(12) United States Patent
Aldred et al.

(10) Patent No.: US 8,815,779 B2
(45) Date of Patent: Aug. 26, 2014

(54) TRANSCRIPTION BIOMARKERS OF BIOLOGICAL RESPONSES AND METHODS

(75) Inventors: Shelley Force Aldred, Hayward, CA (US); Nathan D. Trinklein, Redwood City, CA (US); Michael Rose, Walnut Creek, CA (US); Patrick Collins, Millbrae, CA (US)

(73) Assignee: SwitchGear Genomics, Inc., Menlo Park, CA (US)

( * ) Notice: Subject to any disclaimer, the term of this patent is extended or adjusted under 35 U.S.C. 154(b) by 0 days.

(21) Appl. No.: 12/586,131

(22) Filed: Sep. 16, 2009

(65) Prior Publication Data

US 2011/0065100 A1 Mar. 17, 2011

(51) Int. Cl.
| | | |
|---|---|---|
| C40B 30/06 | (2006.01) | |
| C12Q 1/02 | (2006.01) | |
| C12N 15/00 | (2006.01) | |
| C12Q 1/68 | (2006.01) | |
| C12N 15/63 | (2006.01) | |
| C12N 15/79 | (2006.01) | |

(52) U.S. Cl.
CPC ........ *C12Q 1/6883* (2013.01); *C12Q 2600/136* (2013.01); *C12Q 1/6886* (2013.01)
USPC .......... 506/10; 514/10.2; 536/24.1; 435/91.4; 435/476

(58) Field of Classification Search
None
See application file for complete search history.

(56) References Cited

U.S. PATENT DOCUMENTS

| | | |
|---|---|---|
| 5,143,854 A | 9/1992 | Pirrung |
| 5,242,974 A | 9/1993 | Holmes |
| 5,252,743 A | 10/1993 | Barrett |
| 5,324,633 A | 6/1994 | Fodor |
| 5,384,261 A | 1/1995 | Winkler |
| 5,424,186 A | 6/1995 | Fodor |
| 5,445,934 A | 8/1995 | Fodor |
| 5,451,683 A | 9/1995 | Barrett |
| 5,482,867 A | 1/1996 | Barrett |
| 5,491,074 A | 2/1996 | Aldwin |
| 5,527,681 A | 6/1996 | Holmes |
| 5,550,215 A | 8/1996 | Holmes |
| 5,571,639 A | 11/1996 | Hubbell |
| 5,578,832 A | 11/1996 | Trulson |
| 5,593,839 A | 1/1997 | Hubbell |
| 5,599,695 A | 2/1997 | Pease |
| 5,624,711 A | 4/1997 | Sundberg |
| 5,631,734 A | 5/1997 | Stern |
| 5,677,195 A | 10/1997 | Winkler |
| 5,708,153 A | 1/1998 | Dower |
| 5,744,305 A | 4/1998 | Fodor |
| 5,770,358 A | 6/1998 | Dower |
| 5,789,162 A | 8/1998 | Dower |
| 5,795,716 A | 8/1998 | Chee |
| 5,800,992 A | 9/1998 | Fodor |
| 5,807,522 A | 9/1998 | Brown |
| 5,831,070 A | 11/1998 | Pease |
| 5,837,832 A | 11/1998 | Chee |
| 5,854,004 A | 12/1998 | Czernilofsky |
| 5,856,101 A | 1/1999 | Hubbell |
| 5,858,659 A | 1/1999 | Sapolsky |
| 5,871,928 A | 2/1999 | Fodor |
| 5,888,765 A | 3/1999 | Patterson |
| 5,936,324 A | 8/1999 | Montagu |
| 5,968,740 A | 10/1999 | Fodor |
| 5,974,164 A | 10/1999 | Chee |
| 5,981,185 A | 11/1999 | Matson |
| 5,981,956 A | 11/1999 | Stern |
| 6,025,601 A | 2/2000 | Trulson |
| 6,033,860 A | 3/2000 | Lockhart |
| 6,040,193 A | 3/2000 | Winkler |
| 6,054,270 A | 4/2000 | Southern |
| 6,090,555 A | 7/2000 | Fiekowsky |
| 6,110,426 A | 8/2000 | Shalon |
| 6,200,760 B1 | 3/2001 | Dannenberg |
| 6,232,107 B1 | 5/2001 | Bryan |
| 6,242,211 B1 | 6/2001 | Peterson |
| 6,261,776 B1 | 7/2001 | Pirrung |
| 6,291,183 B1 | 9/2001 | Pirrung |
| 6,537,746 B2 | 3/2003 | Arnold |
| 6,544,790 B1 | 4/2003 | Sabatini |
| 6,605,431 B1 | 8/2003 | Gourse |
| 6,610,482 B1 | 8/2003 | Fodor |
| 6,630,324 B1 | 10/2003 | Barski |
| 6,670,129 B2 | 12/2003 | Webb |

(Continued)

FOREIGN PATENT DOCUMENTS

| | | |
|---|---|---|
| EP | 1176196 | 1/2002 |
| EP | 1447413 A2 | 8/2004 |

(Continued)

OTHER PUBLICATIONS

Trinklein et al., "Identification and Functional Analysis of Human Transcriptional Promoters," Genome Res., vol. 13, No. 2, pp. 308-312 (2003).*
Okazaki, Nature, 420, Dec. 2002, 560-570.*
Trinklein et al. (Genome Res., 2003, 13(2):308-312).*
Okazaki et al. (Nature, 2002, 420:560-570).*
Cooper, Sara J., et al., "Comprehensive analysis of transcriptional promoter structure and function in 1% of the human genome", Genome Res. 2006 16: 1-10.

(Continued)

*Primary Examiner* — Christopher M Babic
*Assistant Examiner* — Jeremy C Flinders
(74) *Attorney, Agent, or Firm* — Storella, P.C.

(57) ABSTRACT

This invention provides transcription regulatory control sequences, the activity of which function as biomarkers for a variety of biological responses. This invention also provides expression constructs in which a biomarker transcription regulatory sequence is operably linked with a sequence for a reporter. Cells that comprise these expression constructs can be used in assays to identify conditions that modulate activity of the biological response.

31 Claims, 102 Drawing Sheets

(56) References Cited

U.S. PATENT DOCUMENTS

| | | |
|---|---|---|
| 6,713,665 B2 | 3/2004 | Crane |
| 6,951,757 B2 | 10/2005 | Sabatini |
| 7,058,515 B1 | 6/2006 | Selifonov |
| 7,060,459 B2 | 6/2006 | Saus |
| 7,067,649 B2 | 6/2006 | Harats |
| 7,084,267 B1 | 8/2006 | Keith |
| H2191 H | 6/2007 | Wang |
| 2002/0006664 A1 | 1/2002 | Sabatini |
| 2003/0008283 A1 | 1/2003 | Li |
| 2003/0211481 A1 | 11/2003 | Erives |
| 2004/0005577 A1 | 1/2004 | Rosen |
| 2004/0043468 A1 | 3/2004 | Mauro |
| 2004/0091866 A1 | 5/2004 | Giordano |
| 2004/0129543 A1 | 7/2004 | Voltz |
| 2004/0146964 A1 | 7/2004 | Maxwell |
| 2004/0219543 A1 | 11/2004 | Wirtz |
| 2005/0074827 A1 | 4/2005 | Muh |
| 2005/0084848 A1 | 4/2005 | Phillips |
| 2006/0183115 A1 | 8/2006 | Wang |
| 2006/0263764 A1 | 11/2006 | Pachuk |
| 2007/0072175 A1 | 3/2007 | Cooper |
| 2007/0161031 A1 | 7/2007 | Trinklein |
| 2007/0243176 A1 | 10/2007 | Escobedo |
| 2007/0258895 A1* | 11/2007 | Wang ............................ 424/9.1 |
| 2008/0044436 A1 | 2/2008 | Hum |
| 2008/0220983 A1 | 9/2008 | Trinklein |
| 2009/0018031 A1 | 1/2009 | Trinklein |

FOREIGN PATENT DOCUMENTS

| | | |
|---|---|---|
| WO | WO-0157190 | 8/2001 |
| WO | WO-0231111 | 4/2002 |
| WO | WO-03031568 | 8/2003 |
| WO | 03/072035 A2 | 9/2003 |
| WO | WO-2011034935 | 3/2011 |

OTHER PUBLICATIONS

Gao, Fen-Biao et al., "Selection of a subset of mRNAs from combinatorial 3' untranslated region libraries using neuronal RNA-binding protein Hel-N1", Proc. Natl. Acad. Sci. USA, 91 (1994), p. 11207-11211.

Guillemin, K. et al., "The Hypoxic Response: Huffing and HIFing", Cell, 89 (1997), p. 9-12.

Lewis, Benjamin P., et al., "Prediction of Mammalian MicroRNA Targets", Cell, 115 (2003), p. 787-798.

Liu, J. et al., "Identification of cell type-specific promoter elements associated with the rat tyrosine hydroxylase gene using transgenic founder analysis", Molecular Brain Research, 50 (1997), p. 33-42.

Lonnerberg, Peter et al., "Cell Type-specific Regulation of Choline Acetyltransferase Gene Expression", The Journal of Biological Chemistry, 271 (1996), p. 33358-33365.

Min, Nan et al., "5' Upstream DNA sequence of the rat tyrosine hydroxylase gene directs high-level and tissue-specific expression to catecholaminergic neurons in the central nervous system of transgenic mice", Molecular Brain Research, 27 (1994), p. 281-289.

Okazaki, Y. et al., Analysis of the mouse transcriptome based on functional annotation of 60,770 full-length cDNAs, Nature, 420 (2002), p. 563-573.

Suzuki, Yutaka et al., "Identification and Characterization of the Potential Promoter Regions of 1031 Kinds of Human Genes", Genome Res., 11 (2001), p. 677-684.

Trinklein, Nathan D., et al., "An Abundance of Bidirectional Promoters in the Human Genome", Genome Res., 14 (2004), p. 62-66.

Trinklein, Nathan D., et al., "Identification and Functional Analysis of Human Transcriptional Promoters", Genome Res., 13 (2003), p. 308-312.

Ahituv, N., et al., "Exploiting human-fish genome comparisons for deciphering gene regulation", Human Molecular Genetics, 13 (2004), 261-266.

Bailey, T.L., et al., "Fitting a Mixture Model by Expectation Maximization to Discover Motifs in Biopolymers", UCSD Technical Report CS94-351, University of California at San Diego, San Diego (Mar. 1994), 33 p.

Bailey, T.L., et al., "Fitting a Mixture Model by Expectation Maximization to Discover Motifs in Biopolymers", Proceedings of the Second International Conference on Intelligent Systems for Molecular Biology, AAAI Press (Aug. 1994), 28-36.

Bertone, P., et al., "Global Identification of Human Transcribed Sequences with Genome Tiling Arrays", Science, 306 (Dec. 24, 2004), 2242-2246.

Blais, A., et al., "Hitting their targets: an emerging picture of E2F and cell cycle control", Current Opinion in Genetics & Development, 14 (2004), 527-532.

Brudno, M., et al., "LAGAN and Multi-LAGAN: Efficient Tools for Large-Scale Multiple Alignment of Genomic DNA", Genome Research, 13 (2003), 721-731.

Buckland, P.R., et al., "Stong Bias in the Location of Functional Promoter Polymorphisms", Human Mutation, 26 (2005), 214-223.

Butler, J.E.F., et al., "The RNA polymerase II core promoter: a key component iin theregualation of gene expression", Genes & Development, 16 (2002), 2583-2592.

Carlson, C.S., et al., "Polymorphisms within the C-Reactive Protein (CRP) Promoter Region Are Associated with Plasma CRP Levels", Am. J. Hum. Genet., 77 (2005), 64-77.

Casey, J.L., et al., "Two genetic loci participate in the regulation by iron of the gene for the human transferrin receptor", Proc. Natl. Acad. Sci. USA, 85 (Mar. 1998) 1787-1791.

Collins, F.S., et al., "A point mutation in the Aγ-globin gene promoter in Greek hereditary persistence of fetal haemoglobin", Nature, 33 (Jan. 24, 1985), 325-326.

Conne, B., et al., "The 3' untranslated region of messenger RNA: A molecular 'hotspot' for pathology?", Nature Medicine, 6 (Jun. 2000), 637-641.

Cooper, G.M., et al., "Distribution and intensity of constraint in mammalian genomic sequence", Genome Research, 15 (2005), 901-913.

Davuluri, R.V., et al., "CART Classification of Human 5' UTR Sequences", Genome Research, 10 (Nov. 2000), 1807-1816.

Dixon, W.J., "Analysis of Extreme Values", The Annals of Mathematical Statistics, 21 (1950), 488-506.

The ENCODE Project Consortium, "Identification and analysis of functional elements in 1% of the human genome by the ENCODE pilot project", Nature, 447 (Jun. 2007), 799-816.

The ENCODE Project Consortium, "The ENCODE (ENCyolpedia of DNA Elements) Project", Science, 306 (Oct. 22, 2004), 636-640.

European Patent Application No. 08726512.0, Search Report mailed Nov. 11, 2010, 7 p.

Evans, W.E., et al., "Pharmacogenomics: Translating Functional Genomics into Rational Therapeutics", Science, 286 (1999), 487-491.

The FANTOM Consortium and the RIKEN Genomic Exploration Research Group Phase I & II Team, "Analysis of the mouse transcriptome based on functional annotations of 60,770 full-length cDNAs", Nature, 420 (Dec. 5, 2002), 563-573.

Fodor, S.P.A., et al., "Light-Directed, Spatially Addressable Parallel Chemical Synthesis", Science, 251 (Feb. 15, 1991), 767-773.

The Gene Ontology, home page [online], [retrieved on Mar. 14, 2008]. Retrieved from the Internet: <URL: http://www.geneontolgy.org/> (2008), 2 p.

Gentles, A.J., et al., Why are human G-protein-coupled receptors predominantly intronless?, Trends in Genetics, 15 (Feb. 1999), 47-49.

Hattori, M., et al., "Homo sapiens genomic DNA, chromosome Un, clone:CMC-190A2, telomere region, complete sequence", NCBI Sequence Viewer,Entrez, Accession AP006221, National Institutes of Health (1993) [online], [retrieved Jan. 24, 2008]. Retrieved from the Internet <URL: http://www.ncbi.nlm.nih.gov/entrez/viewer.fcgi?db=nuccore&id=28411657>, 12 p.

Hentschel, C.C., et al., "The Organization and Expression of Histone Gene Families", Cell, 25 (Aug. 1981), 301-313.

Howard, M.L., et al, "cis-Regulatory control circuits in development", Developmental Biology, 271 (2004), 109-118.

(56) References Cited

OTHER PUBLICATIONS

The I.M.A.G.E. Consortium, home page [online], [retrieved on Jun. 12, 2008]. Retrieved from the Internet: <URL: http://image.llnl.gov/> (2008), 1 p.
Imanishi, T., et al., "Integrative Annotation of 21,037 Human Genes Validated by Full-Length cDNA Clones", PLoS Biology, 2 (Jun. 2004), 0856-0875.
Kamura, N., et al., "Selection of 5'-untranslated sequences that enhance initiation of translation in a cell-free protein synthesis system from wheat embryos" Bioorganic & Medicinal Chemistry Letters, 15 (2005), 5402-5406.
Kanamori, H., et al., "Differential Display Combined with a Regulated Transient Expression System", BioTechniques, 26 (Jun. 1999), 1018-1020.
Kapranov, P., et al., "Large-Scale Transcriptional Activity in Chromosomes 21 and 22", Science, 296 (May 3, 2002), 916-919.
Karolchik, D., et al., "The UCSC Genome Browser Database", Nucleic Acids Research, 31 (2003), 51-54.
Kaul, R.K., et al., "Homo sapiens chromosome 1 clone RP4-700A9, complete sequence", NCBI Sequence Viewer, Accession AC099680, National Institutes of Health (2002) [online], [retrieved Sep. 6, 2011]. Retrieved from the Internet <URL: http://www.ncbi.nlm.nih.gov/nuccore/AC099680>, 25 p.
Kim, N., et al., "A Novel Member of the Leukocyte Receptor Complex Regulates Osteoclast Differentiation", J. Exp. Med., 195 (Jan. 21, 2002), 201-209.
Kim, T.H., et al., "Direct isolation and identification of promoters in the human genome", Genome Research, 15 (2005), 830-839.
Kimmel, A.R., et al., "Preparation of cDNA and the Generation of cDNA Libraries: Overview", Methods in Enzymology, 152 (1987), 307-316.
Krumm, A., et al., "The block to transcriptional elongation within the human c-myc gene is determined in the promoter-proximal region", Genes & Development, 6 (1992), 2201-2213.
Krumm, A., et al., "Promoter-proximal pausing of RNA polymerase II defines a general rate-limiting step after transcription initiation", Genes & Development, 9 (1995), 559-572.
Kulozik, A.E., et al., "Thalassemia Intermedia: Moderate Reduction of β Globin Gene Transcriptional Activity by a Novel Mutation of the Proximal CACCC Promoter Element", Blood, 77 (May 1, 1991), 2054-2058.
Landry, J.R., et al., "Complex controls: the role of alternative promoters in mammalian genomes", Trends in Genetics, 19 (Nov. 2003), 640-648.
Le, P.P., et al., "Glucocorticoid Receptor-Dependent Gene Regulatory Networks", PLoS Genetics, 1 (Aug. 2005), 0159-0170.
Liu, X., et al., "Bioprospector: discovering conserved DNA motifs in upstream regulatory regions of co-expressed genes", Pacific Symposium on Biocomputing, 6 (2001), 127-138.
Lonnerberg, P., et al., "Cell Type-specific Regulation of *Choline Acetyltransferase* Gene Expression", The Journal of Biological Chemistry, 271 (Dec. 27, 1996), 33358-33365.
Lunyak, V.V., et al., "REST and Peace for the Neuronal-Specific Transcriptional Program", Ann. N.Y. Acad. Sci., 1014 (2004) 110-120.
Mazumder, B., et al., "Translational control by the 3'-UTR: the ends specify the means", Trends in Biochemical Sciences, 28 (Feb. 2003), 91-98.
Metzen, E., et al., "Intracellular localisation of human HIF-1a hydroxylases: implications for oxygen sensing", J. Cell Sci., 116 (2003), 1319-1326.
Metzen, E., et al., "Regulation of the prolyl hydroxylase domain protein 2 (phd2/egln-1) gene: identification of a functional hypoxia-responsive element", Biochem. J., 387 (2005), 711-717.
Meyer, S., et al., "Messenger RNA Turnover in Eukaryotes: Pathways and Enzymes", Critical Reviews in Biochemistry and Molecular Biology, 39 (2004), 197-216.
The MGC Project Team, "The Status, Quality, and Expansion of the NIH Full-Length cDNA Project: The Mammalian Gene Collection (MGC)", Genome Research, 14 (2004), 2121-2127.
Mullner, E.W., et al., "A Stem-Loop in the 3' Unstranslated Region Mediates Iron-Dependent Regulation of Transferrin Receptor mRNA Stability in the Cytoplasm", Cell, 53 (Jun. 3, 1988), 815-825.
Murray, J.I., et al., "Diverse and Specific Gene Expression Responses to Stresses in Cultured Human Cells", Molecular Biology of the Cell, 15 (May 2004), 2361-2374.
Myers, R.M., et al., "Fine Structure Genetic Analysis of a β-Globin Promoter", Science, 232 (May 2, 1986), 613-618.
National Institutes of Health, Mammalian Gene Collection, home page [online], [retrieved on May 22, 2008]. Retrieved from the Internet: <URL: http://mgc.nci.nih.gov/> (2008), 2 p.
National Institutes of Health, NCBI RefSeq, home page [online], [retrieved on Mar. 14, 2008]. Retrieved from the Internet: <URL: http://www.ncbi.nlm.nih.gov/RefSeq/> (2008), 4 p.
National Institutes of Health, NCBI RefSeq, home page, Release 28 [online], [retrieved on Mar. 14, 2008]. Retrieved from the Internet: <URL: http://www.ncbi.nlm.nih.gov/RefSeq/> (2008), 4 p.
National Institutes of Health, NCBI RefSeq, home page, Release 29 [online], [retrieved on May 22, 2008]. Retrieved from the Internet: <URL: http://www.ncbi.nlm.nih.gov/RefSeq/> (2008), 3 p.
Ogbourne, S., et al., "Transcriptional control and the role of silencers in transcriptional regulation in eukaryotes", Biochem. J., 331 (1998), 1-14.
Perier, R.C., et al., "The Eukaryotic Promoter Database EPD", Nucleic Acids Research, 26 (1998), 353-357.
Pesole, G., et al., "UTRdb and UTRsite: specialized databases of sequences and functional elements of 5' and 3' untranslated regions of eukaryotic mRNAs. Update 2002", Nucleic Acids Research, 30 (2002), 335-340.
Pirkkala, L., et al., "Roles of the heat shock transcription factors in regulation of the heat shock response and beyond", The FASEB Journal, 15 (May 2001), 1118-1131.
Praz, V., et al., "The Eukaryotic Promoter Database, EPD: new entry types and links to gene expression data", Nucleic Acids Research, 30 (2002), 322-324.
Rimokh, R., et al., "Rearrangment of CCND1 (BCL1/PRAD1) 3' Untranslated Region in Mantle-Cell Lymphomas and t(11q13)—Associated Leukemias", Blood, 83 (Jun. 15, 1994), 3689-3696.
Rozen, S. et al., "Primer3 on the WWW for General Users and for Biologist Programmers", Methods in Molecular Biology, 132 (2000), 365-386.
Schoenherr, C.J., et al., "Identification of potential target genes for the neuron-restrictive silencer factor", Proc. Natl. Acad. Sci. USA, 93 (1996), 9881-9886.
Schoenherr, C.J., et al., "The Neuron-Restrictive Silencer Factor (NRSF): A Coordinate Repressor of Multiple Neuron-Specific Genes", Science, 267 (Mar. 3, 1995), 1360-1363.
Score, sequence listing for Cooper et al., U.S. Patent Application Publication No. 2007/0072175 [online]. [retrieved on Mar. 9, 2010]. Retrieved from the Internet: <URL: http://es/ScoreAccessWeb/viewSeqIdResult.action>, 5 p.
Suzuki, Y., et al., "DBTSS: DataBase of human Transcriptional Start Sites and full-length cDNAs", Nucleic Acids Research, 30 (2002), 328-331.
Suzuki, Y., et al., "DBTSS: DataBase of Transcriptional Start Sites: progress report 2004", Nucleic Acids Research, 32 (2004), D78-D81.
Suzuki, Y., et al., "Identification and Characterization of the Potential Promoter Regions of 1031 Kinds of Human Genes", Genome Research, 11 (2001), 677-684.
Suzuki-Yagawa, Y., et al., "The ts13 Mutation in the TAFII250 Subunit (CCG1) of TFIID Directly Affects Transcription of D-Type Cyclin Genes in Cells Arrested in G1 at the Nonpermissive Temperature", Molecular and Cellular Biology, 17 (Jun. 1997), 3284-3294.
Tarnasky, H., et al., "A novel testis-specific gene, SPAG4, whose product interacts specifically with outer dense fiber protein ODF27, maps to human chromosome 20q11.2", Cytogenet. Cell Genet., 81 (1998), 65-67.
Tatarelli, C., et al., "Characterization of the Human TESTIN Gene Localized in the FRA7G Region at 7q31.2", Genomics, 68 (2000), 1-12.
Theodorakis, N.G., et al,. "Posttranscriptional Regulation of hsp70 Expression in Human Cells: Effects of Heat Shock, Inhibition of

(56) References Cited

OTHER PUBLICATIONS

Protein Synthesis, and Adenovirus Infection on Translation and mRNA Stability", Molecular and Cellular Biology, 7 (Dec. 1987), 4357-4368.

Trinklein, N.D., et al., "The Role of Heat Shock Transcription Factor 1 in the Genome-wide Regulation of the Mammalian Heat Shock Response", Molecular Biology of the Cell, 15 (Mar. 2004), 1254-1261.

Trinklein, N.D., et al., "An Abundance of Bidirectional Promoters in the Human Genome", Genome Research, 14 (2004), 62-66.

Trinklein, N.D., et al., "Transcriptional regulation and binding of heat shock factor 1 and heat shock factor 2 to 32 human heat shock genes during thermal stress and differentiation", Cell Stress & Chaperones, 9 (2004), 21-28.

Trinklein, N.D., et al., "Integrated analysis of experimental data sets reveals many novel promoters in 1% of the human genome", Genome Research, 17 (2007), 720-731.

Wang, E.H., "Promoter-Selective Transcriptional Defect in Cell Cycle Mutant ts13 Rescued by hTAFII250", Science, 263 (Feb. 11, 1994), 811-814.

Weiler, J., et al., "Hybridisation based DNA screening on peptide nucleic acid (PNA) oligomer arrays", Nucleic Acids Research, 25 (1997), 2792-2799.

Weiss, I.M., et al., "Erythroid Cell-Specific mRNA Stability Elements in the α2-Globin 3' Nontranslated Region", Molecular and Cellular Biology, 15 (May 1995), 2457-2465.

Wilson, et al., "A Novel Cell Line, MDA-kb2, That Stably Expresses an Androgent and Glucocorticoid-Responsive Reporter for the Detection of Hormone Receptor Agonists and Antagonists," Toxicological Sciences, 66 (2002), 69-81.

Wilusz, C.J., et al., "Bringing the role of mRNA decay in the control of gene expression into focus", Trends in Genetics, 20 (Oct. 2004), 491-497.

Xie, X, et al., "Systematic discovery of regulatory motifs in human promoters and 3' UTRs by comparison of several mammals", Nature, 434 (Mar. 17, 2005), 338-345.

Yang, A., et al., "p63, a p53 Homolog at 3q27-29, Encodes Multiple Products with Transactivating, Death-Inducing, and Dominant-Negative Activities", Molecular Cell, 2 (Sep. 1998), 305-316.

U.S. Appl. No. 11/999,792, official Updated Filing Receipt mailed Oct. 7, 2008, and Specification, Claims, Abstract, and Drawings as filed on Dec. 6, 2007 (65 p.).

U.S. Appl. No. 11/636,385, Sequence Listing filed Dec. 7, 2006 (6 p.).

U.S. Appl. No. 11/636,385, Office Action mailed Jan. 9, 2009 (18 p.).

International Application No. PCT/US2010/048950, International Search Report published as WO 2011/034935 A3 on Oct. 6, 2011 (7 p.).

Yasumoto, K-I. et al. "Role of the intracellular localization 1-55 of HIF-prolyl hydroxylases", Biochim. Biophy. Acta, Feb. 2009(available on line), vol. 1793, pp. 792-797. See abstract, fig. 1 and materials and methods.]].

* cited by examiner

*FIG. 1A* TABLE 1 TRANSCRIPTIONAL BIOMARKER FUNCTIONAL DATA
PART 1
SECTION 1:

| LINE_ID | GENE_SYMBOL | SEQUENCE_ID_LISTING | PROM_ACTIVITY_N O_INDUCTION | PROM_ACTIVITY_WI TH_INDUCTION | INDUCTION RATIO | INDUCTION_CONDITIONS* |
|---|---|---|---|---|---|---|
| 1 | EGLN1 | SEQ ID NO. 1 | 732.385 | 1154.843 | 1.577 | HYPOX_DFO_HCT116 |
| 2 | EGLN1 | SEQ ID NO. 1 | 8.435 | 292.298 | 34.654 | HYPOX_DFO_HT1080 |
| 3 | EGLN1 | SEQ ID NO. 1 | 732.385 | 1989.674 | 2.717 | HYPOX_O2_HCT116 |
| 4 | EGLN1 | SEQ ID NO. 1 | 8.435 | 231.019 | 27.389 | HYPOX_O2_HT1080 |
| 5 | LDHA | SEQ ID NO. 2 | 1306.69 | 9656.519 | 7.39 | HYPOX_DFO_HCT116 |
| 6 | LDHA | SEQ ID NO. 2 | 106.747 | 2987.773 | 27.989 | HYPOX_DFO_HT1080 |
| 7 | LDHA | SEQ ID NO. 2 | 1306.69 | 4101.176 | 3.139 | HYPOX_O2_HCT116 |
| 8 | LDHA | SEQ ID NO. 2 | 106.747 | 1712.725 | 16.045 | HYPOX_O2_HT1080 |
| 9 | GAPDH | SEQ ID NO. 3 | 567 | 1030.545 | 1.818 | HYPOX_DFO_HCT116 |
| 10 | GAPDH | SEQ ID NO. 3 | 208.992 | 956.212 | 4.575 | HYPOX_DFO_HT1080 |
| 11 | GAPDH | SEQ ID NO. 3 | 567 | 1038.687 | 1.832 | HYPOX_O2_HCT116 |
| 12 | GAPDH | SEQ ID NO. 3 | 208.992 | 672.815 | 3.219 | HYPOX_O2_HT1080 |
| 13 | ALDOA | SEQ ID NO. 4 | 3644.442 | 13844.666 | 3.799 | HYPOX_DFO_HCT116 |
| 14 | ALDOA | SEQ ID NO. 4 | 686.221 | 2889.334 | 4.21 | HYPOX_DFO_HT1080 |
| 15 | ALDOA | SEQ ID NO. 4 | 3644.442 | 10296.92 | 2.825 | HYPOX_O2_HCT116 |
| 16 | ALDOA | SEQ ID NO. 4 | 686.221 | 1461.874 | 2.13 | HYPOX_O2_HT1080 |
| 17 | ALDOC | SEQ ID NO. 5 | 2899.784 | 4431.376 | 1.528 | HYPOX_DFO_HCT116 |
| 18 | ALDOC | SEQ ID NO. 5 | 92.432 | 574.525 | 6.216 | HYPOX_DFO_HT1080 |
| 19 | ALDOC | SEQ ID NO. 5 | 2899.784 | 4376.288 | 1.509 | HYPOX_O2_HCT116 |
| 20 | ALDOC | SEQ ID NO. 5 | 92.432 | 365.504 | 3.954 | HYPOX_O2_HT1080 |
| 21 | HK2 | SEQ ID NO. 6 | 2427.985 | 13969.978 | 5.754 | HYPOX_DFO_HCT116 |
| 22 | HK2 | SEQ ID NO. 6 | 19.517 | 1560.932 | 79.976 | HYPOX_DFO_HT1080 |
| 23 | HK2 | SEQ ID NO. 6 | 2427.986 | 10507.561 | 4.328 | HYPOX_O2_HCT116 |
| 24 | HK2 | SEQ ID NO. 6 | 19.517 | 928.374 | 47.566 | HYPOX_O2_HT1080 |

*FIG. 1B* -- TABLE 1 TRANSCRIPTIONAL BIOMARKER FUNCTIONAL DATA
SECTION 1

| LINE_ID | GENE_SYMBOL | SEQUENCE_ID_LISTING | PROM_ACTIVITY_NO_INDUCTION | PROM_ACTIVITY_WITH_INDUCTION | INDUCTION_RATIO | INDUCTION_CONDITIONS* |
|---|---|---|---|---|---|---|
| 25 | TFRC | SEQ ID NO. 7 | 3880.483 | 13834.58 | 3.565 | HYPOX_DFO_HCT116 |
| 26 | TFRC | SEQ ID NO. 7 | 408.651 | 1834.062 | 4.488 | HYPOX_DFO_HT1080 |
| 27 | TFRC | SEQ ID NO. 7 | 3880.483 | 7869.671 | 2.028 | HYPOX_O2_HCT116 |
| 28 | TFRC | SEQ ID NO. 7 | 408.651 | 963.829 | 2.359 | HYPOX_O2_HT1080 |
| 29 | CA9 | SEQ ID NO. 8 | 112.752 | 200.984 | 1.783 | HYPOX_DFO_HCT116 |
| 30 | CA9 | SEQ ID NO. 8 | 1.258 | 123.533 | 98.237 | HYPOX_DFO_HT1080 |
| 31 | CA9 | SEQ ID NO. 8 | 112.752 | 565.723 | 5.017 | HYPOX_O2_HCT116 |
| 32 | CA9 | SEQ ID NO. 8 | 1.258 | 87.797 | 69.819 | HYPOX_O2_HT1080 |
| 33 | PGK1 | SEQ ID NO. 9 | 633.088 | 5453.643 | 8.614 | HYPOX_DFO_HCT116 |
| 34 | PGK1 | SEQ ID NO. 9 | 151.596 | 669.957 | 4.419 | HYPOX_DFO_HT1080 |
| 35 | PGK1 | SEQ ID NO. 9 | 633.088 | 2931.336 | 4.63 | HYPOX_O2_HCT116 |
| 36 | PGK1 | SEQ ID NO. 9 | 151.596 | 274.798 | 1.813 | HYPOX_O2_HT1080 |
| 37 | ENO2 | SEQ ID NO. 10 | 915.281 | 1522.224 | 1.663 | HYPOX_DFO_HCT116 |
| 38 | ENO2 | SEQ ID NO. 10 | 144.329 | 1429.9 | 9.907 | HYPOX_DFO_HT1080 |
| 39 | ENO2 | SEQ ID NO. 10 | 915.281 | 2657.514 | 2.903 | HYPOX_O2_HCT116 |
| 40 | ENO2 | SEQ ID NO. 10 | 144.329 | 954.14 | 6.611 | HYPOX_O2_HT1080 |
| 41 | PDK1 | SEQ ID NO. 11 | 32.378 | 151.803 | 4.688 | HYPOX_DFO_HCT116 |
| 42 | PDK1 | SEQ ID NO. 11 | 0.776 | 58.13 | 74.927 | HYPOX_DFO_HT1080 |
| 43 | PDK1 | SEQ ID NO. 11 | 32.378 | 136.252 | 4.208 | HYPOX_O2_HCT116 |
| 44 | PDK1 | SEQ ID NO. 11 | 0.776 | 23.971 | 30.897 | HYPOX_O2_HT1080 |
| 45 | MIF | SEQ ID NO. 12 | 52.071 | 269.38 | 5.173 | HYPOX_DFO_HCT116 |
| 46 | MIF | SEQ ID NO. 12 | 1.698 | 22.283 | 13.119 | HYPOX_DFO_HT1080 |
| 47 | MIF | SEQ ID NO. 12 | 52.071 | 222.336 | 4.271 | HYPOX_O2_HCT116 |
| 48 | MIF | SEQ ID NO. 12 | 1.698 | 21.16 | 12.458 | HYPOX_O2_HT1080 |

FIG. 1C -- TABLE 1 TRANSCRIPTIONAL BIOMARKER FUNCTIONAL DATA
SECTION 1

| LINE_ID | GENE_SYMBOL | SEQUENCE_ID_LISTING | PROM_ACTIVITY_NO_INDUCTION | PROM_ACTIVITY_WITH_INDUCTION | INDUCTION_RATIO | INDUCTION_CONDITIONS* |
|---|---|---|---|---|---|---|
| 49 | HIG2 | SEQ ID NO. 13 | 2563.952 | 8013.064 | 3.125 | HYPOX_DFO_HCT116 |
| 50 | HIG2 | SEQ ID NO. 13 | 232.211 | 1351.21 | 5.819 | HYPOX_DFO_HT1080 |
| 51 | HIG2 | SEQ ID NO. 13 | 2563.952 | 9981.119 | 3.893 | HYPOX_O2_HCT116 |
| 52 | HIG2 | SEQ ID NO. 13 | 232.211 | 666.439 | 2.87 | HYPOX_O2_HT1080 |
| 53 | ANKRD37 | SEQ ID NO. 14 | 2361.653 | 13975.168 | 5.918 | HYPOX_DFO_HCT116 |
| 54 | ANKRD37 | SEQ ID NO. 14 | 32.418 | 1760.782 | 54.315 | HYPOX_DFO_HT1080 |
| 55 | ANKRD37 | SEQ ID NO. 14 | 2361.653 | 9515.659 | 4.029 | HYPOX_O2_HCT116 |
| 56 | ANKRD37 | SEQ ID NO. 14 | 32.418 | 897.264 | 27.678 | HYPOX_O2_HT1080 |
| 57 | P4HA2 | SEQ ID NO. 15 | 1104.155 | 2048.364 | 1.855 | HYPOX_DFO_HCT116 |
| 58 | P4HA2 | SEQ ID NO. 15 | 31.08 | 239.969 | 7.721 | HYPOX_DFO_HT1080 |
| 59 | P4HA2 | SEQ ID NO. 15 | 1104.155 | 2901.76 | 2.628 | HYPOX_O2_HCT116 |
| 60 | P4HA2 | SEQ ID NO. 15 | 31.08 | 223.71 | 7.198 | HYPOX_O2_HT1080 |
| 61 | YEATS2 | SEQ ID NO. 16 | 889.621 | 1044.798 | 1.174 | HYPOX_DFO_HCT116 |
| 62 | YEATS2 | SEQ ID NO. 16 | 68.812 | 150.291 | 2.184 | HYPOX_DFO_HT1080 |
| 63 | YEATS2 | SEQ ID NO. 16 | 889.621 | 2879.097 | 3.236 | HYPOX_O2_HCT116 |
| 64 | YEATS2 | SEQ ID NO. 16 | 68.812 | 217.153 | 3.156 | HYPOX_O2_HT1080 |
| 65 | HK1 | SEQ ID NO. 17 | 201.908 | 388.148 | 1.922 | HYPOX_DFO_HCT116 |
| 66 | HK1 | SEQ ID NO. 17 | 20.592 | 66.208 | 3.215 | HYPOX_DFO_HT1080 |
| 67 | HK1 | SEQ ID NO. 17 | 201.908 | 454.671 | 2.252 | HYPOX_O2_HCT116 |
| 68 | HK1 | SEQ ID NO. 17 | 20.592 | 89.461 | 4.344 | HYPOX_O2_HT1080 |
| 69 | ENO1 | SEQ ID NO. 18 | 2508.594 | 12447.003 | 4.962 | HYPOX_DFO_HCT116 |
| 70 | ENO1 | SEQ ID NO. 18 | 733.645 | 3491.341 | 4.759 | HYPOX_DFO_HT1080 |
| 71 | ENO1 | SEQ ID NO. 18 | 2508.594 | 6152.489 | 2.453 | HYPOX_O2_HCT116 |
| 72 | ENO1 | SEQ ID NO. 18 | 733.645 | 2120.542 | 2.89 | HYPOX_O2_HT1080 |

*FIG. 1D* -- TABLE 1 TRANSCRIPTIONAL BIOMARKER FUNCTIONAL DATA

SECTION 2:

| LINE_ID | GENE_SYMBOL | SEQUENCE_ID_LISTING | PROM_ACTIVITY_N O_INDUCTION | PROM_ACTIVITY_WI TH_INDUCTION | INDUCTION RATIO | INDUCTION_CONDITIONS* |
|---|---|---|---|---|---|---|
| 73 | ASB2 | SEQ ID NO. 19 | 1.209 | 3.222 | 2.664 | ER |
| 74 | SYT8 | SEQ ID NO. 20 | 0.907 | 5.032 | 5.551 | ER |
| 75 | KRT13 | SEQ ID NO. 21 | 1.427 | 8.421 | 5.9 | ER |
| 76 | NULL | SEQ ID NO. 22 | 17.172 | 40.397 | 2.353 | ER |
| 77 | NNT | SEQ ID NO. 23 | 0.981 | 3.42 | 3.487 | ER |
| 78 | C14orf133 | SEQ ID NO. 24 | 51.361 | 82.848 | 1.609 | ER |
| 79 | C1orf151 | SEQ ID NO. 25 | 14.024 | 34.468 | 2.458 | ER |
| 80 | TFAP2C | SEQ ID NO. 26 | 1.041 | 3.039 | 2.92 | ER |
| 81 | CAT | SEQ ID NO. 27 | 9.629 | 80.616 | 8.372 | ER |
| 82 | DDAH2 | SEQ ID NO. 28 | 1.245 | 6.579 | 5.283 | ER |
| 83 | SLC25A36 | SEQ ID NO. 29 | 0.845 | 2.971 | 3.515 | ER |
| 84 | NULL | SEQ ID NO. 30 | 59.787 | 282.204 | 4.72 | ER |
| 85 | MICALL2 | SEQ ID NO. 31 | 4.538 | 23.994 | 5.288 | ER |

FIG. 1E -- TABLE 1 TRANSCRIPTIONAL BIOMARKER FUNCTIONAL DATA
SECTION 3:

| LINE_ID | GENE_SYMBOL | SEQUENCE_ID_LISTING | PROM_ACTIVITY_N O_INDUCTION | PROM_ACTIVITY_WI TH_INDUCTION | INDUCTION RATIO | INDUCTION_CONDITIONS* |
|---|---|---|---|---|---|---|
| 86 | PMEPA1 | SEQ ID NO. 32 | 1.42 | 5.92 | 4.18 | AR |
| 87 | EGLN3 | SEQ ID NO. 33 | 2.47 | 6.46 | 2.61 | AR |
| 88 | DSEL | SEQ ID NO. 34 | 0.52 | 15.34 | 29.31 | AR |
| 89 | NAT1 | SEQ ID NO. 35 | 4.04 | 11.6 | 2.87 | AR |
| 90 | KLK2 | SEQ ID NO. 36 | 0.05 | 2.41 | 48.83 | AR |
| 91 | C1orf21 | SEQ ID NO. 37 | 0.2 | 3.84 | 19.06 | AR |
| 92 | SGK1 | SEQ ID NO. 38 | 0.79 | 4.5 | 5.68 | AR |
| 93 | TIPARP | SEQ ID NO. 39 | 1.12 | 7.91 | 7.06 | AR |
| 94 | PRKCD | SEQ ID NO. 40 | 4.05 | 19.99 | 4.94 | AR |
| 95 | PMEPA1 | SEQ ID NO. 41 | 1.19 | 5.49 | 4.63 | AR |
| 96 | CDC42EP3 | SEQ ID NO. 42 | 0.24 | 2.49 | 10.3 | AR |
| 97 | FNBP1L | SEQ ID NO. 43 | 0.24 | 4.55 | 19.04 | AR |
| 98 | UAP1 | SEQ ID NO. 44 | 1.79 | 5.81 | 3.25 | AR |
| 99 | JAG1 | SEQ ID NO. 45 | 0.55 | 11.01 | 19.88 | AR |
| 100 | BARD1 | SEQ ID NO. 46 | 1.75 | 4.84 | 2.76 | AR |

FIG. 1F -- TABLE 1 TRANSCRIPTIONAL BIOMARKER FUNCTIONAL DATA
SECTION 4:

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS* |
|---|---|---|---|---|---|---|
| 101 | NULL | SEQ ID NO. 47 | 1.16 | 3.971 | 3.424 | P53 |
| 102 | KANK1 | SEQ ID NO. 48 | 0.793 | 5.275 | 6.651 | P53 |
| 103 | DDI2 | SEQ ID NO. 49 | 31.304 | 128.359 | 4.1 | P53 |
| 104 | E2F7 | SEQ ID NO. 50 | 1.768 | 11.073 | 6.263 | P53 |
| 105 | VWA5A | SEQ ID NO. 51 | 0.994 | 2.229 | 2.242 | P53 |
| 106 | NULL | SEQ ID NO. 52 | 0.483 | 2.843 | 5.887 | P53 |
| 107 | CDKN1A | SEQ ID NO. 53 | 41.286 | 114.848 | 2.782 | P53 |
| 108 | TRAF6 | SEQ ID NO. 54 | 8.431 | 14.494 | 1.719 | P53 |
| 109 | NULL | SEQ ID NO. 55 | 3.02 | 17.518 | 5.8 | P53 |
| 110 | TP73 | SEQ ID NO. 56 | 1.331 | 19.66 | 14.766 | P53 |
| 111 | TP53INP1 | SEQ ID NO. 57 | 301.135 | 1137.284 | 3.777 | P53 |
| 112 | SERPINE1 | SEQ ID NO. 58 | 5.233 | 23.067 | 4.408 | P53 |
| 113 | ARG2 | SEQ ID NO. 59 | 2.54 | 12.893 | 5.076 | P53 |
| 114 | GPX1 | SEQ ID NO. 60 | 3.612 | 9.722 | 2.692 | P53 |

*FIG. 1G* -- TABLE 1 TRANSCRIPTIONAL BIOMARKER FUNCTIONAL DATA
SECTION 5:

| LINE_ID | GENE_SYMBOL | SEQUENCE_ID_LISTING | PROM_ACTIVITY_NO_INDUCTION | PROM_ACTIVITY_WITH_INDUCTION | INDUCTION_RATIO | INDUCTION_CONDITIONS* |
|---|---|---|---|---|---|---|
| 115 | LSS | SEQ ID NO. 61 | 9.095 | 52.183 | 5.738 | SREBP_LOV |
| 116 | LSS | SEQ ID NO. 61 | 9.095 | 4.087 | 0.449 | SREBP_SYNTH |
| 117 | LSS | SEQ ID NO. 61 | 9.095 | 42.583 | 4.682 | SREBP_U18666A |
| 118 | HMGCS1 | SEQ ID NO. 62 | 11.3 | 43.771 | 3.874 | SREBP_LOV |
| 119 | HMGCS1 | SEQ ID NO. 62 | 11.3 | 8.584 | 0.76 | SREBP_SYNTH |
| 120 | HMGCS1 | SEQ ID NO. 62 | 11.3 | 33.317 | 2.948 | SREBP_U18666A |
| 121 | LDLR | SEQ ID NO. 63 | 0.528 | 4.194 | 7.942 | SREBP_LOV |
| 122 | LDLR | SEQ ID NO. 63 | 0.528 | 0.127 | 0.241 | SREBP_SYNTH |
| 123 | LDLR | SEQ ID NO. 63 | 0.528 | 2.365 | 4.479 | SREBP_U18666A |
| 124 | INSIG1 | SEQ ID NO. 64 | 18.688 | 58.689 | 3.14 | SREBP_LOV |
| 125 | INSIG1 | SEQ ID NO. 64 | 18.688 | 8.012 | 0.429 | SREBP_SYNTH |
| 126 | INSIG1 | SEQ ID NO. 64 | 18.688 | 43.001 | 2.301 | SREBP_U18666A |
| 127 | HMGCR | SEQ ID NO. 65 | 9.276 | 34.599 | 3.73 | SREBP_LOV |
| 128 | HMGCR | SEQ ID NO. 65 | 9.276 | 4.883 | 0.526 | SREBP_SYNTH |
| 129 | HMGCR | SEQ ID NO. 65 | 9.276 | 29.572 | 3.188 | SREBP_U18666A |
| 130 | ACSL5 | SEQ ID NO. 66 | 0.876 | 1.878 | 2.145 | SREBP_LOV |
| 131 | ACSL5 | SEQ ID NO. 66 | 0.876 | 1.246 | 1.423 | SREBP_SYNTH |
| 132 | ACSL5 | SEQ ID NO. 66 | 0.876 | 1.474 | 1.683 | SREBP_U18666A |
| 133 | NULL | SEQ ID NO. 67 | 10.538 | 19.205 | 1.822 | SREBP_LOV |
| 134 | NULL | SEQ ID NO. 67 | 10.538 | 4.796 | 0.455 | SREBP_SYNTH |
| 135 | NULL | SEQ ID NO. 67 | 10.538 | 20.415 | 1.937 | SREBP_U18666A |
| 136 | MSDHL | SEQ ID NO. 68 | 36.05 | 94.957 | 2.634 | SREBP_LOV |
| 137 | MSDHL | SEQ ID NO. 68 | 36.05 | 28.552 | 0.792 | SREBP_SYNTH |
| 138 | MSDHL | SEQ ID NO. 68 | 36.05 | 85.634 | 2.375 | SREBP_U18666A |
| 139 | DHCR24 | SEQ ID NO. 69 | 1.468 | 7.337 | 4.998 | SREBP_LOV |
| 140 | DHCR24 | SEQ ID NO. 69 | 1.468 | 0.52 | 0.354 | SREBP_SYNTH |
| 141 | DHCR24 | SEQ ID NO. 69 | 1.468 | 4.608 | 3.139 | SREBP_U18666A |
| 142 | FASN | SEQ ID NO. 70 | 20.017 | 96.388 | 4.815 | SREBP_LOV |
| 143 | FASN | SEQ ID NO. 70 | 20.017 | 12.38 | 0.618 | SREBP_SYNTH |
| 144 | FASN | SEQ ID NO. 70 | 20.017 | 63.245 | 3.16 | SREBP_U18666A |
| 145 | PGD | SEQ ID NO. 71 | 12.135 | 23.708 | 1.954 | SREBP_LOV |
| 146 | PGD | SEQ ID NO. 71 | 12.135 | 9.875 | 0.814 | SREBP_SYNTH |
| 147 | PGD | SEQ ID NO. 71 | 12.135 | 21.95 | 1.809 | SREBP_U18666A |
| 148 | ID1 | SEQ ID NO. 72 | 26.773 | 90.093 | 3.365 | SREBP_LOV |
| 149 | ID1 | SEQ ID NO. 72 | 26.773 | 16.24 | 0.607 | SREBP_SYNTH |
| 150 | ID1 | SEQ ID NO. 72 | 26.773 | 81.934 | 3.06 | SREBP_U18666A |
| 151 | DHCR7 | SEQ ID NO. 73 | 2.292 | 11.562 | 5.044 | SREBP_LOV |
| 152 | DHCR7 | SEQ ID NO. 73 | 2.292 | 1.427 | 0.623 | SREBP_SYNTH |
| 153 | DHCR7 | SEQ ID NO. 73 | 2.292 | 11.65 | 5.083 | SREBP_U18666A |

FIG. 1H -- TABLE 1 TRANSCRIPTIONAL BIOMARKER FUNCTIONAL DATA
SECTION 5

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS* |
|---|---|---|---|---|---|---|
| 154 | FDPS | SEQ ID NO. 74 | 7.185 | 23.308 | 3.244 | SREBP_LOV |
| 155 | FDPS | SEQ ID NO. 74 | 7.185 | 4.27 | 0.594 | SREBP_SYNTH |
| 156 | FDPS | SEQ ID NO. 74 | 7.185 | 20.148 | 2.804 | SREBP_U18666A |
| 157 | FASN | SEQ ID NO. 75 | 22.43 | 93.388 | 4.164 | SREBP_LOV |
| 158 | FASN | SEQ ID NO. 75 | 22.43 | 11.78 | 0.525 | SREBP_SYNTH |
| 159 | FASN | SEQ ID NO. 75 | 22.43 | 50.082 | 2.233 | SREBP_U18666A |
| 160 | MVD | SEQ ID NO. 76 | 7.236 | 59.473 | 8.219 | SREBP_LOV |
| 161 | MVD | SEQ ID NO. 76 | 7.236 | 4.733 | 0.654 | SREBP_SYNTH |
| 162 | MVD | SEQ ID NO. 76 | 7.236 | 39.052 | 5.397 | SREBP_U18666A |
| 163 | SQLE | SEQ ID NO. 77 | 8.145 | 36.969 | 4.539 | SREBP_LOV |
| 164 | SQLE | SEQ ID NO. 77 | 8.145 | 2.952 | 0.362 | SREBP_SYNTH |
| 165 | SQLE | SEQ ID NO. 77 | 8.145 | 27.994 | 3.437 | SREBP_U18666A |
| 166 | IDI1 | SEQ ID NO. 78 | 25.019 | 84.405 | 3.374 | SREBP_LOV |
| 167 | IDI1 | SEQ ID NO. 78 | 25.019 | 16.67 | 0.666 | SREBP_SYNTH |
| 168 | IDI1 | SEQ ID NO. 78 | 25.019 | 59.197 | 2.366 | SREBP_U18666A |

FIG. 1I -- TABLE 1 TRANSCRIPTIONAL BIOMARKER FUNCTIONAL DATA
SECTION 6:

| LINE_ID | GENE_SYMBOL | SEQUENCE_ID_LISTING | PROM_ACTIVITY_NO_INDUCTION | PROM_ACTIVITY_WITH_INDUCTION | INDUCTION_RATIO | INDUCTION_CONDITIONS* |
|---|---|---|---|---|---|---|
| 169 | AIM2 | SEQ ID NO. 79 | 19.656 | 83.528 | 4.25 | STAT_IFNA |
| 170 | AIM2 | SEQ ID NO. 79 | 19.656 | 289.257 | 14.716 | STAT_IFNG |
| 171 | TMEM140 | SEQ ID NO. 80 | 58.845 | 542.563 | 9.222 | STAT_IFNA |
| 172 | TMEM140 | SEQ ID NO. 80 | 58.845 | 707.901 | 12.03 | STAT_IFNG |
| 173 | PARP12 | SEQ ID NO. 81 | 5.477 | 37.459 | 6.84 | STAT_IFNA |
| 174 | PARP12 | SEQ ID NO. 81 | 5.477 | 13.947 | 2.547 | STAT_IFNG |
| 175 | BTC | SEQ ID NO. 82 | 3.858 | 51.865 | 13.445 | STAT_IFNA |
| 176 | BTC | SEQ ID NO. 82 | 3.858 | 9.144 | 2.371 | STAT_IFNG |
| 177 | NULL | SEQ ID NO. 83 | 553.985 | 815.222 | 1.472 | STAT_IFNA |
| 178 | NULL | SEQ ID NO. 83 | 553.985 | 879.604 | 1.588 | STAT_IFNG |
| 179 | IL4I1 | SEQ ID NO. 84 | 2.606 | 11.031 | 4.232 | STAT_IFNA |
| 180 | IL4I1 | SEQ ID NO. 84 | 2.606 | 5.441 | 2.087 | STAT_IFNG |
| 181 | IRF7 | SEQ ID NO. 85 | 432.776 | 1805.48 | 4.172 | STAT_IFNA |
| 182 | IRF7 | SEQ ID NO. 85 | 432.776 | 1119.382 | 2.587 | STAT_IFNG |
| 183 | EIF2AK2 | SEQ ID NO. 86 | 25.921 | 513.496 | 19.81 | STAT_IFNA |
| 184 | EIF2AK2 | SEQ ID NO. 86 | 25.921 | 92.338 | 3.562 | STAT_IFNG |
| 185 | CASP7 | SEQ ID NO. 87 | 254.479 | 1063.833 | 4.18 | STAT_IFNA |
| 186 | CASP7 | SEQ ID NO. 87 | 254.479 | 1059.063 | 4.162 | STAT_IFNG |
| 187 | CHMP5 | SEQ ID NO. 88 | 80.529 | 193.176 | 2.399 | STAT_IFNA |
| 188 | CHMP5 | SEQ ID NO. 88 | 80.529 | 118.97 | 1.477 | STAT_IFNG |
| 189 | RUNX1 | SEQ ID NO. 89 | 21.879 | 37.16 | 1.698 | STAT_IFNA |
| 190 | RUNX1 | SEQ ID NO. 89 | 21.879 | 382.492 | 17.482 | STAT_IFNG |
| 191 | ZC3HAV1 | SEQ ID NO. 90 | 93.614 | 571.207 | 6.102 | STAT_IFNA |
| 192 | ZC3HAV1 | SEQ ID NO. 90 | 93.614 | 792 | 8.46 | STAT_IFNG |
| 193 | PML | SEQ ID NO. 91 | 60.959 | 620.577 | 10.18 | STAT_IFNA |
| 194 | PML | SEQ ID NO. 91 | 60.959 | 203.412 | 3.337 | STAT_IFNG |
| 195 | TNFSF10 | SEQ ID NO. 92 | 1.914 | 21.588 | 11.332 | STAT_IFNA |
| 196 | TNFSF10 | SEQ ID NO. 92 | 1.914 | 6.894 | 3.602 | STAT_IFNG |
| 197 | ACTA2 | SEQ ID NO. 93 | 47.901 | 75.99 | 1.586 | STAT_IFNA |
| 198 | ACTA2 | SEQ ID NO. 93 | 47.901 | 252.117 | 5.263 | STAT_IFNG |
| 199 | ERAP1 | SEQ ID NO. 94 | 58.867 | 204.741 | 3.478 | STAT_IFNA |
| 200 | ERAP1 | SEQ ID NO. 94 | 58.867 | 133.037 | 2.26 | STAT_IFNG |
| 201 | BCL6 | SEQ ID NO. 95 | 94.574 | 145.049 | 1.534 | STAT_IFNA |
| 202 | BCL6 | SEQ ID NO. 95 | 94.574 | 530.532 | 5.61 | STAT_IFNG |
| 203 | LOC441108 | SEQ ID NO. 96 | 8.789 | 137.783 | 15.676 | STAT_IFNA |
| 204 | LOC441108 | SEQ ID NO. 96 | 8.789 | 83.891 | 9.545 | STAT_IFNG |
| 205 | PSMB9 | SEQ ID NO. 97 | 1.828 | 25.902 | 14.17 | STAT_IFNA |
| 206 | PSMB9 | SEQ ID NO. 97 | 1.828 | 103.313 | 56.513 | STAT_IFNG |

FIG. 1J -- TABLE 1 TRANSCRIPTIONAL BIOMARKER FUNCTIONAL DATA

SECTION 7:

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS* |
|---|---|---|---|---|---|---|
| 207 | HIST1H3B | SEQ ID NO. 98 | 0.652 | 1.484 | 2.276 | CREB_FSK |
| 208 | HIST1H3B | SEQ ID NO. 98 | 0.652 | 1.801 | 2.763 | CREB_PMA |
| 209 | PCNA | SEQ ID NO. 99 | 6.328 | 10.501 | 1.659 | CREB_FSK |
| 210 | PCNA | SEQ ID NO. 99 | 6.328 | 27.293 | 4.313 | CREB_PMA |
| 211 | GTF2E1 | SEQ ID NO. 100 | 3.16 | 5.271 | 1.668 | CREB_FSK |
| 212 | GTF2E1 | SEQ ID NO. 100 | 3.16 | 6.486 | 2.053 | CREB_PMA |
| 213 | PPP1R15A | SEQ ID NO. 101 | 2.109 | 6.238 | 2.958 | CREB_FSK |
| 214 | PPP1R15A | SEQ ID NO. 101 | 2.109 | 15.03 | 7.127 | CREB_PMA |
| 215 | GADD45B | SEQ ID NO. 102 | 8.541 | 13.563 | 1.588 | CREB_FSK |
| 216 | GADD45B | SEQ ID NO. 102 | 8.541 | 32.725 | 3.831 | CREB_PMA |
| 217 | SGK1 | SEQ ID NO. 103 | 1.557 | 3.279 | 2.105 | CREB_FSK |
| 218 | SGK1 | SEQ ID NO. 103 | 1.557 | 4.745 | 3.047 | CREB_PMA |
| 219 | SNF1LK | SEQ ID NO. 104 | 9.029 | 24.785 | 2.745 | CREB_FSK |
| 220 | SNF1LK | SEQ ID NO. 104 | 9.029 | 25.6 | 2.835 | CREB_PMA |
| 221 | CYR61 | SEQ ID NO. 105 | 2.649 | 6.489 | 2.449 | CREB_FSK |
| 222 | CYR61 | SEQ ID NO. 105 | 2.649 | 8.97 | 3.386 | CREB_PMA |
| 223 | CREM | SEQ ID NO. 106 | 0.197 | 0.47 | 2.385 | CREB_FSK |
| 224 | CREM | SEQ ID NO. 106 | 0.197 | 0.831 | 4.218 | CREB_PMA |
| 225 | NDUFV1 | SEQ ID NO. 107 | 2.194 | 4.297 | 1.959 | CREB_FSK |
| 226 | NDUFV1 | SEQ ID NO. 107 | 2.194 | 3.789 | 1.727 | CREB_PMA |
| 227 | ID2 | SEQ ID NO. 108 | 1.466 | 1.913 | 1.308 | CREB_FSK |
| 228 | ID2 | SEQ ID NO. 108 | 1.466 | 6.304 | 4.3 | CREB_PMA |
| 229 | FN1 | SEQ ID NO. 109 | 0.405 | 0.902 | 2.227 | CREB_FSK |
| 230 | FN1 | SEQ ID NO. 109 | 0.405 | 3.046 | 7.522 | CREB_PMA |
| 231 | DNAJB11 | SEQ ID NO. 110 | 1.89 | 3.401 | 1.8 | CREB_FSK |
| 232 | DNAJB11 | SEQ ID NO. 110 | 1.89 | 3.228 | 1.708 | CREB_PMA |
| 233 | PPARGC1A | SEQ ID NO. 111 | 0.295 | 0.62 | 2.103 | CREB_FSK |
| 234 | PPARGC1A | SEQ ID NO. 111 | 0.295 | 1.107 | 3.758 | CREB_PMA |

*FIG. 1K* -- TABLE 1 TRANSCRIPTIONAL BIOMARKER FUNCTIONAL DATA
SECTION 8:

| LINE_ID | GENE_SYMBOL | SEQUENCE_ID_LISTING | PROM_ACTIVITY_N O_INDUCTION | PROM_ACTIVITY_WI TH_INDUCTION | INDUCTION RATIO | INDUCTION_CONDITIONS* |
|---|---|---|---|---|---|---|
| 235 | COMT | SEQ ID NO. 112 | 0.716 | 1.056 | 1.476 | GR_CORT |
| 236 | COMT | SEQ ID NO. 112 | 0.716 | 1.412 | 1.974 | GR_DEX |
| 237 | COMT | SEQ ID NO. 112 | 0.716 | 1.221 | 1.706 | GR_PRED |
| 238 | NULL | SEQ ID NO. 113 | 0.94 | 2.551 | 2.713 | GR_CORT |
| 239 | NULL | SEQ ID NO. 113 | 0.94 | 3.253 | 3.46 | GR_DEX |
| 240 | NULL | SEQ ID NO. 113 | 0.94 | 3.481 | 3.702 | GR_PRED |
| 241 | CYP3A43 | SEQ ID NO. 114 | 0.614 | 0.957 | 1.559 | GR_CORT |
| 242 | CYP3A43 | SEQ ID NO. 114 | 0.614 | 1.866 | 3.039 | GR_DEX |
| 243 | CYP3A43 | SEQ ID NO. 114 | 0.614 | 1.703 | 2.774 | GR_PRED |
| 244 | NULL | SEQ ID NO. 115 | 0.255 | 0.611 | 2.4 | GR_CORT |
| 245 | NULL | SEQ ID NO. 115 | 0.255 | 1.116 | 4.386 | GR_DEX |
| 246 | NULL | SEQ ID NO. 115 | 0.255 | 0.666 | 2.618 | GR_PRED |
| 247 | BAIAP2 | SEQ ID NO. 116 | 1.017 | 2.5 | 2.457 | GR_CORT |
| 248 | BAIAP2 | SEQ ID NO. 116 | 1.017 | 5.467 | 5.373 | GR_DEX |
| 249 | BAIAP2 | SEQ ID NO. 116 | 1.017 | 4.83 | 4.747 | GR_PRED |
| 250 | RNASE2 | SEQ ID NO. 117 | 0.387 | 0.535 | 1.383 | GR_CORT |
| 251 | RNASE2 | SEQ ID NO. 117 | 0.387 | 5.642 | 14.581 | GR_DEX |
| 252 | RNASE2 | SEQ ID NO. 117 | 0.387 | 1.204 | 3.112 | GR_PRED |
| 253 | NULL | SEQ ID NO. 118 | 0.095 | 0.429 | 4.516 | GR_CORT |
| 254 | NULL | SEQ ID NO. 118 | 0.095 | 1.627 | 17.138 | GR_DEX |
| 255 | NULL | SEQ ID NO. 118 | 0.095 | 1.144 | 12.049 | GR_PRED |
| 256 | NKPD1 | SEQ ID NO. 119 | 2.933 | 16.5 | 5.626 | GR_CORT |
| 257 | NKPD1 | SEQ ID NO. 119 | 2.933 | 32.967 | 11.241 | GR_DEX |
| 258 | NKPD1 | SEQ ID NO. 119 | 2.933 | 36.324 | 12.385 | GR_PRED |
| 259 | MARK3 | SEQ ID NO. 120 | 0.312 | 0.448 | 1.438 | GR_CORT |
| 260 | MARK3 | SEQ ID NO. 120 | 0.312 | 1.236 | 3.963 | GR_DEX |
| 261 | MARK3 | SEQ ID NO. 120 | 0.312 | 1.269 | 4.063 | GR_PRED |

*FIG. 1L* -- TABLE 1 TRANSCRIPTIONAL BIOMARKER FUNCTIONAL DATA
SECTION 8

| LINE_ID | GENE_SYMBOL | SEQUENCE_ID_LISTING | PROM_ACTIVITY_NO_INDUCTION | PROM_ACTIVITY_WITH_INDUCTION | INDUCTION_RATIO | INDUCTION_CONDITIONS* |
|---|---|---|---|---|---|---|
| 262 | PREPL | SEQ ID NO. 121 | 0.145 | 0.255 | 1.761 | GR_CORT |
| 263 | PREPL | SEQ ID NO. 121 | 0.145 | 0.693 | 4.794 | GR_DEX |
| 264 | PREPL | SEQ ID NO. 121 | 0.145 | 0.384 | 2.656 | GR_PRED |
| 265 | SLC38A4 | SEQ ID NO. 122 | 0.041 | 0.335 | 8.123 | GR_CORT |
| 266 | SLC38A4 | SEQ ID NO. 122 | 0.041 | 2.143 | 51.936 | GR_DEX |
| 267 | SLC38A4 | SEQ ID NO. 122 | 0.041 | 1.137 | 27.566 | GR_PRED |
| 268 | MEST | SEQ ID NO. 123 | 3.089 | 4.859 | 1.573 | GR_CORT |
| 269 | MEST | SEQ ID NO. 123 | 3.089 | 8.897 | 2.88 | GR_DEX |
| 270 | MEST | SEQ ID NO. 123 | 3.089 | 7.63 | 2.47 | GR_PRED |
| 271 | SLC19A2 | SEQ ID NO. 124 | 6.66 | 19.273 | 2.894 | GR_CORT |
| 272 | SLC19A2 | SEQ ID NO. 124 | 6.66 | 24.721 | 3.712 | GR_DEX |
| 273 | SLC19A2 | SEQ ID NO. 124 | 6.66 | 18.987 | 2.851 | GR_PRED |
| 274 | MT2A | SEQ ID NO. 125 | 56.855 | 130.707 | 2.299 | GR_CORT |
| 275 | MT2A | SEQ ID NO. 125 | 56.855 | 121.445 | 2.136 | GR_DEX |
| 276 | MT2A | SEQ ID NO. 125 | 56.855 | 133.159 | 2.342 | GR_PRED |
| 277 | SDPR | SEQ ID NO. 126 | 0.608 | 2.959 | 4.865 | GR_CORT |
| 278 | SDPR | SEQ ID NO. 126 | 0.608 | 6.022 | 9.9 | GR_DEX |
| 279 | SDPR | SEQ ID NO. 126 | 0.608 | 4.037 | 6.636 | GR_PRED |

FIG. 1M -- TABLE 1 TRANSCRIPTIONAL BIOMARKER FUNCTIONAL DATA
SECTION 9:

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS* |
|---|---|---|---|---|---|---|
| 280 | PLA2G2A | SEQ ID NO. 127 | 0.188 | 0.302 | 1.608 | PPAR_ALPHA |
| 281 | PLA2G2A | SEQ ID NO. 127 | 0.062 | 0.064 | 1.038 | PPAR_DELTA |
| 282 | PLA2G2A | SEQ ID NO. 127 | 0.154 | 1.071 | 6.931 | PPAR_GAMMA |
| 283 | FABP1 | SEQ ID NO. 128 | 0.577 | 1.279 | 2.219 | PPAR_ALPHA |
| 284 | FABP1 | SEQ ID NO. 128 | 0.043 | 0.033 | 0.761 | PPAR_DELTA |
| 285 | FABP1 | SEQ ID NO. 128 | 0.182 | 0.552 | 3.032 | PPAR_GAMMA |
| 286 | LIPC | SEQ ID NO. 129 | 0.073 | 0.085 | 1.158 | PPAR_ALPHA |
| 287 | LIPC | SEQ ID NO. 129 | 0.009 | 0.008 | 0.909 | PPAR_DELTA |
| 288 | LIPC | SEQ ID NO. 129 | 0.027 | 0.069 | 2.559 | PPAR_GAMMA |
| 289 | AQP7 | SEQ ID NO. 130 | 0.074 | 0.1 | 1.34 | PPAR_ALPHA |
| 290 | AQP7 | SEQ ID NO. 130 | 0.018 | 0.014 | 0.737 | PPAR_DELTA |
| 291 | AQP7 | SEQ ID NO. 130 | 0.109 | 0.434 | 3.981 | PPAR_GAMMA |
| 292 | C9orf25 | SEQ ID NO. 131 | 1.57 | 1.739 | 1.107 | PPAR_ALPHA |
| 293 | C9orf25 | SEQ ID NO. 131 | 0.192 | 0.408 | 2.125 | PPAR_DELTA |
| 294 | C9orf25 | SEQ ID NO. 131 | 0.829 | 1.04 | 1.255 | PPAR_GAMMA |
| 295 | RPS3A | SEQ ID NO. 132 | 0.233 | 0.495 | 2.128 | PPAR_ALPHA |
| 296 | RPS3A | SEQ ID NO. 132 | 0.079 | 0.076 | 0.96 | PPAR_DELTA |
| 297 | RPS3A | SEQ ID NO. 132 | 0.101 | 0.557 | 5.512 | PPAR_GAMMA |
| 298 | ECH1 | SEQ ID NO. 133 | 0.32 | 1.127 | 3.523 | PPAR_ALPHA |
| 299 | ECH1 | SEQ ID NO. 133 | 0.015 | 0.02 | 1.346 | PPAR_DELTA |
| 300 | ECH1 | SEQ ID NO. 133 | 0.043 | 0.212 | 4.933 | PPAR_GAMMA |

FIG. 1N -- TABLE 1 TRANSCRIPTIONAL BIOMARKER FUNCTIONAL DATA
SECTION 10:

| LINE_ID | GENE_SYMBOL | SEQUENCE_ID_LISTING | PROM_ACTIVITY_N O_INDUCTION | PROM_ACTIVITY_WI TH_INDUCTION | INDUCTION RATIO | INDUCTION_CONDITIONS* |
|---|---|---|---|---|---|---|
| 301 | ABCA1 | SEQ ID NO. 134 | 0.288 | 0.502 | 1.74 | RAR_BETA |
| 302 | HOXA1 | SEQ ID NO. 135 | 0.066 | 0.099 | 1.515 | RAR_BETA |
| 303 | NUB1 | SEQ ID NO. 136 | 0.686 | 1.692 | 2.464 | RAR_BETA |
| 304 | PKD1 | SEQ ID NO. 137 | 0.018 | 0.032 | 1.77 | RAR_BETA |

FIG. 10 -- TABLE 1 TRANSCRIPTIONAL BIOMARKER FUNCTIONAL DATA
SECTION 11:

| LINE_ID | GENE_SYMBOL | SEQUENCE_ID_LISTING | PROM_ACTIVITY_N O_INDUCTION | PROM_ACTIVITY_WI TH_INDUCTION | INDUCTION _RATIO | INDUCTION_CONDITIONS* |
|---|---|---|---|---|---|---|
| 305 | YIPF5 | SEQ ID NO. 138 | 159.088 | 180.629 | 1.135 | NFKB |
| 306 | IRF1 | SEQ ID NO. 139 | 19.14 | 224.79 | 11.745 | NFKB |
| 307 | TNFAIP3 | SEQ ID NO. 140 | 14.284 | 72.734 | 5.092 | NFKB |
| 308 | NFKB1 | SEQ ID NO. 141 | 7.148 | 60.486 | 8.461 | NFKB |
| 309 | RELB | SEQ ID NO. 142 | 12.045 | 95.231 | 7.906 | NFKB |
| 310 | TP53 | SEQ ID NO. 143 | 113.43 | 173.202 | 1.527 | NFKB |
| 311 | IL8 | SEQ ID NO. 144 | 1.075 | 35.046 | 32.611 | NFKB |
| 312 | VCAM1 | SEQ ID NO. 145 | 1.87 | 10.87 | 5.814 | NFKB |
| 313 | CCL5 | SEQ ID NO. 146 | 9.502 | 43.622 | 4.591 | NFKB |
| 314 | MT2A | SEQ ID NO. 146 | 118.861 | 293.325 | 2.468 | NFKB |
| 315 | SELE | SEQ ID NO. 147 | 0.746 | 20.008 | 26.817 | NFKB |
| 316 | TNF | SEQ ID NO. 148 | 26.761 | 41.369 | 1.546 | NFKB |
| 317 | CD40 | SEQ ID NO. 149 | 0.966 | 28.883 | 29.908 | NFKB |
| 318 | STAT5A | SEQ ID NO. 150 | 10.915 | 34.258 | 3.139 | NFKB |
| 319 | CSF1 | SEQ ID NO. 151 | 3.521 | 37.765 | 10.725 | NFKB |
| 320 | NFKBIA | SEQ ID NO. 152 | 34.253 | 70.096 | 2.046 | NFKB |
| 321 | NFKB2 | SEQ ID NO. 153 | 5.167 | 45.614 | 8.829 | NFKB |
| 322 | TAP1 | SEQ ID NO. 154 | 29.246 | 62.573 | 2.139 | NFKB |

*FIG. 1P* -- TABLE 1 TRANSCRIPTIONAL BIOMARKER FUNCTIONAL DATA
SECTION 12:

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS* |
|---|---|---|---|---|---|---|
| 323 | CEACAM1 | SEQ ID NO. 155 | 0.338 | 3.039 | 8.982 | HEATSHOCK |
| 324 | PTCD1 | SEQ ID NO. 156 | 0.242 | 3.188 | 13.192 | HEATSHOCK |
| 325 | DNAJB5 | SEQ ID NO. 157 | 76.04 | 263.214 | 3.462 | HEATSHOCK |
| 326 | GML | SEQ ID NO. 158 | 0.398 | 19.155 | 48.033 | HEATSHOCK |
| 327 | HSPD1 | SEQ ID NO. 159 | 39.523 | 190.072 | 4.809 | HEATSHOCK |
| 328 | SLC35F2 | SEQ ID NO. 160 | 0.339 | 2.618 | 7.715 | HEATSHOCK |
| 329 | APTX | SEQ ID NO. 161 | 39.683 | 141.938 | 3.577 | HEATSHOCK |
| 330 | HSPE1 | SEQ ID NO. 162 | 34.034 | 138.525 | 4.07 | HEATSHOCK |
| 331 | CAPZB | SEQ ID NO. 163 | 0.973 | 1.845 | 1.897 | HEATSHOCK |
| 332 | HNRNPA2B1 | SEQ ID NO. 164 | 271.363 | 439.445 | 1.619 | HEATSHOCK |
| 333 | RAB39 | SEQ ID NO. 165 | 0.233 | 1.361 | 5.831 | HEATSHOCK |
| 334 | ST13 | SEQ ID NO. 166 | 23.905 | 87.572 | 3.663 | HEATSHOCK |
| 335 | XPNPEP3 | SEQ ID NO. 167 | 59.06 | 149.475 | 2.531 | HEATSHOCK |
| 336 | HSPA1A | SEQ ID NO. 168 | 7.946 | 892.531 | 112.325 | HEATSHOCK |
| 337 | HSP90AB1 | SEQ ID NO. 169 | 20.038 | 178.812 | 8.924 | HEATSHOCK |

*FIG. 1Q* -- TABLE 1 TRANSCRIPTIONAL BIOMARKER FUNCTIONAL DATA
SECTION 13:

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS* |
|---|---|---|---|---|---|---|
| 338 | NR4A1 | SEQ ID NO. 170 | 15.285 | 110.453 | 7.226 | SRF |
| 339 | ING4 | SEQ ID NO. 171 | 1.007 | 1.585 | 1.573 | SRF |
| 340 | NLRP1 | SEQ ID NO. 172 | 6.368 | 16.172 | 2.54 | SRF |
| 341 | FOSB | SEQ ID NO. 173 | 0.807 | 3.736 | 4.63 | SRF |
| 342 | MYH9 | SEQ ID NO. 174 | 3.859 | 26.688 | 6.916 | SRF |

\* INDUCTION CONDITION DESCRIPTION

HYPOX_DFO_HCT116= Biological response to hypoxia in HCT116 cells using deferoxamine (DFO) as the inducer
HYPOX_DFO_HT1080= Biological response to hypoxia in HT1080 cells using deferoxamine (DFO) as the inducer
HYPOX_O2_HCT116= Biological response to hypoxia in HCT116 cells using 1% oxygen as the inducing condition
HYPOX_O2_HT1080= Biological response to hypoxia in HT1080 cells using 1% oxygen as the inducing condition
ER= Biological response to estrogen using beta estradiol as the inducing condition
AR= Biological response to androgen using methyltrienolone as the inducing condition
P53= Biological response to p53 activation using nutlin as the inducing condition
SREBP_LOV= Biological response to cholesterol biosynthesis inhibition using lovastatin as the inducing condition
SREBP_SYNTH= Biological response to cholesterol biosynthesis activation using synthecol as the inducing condition
SREBP_U18666A= Biological response to cholesterol biosynthesis inhibition using U18666A as the inducing condition
STAT_IFNA= Biological response to interferons using interferon alpha as the inducing condition
STAT_IFNG= Biological response to interferons using interferon gamma as the inducing condition
CREB_FSK= Biological response to cyclic AMP signaling using forskolin as the inducing condition
CREB_PMA= Biological response to cyclic AMP signaling using phorbol 12-myristate 13-acetate (PMA) as the inducing condition
GR_CORT= Biological response to glucocorticoids using cortisone as the inducing condition
GR_DEX= Biological response to glucocorticoids using dexamethasone as the inducing condition
GR_PRED= Biological response to glucocorticoids using prednisone as the inducing condition
PPAR_ALPHA= Biological response to PPAR alpha using WY14643 as the inducing condition
PPAR_DELTA= Biological response to PPAR delta using GW501516 as the inducing condition
PPAR_GAMMA= Biological response to PPAR gamma using cigitazone as the inducing condition
RAR_BETA= Biological response to RAR beta using adapalene as the inducing condition
NFKB= Biological response to NFKB activation using TNF alpha as the inducing condition
HEATSHOCK= Biological response to heat shock using 43 degrees celcius as the inducing condition
SRF= Biological response to serum using 20% serum as the inducing condition

*FIG. 1R* -- TABLE 1 TRANSCRIPTIONAL BIOMARKER FUNCTIONAL DATA
PART II: SUPPLEMENTAL TRANSCRIPTIONAL BIOMARKER FUNCTIONAL DATA

SECTION 3A

| LINE_ID | GENE_SYMBOL | SEQUENCE_ID_LISTING | PROM_ACTIVITY_NO_INDUCTION | PROM_ACTIVITY_WITH_INDUCTION | INDUCTION_RATIO | INDUCTION_CONDITIONS* |
|---|---|---|---|---|---|---|
| 343 | GSTT2 | SEQ ID NO. 175 | 0.05 | 0.19 | 3.71 | AR |
| 344 | DNM1L | SEQ ID NO. 176 | 3.05 | 3.08 | 1.01 | AR |
| 345 | PFTK1 | SEQ ID NO. 177 | 0.07 | 0.36 | 5.33 | AR |
| 346 | SOCS2 | SEQ ID NO. 178 | 0.05 | 0.09 | 1.83 | AR |
| 347 | TRPV3 | SEQ ID NO. 179 | 1.02 | 0.38 | 0.37 | AR |
| 348 | GREB1 | SEQ ID NO. 180 | 0.06 | 0.28 | 4.65 | AR |
| 349 | UHRF2 | SEQ ID NO. 181 | 6.93 | 4.83 | 0.7 | AR |
| 350 | PYCR1 | SEQ ID NO. 182 | 0.02 | 0.05 | 2.18 | AR |
| 351 | MBOAT2 | SEQ ID NO. 183 | 0.08 | 0.25 | 3.2 | AR |
| 352 | SLC39A10 | SEQ ID NO. 184 | 0.48 | 0.82 | 1.72 | AR |
| 353 | NDRG1 | SEQ ID NO. 185 | 4.41 | 15.92 | 3.61 | AR |
| 354 | CAMKK2 | SEQ ID NO. 186 | 0.06 | 0.34 | 5.91 | AR |
| 355 | PIK3R1 | SEQ ID NO. 187 | 0.03 | 0.04 | 1.41 | AR |
| 356 | PIK3AP1 | SEQ ID NO. 188 | 0.14 | 0.52 | 3.59 | AR |
| 357 | IHPK1 | SEQ ID NO. 189 | 0.43 | 1.48 | 3.47 | AR |
| 358 | MID1 | SEQ ID NO. 190 | 0.09 | 0.17 | 1.79 | AR |
| 359 | ACO2 | SEQ ID NO. 191 | 11.54 | 8.55 | 0.74 | AR |
| 360 | FAM115A | SEQ ID NO. 192 | 0.32 | 1.52 | 4.8 | AR |
| 361 | RAB4A | SEQ ID NO. 193 | 0.76 | 0.67 | 0.89 | AR |
| 362 | PIK3CB | SEQ ID NO. 194 | 0.05 | 0.13 | 2.49 | AR |
| 363 | SEC24B | SEQ ID NO. 195 | 0.25 | 0.24 | 0.96 | AR |
| 364 | PTPRM | SEQ ID NO. 196 | 0.1 | 1.4 | 13.74 | AR |
| 365 | MRPS28 | SEQ ID NO. 197 | 0.01 | 0.01 | 1.31 | AR |
| 366 | ACAD8 | SEQ ID NO. 198 | 0.71 | 1.19 | 1.67 | AR |
| 367 | PPFIBP2 | SEQ ID NO. 199 | 0.04 | 0.45 | 12.4 | AR |
| 368 | ATP2B1 | SEQ ID NO. 200 | 0.37 | 1.78 | 4.8 | AR |
| 369 | MLPH | SEQ ID NO. 201 | 0.16 | 0.53 | 3.23 | AR |
| 370 | PDS5B | SEQ ID NO. 202 | 2.3 | 2.71 | 1.18 | AR |
| 371 | DNAJB9 | SEQ ID NO. 203 | 14.91 | 13.96 | 0.94 | AR |
| 372 | RALB | SEQ ID NO. 204 | 0.23 | 1.75 | 7.52 | AR |
| 373 | C15orf23 | SEQ ID NO. 205 | 5.42 | 5.3 | 0.98 | AR |
| 374 | ORM2 | SEQ ID NO. 206 | 0.04 | 0.08 | 1.85 | AR |
| 375 | CXCR7 | SEQ ID NO. 207 | 0.21 | 0.19 | 0.91 | AR |
| 376 | KLK3 | SEQ ID NO. 208 | 0.06 | 0.39 | 6.49 | AR |
| 377 | FKBP5 | SEQ ID NO. 209 | 0.04 | 0.04 | 1.05 | AR |
| 378 | CAMKK2 | SEQ ID NO. 210 | 0.07 | 0.51 | 6.89 | AR |
| 379 | C14orf4 | SEQ ID NO. 211 | 4.14 | 1.36 | 0.33 | AR |
| 380 | PGC | SEQ ID NO. 212 | 0.02 | 0.08 | 3.99 | AR |
| 381 | CDC42EP3 | SEQ ID NO. 213 | 0.03 | 0.07 | 2.44 | AR |
| 382 | OAT | SEQ ID NO. 213 | 0.77 | 9.16 | 11.83 | AR |

FIG. 1S -- TABLE 1 TRANSCRIPTIONAL BIOMARKER FUNCTIONAL DATA
SECTION 3A

| LINE_ID | GENE_SYMBOL | SEQUENCE_ID_LISTING | PROM_ACTIVITY_N O_INDUCTION | PROM_ACTIVITY_WI TH_INDUCTION | INDUCTION RATIO | INDUCTION_CONDITIONS* |
|---|---|---|---|---|---|---|
| 383 | CDK5RAP1 | SEQ ID NO. 214 | 24.6 | 17.66 | 0.72 | AR |
| 384 | LRRN1 | SEQ ID NO. 215 | 0.19 | 1.3 | 7.02 | AR |
| 385 | HELZ | SEQ ID NO. 216 | 3.39 | 2.09 | 0.62 | AR |
| 386 | RNF19A | SEQ ID NO. 217 | 1.13 | 3.77 | 3.35 | AR |
| 387 | C1orf26 | SEQ ID NO. 218 | 9.96 | 14.43 | 1.45 | AR |
| 388 | KCTD3 | SEQ ID NO. 219 | 0.36 | 0.65 | 1.82 | AR |
| 389 | CCNH | SEQ ID NO. 220 | 1.3 | 1.27 | 0.98 | AR |
| 390 | HMGCR | SEQ ID NO. 220 | 5.81 | 8.94 | 1.54 | AR |
| 391 | CAMKK2 | SEQ ID NO. 221 | 0.11 | 0.1 | 0.89 | AR |
| 392 | NSMAF | SEQ ID NO. 222 | 0.51 | 0.29 | 0.57 | AR |
| 393 | ATAD2 | SEQ ID NO. 223 | 0.08 | 0.1 | 1.21 | AR |
| 394 | PAK1IP1 | SEQ ID NO. 224 | 1.33 | 1.3 | 0.97 | AR |
| 395 | PFTK1 | SEQ ID NO. 225 | 0.06 | 0.07 | 1.19 | AR |
| 396 | GNGT1 | SEQ ID NO. 226 | 0.02 | 0.04 | 2.51 | AR |
| 397 | SYTL2 | SEQ ID NO. 227 | 0.54 | 0.31 | 0.57 | AR |
| 398 | SAT1 | SEQ ID NO. 228 | 0.08 | 0.25 | 3.05 | AR |
| 399 | AKAP9 | SEQ ID NO. 229 | 1.17 | 2.21 | 1.89 | AR |
| 400 | TRIP6 | SEQ ID NO. 230 | 3.74 | 2.65 | 0.71 | AR |
| 401 | PLOD3 | SEQ ID NO. 231 | 17.4 | 10.84 | 0.62 | AR |
| 402 | NULL | SEQ ID NO. 232 | 8.38 | 7.55 | 0.9 | AR |
| 403 | NULL | SEQ ID NO. 233 | 3.8 | 3.33 | 0.88 | AR |
| 404 | HERPUD2 | SEQ ID NO. 234 | 1.07 | 2.09 | 1.95 | AR |
| 405 | NCAPG2 | SEQ ID NO. 235 | 7.4 | 8.41 | 1.14 | AR |
| 406 | TRIP6 | SEQ ID NO. 236 | 0.06 | 0.31 | 4.8 | AR |
| 407 | NUB1 | SEQ ID NO. 236 | 21.62 | 24.91 | 1.15 | AR |
| 408 | BRCA2 | SEQ ID NO. 237 | 1.63 | 1.77 | 1.09 | AR |
| 409 | TP53INP1 | SEQ ID NO. 237 | 38.4 | 15.35 | 0.4 | AR |
| 410 | SGK1 | SEQ ID NO. 238 | 0.05 | 0.08 | 1.63 | AR |

FIG. 1T — TABLE 1 TRANSCRIPTIONAL BIOMARKER FUNCTIONAL DATA
SECTION 7A

| LINE_ID | GENE_SYMBOL | SEQUENCE_ID_LISTING | PROM_ACTIVITY_N O_INDUCTION | PROM_ACTIVITY_WI TH_INDUCTION | INDUCTION RATIO | INDUCTION_CONDITIONS* |
|---|---|---|---|---|---|---|
| 411 | EIF3H | SEQ ID NO. 239 | 0.333 | 0.364 | 1.096 | CREB_FSK |
| 412 | EIF3H | SEQ ID NO. 239 | 0.333 | 0.413 | 1.24 | CREB_PMA |
| 413 | WBP11 | SEQ ID NO. 240 | 2.67 | 3.077 | 1.152 | CREB_FSK |
| 414 | WBP11 | SEQ ID NO. 240 | 2.67 | 2.764 | 1.035 | CREB_PMA |
| 415 | LARP7 | SEQ ID NO. 241 | 0.015 | 0.015 | 0.989 | CREB_FSK |
| 416 | LARP7 | SEQ ID NO. 241 | 0.015 | 0.024 | 1.577 | CREB_PMA |
| 417 | HISPPD1 | SEQ ID NO. 242 | 1.535 | 1.611 | 1.049 | CREB_FSK |
| 418 | HISPPD1 | SEQ ID NO. 242 | 1.535 | 1.248 | 0.813 | CREB_PMA |
| 419 | ANKRD42 | SEQ ID NO. 243 | 2.033 | 1.831 | 0.9 | CREB_FSK |
| 420 | ANKRD42 | SEQ ID NO. 243 | 2.033 | 3.1 | 1.525 | CREB_PMA |
| 421 | LMLN | SEQ ID NO. 244 | 0.271 | 0.297 | 1.1 | CREB_FSK |
| 422 | LMLN | SEQ ID NO. 244 | 0.271 | 0.342 | 1.263 | CREB_PMA |
| 423 | HIST1H2AH | SEQ ID NO. 245 | 1.672 | 2.164 | 1.294 | CREB_FSK |
| 424 | HIST1H2AH | SEQ ID NO. 245 | 1.672 | 2.31 | 1.381 | CREB_PMA |
| 425 | TTC35 | SEQ ID NO. 246 | 0.175 | 0.238 | 1.359 | CREB_FSK |
| 426 | TTC35 | SEQ ID NO. 246 | 0.175 | 0.233 | 1.329 | CREB_PMA |
| 427 | HIST1H2BK | SEQ ID NO. 247 | 2.742 | 4.9 | 1.787 | CREB_FSK |
| 428 | HIST1H2BK | SEQ ID NO. 247 | 2.742 | 7.958 | 2.903 | CREB_PMA |
| 429 | HIST2H2AC | SEQ ID NO. 248 | 3.986 | 4.97 | 1.247 | CREB_FSK |
| 430 | HIST2H2AC | SEQ ID NO. 248 | 3.986 | 5.603 | 1.406 | CREB_PMA |
| 431 | HIST2H2BE | SEQ ID NO. 249 | 9.397 | 10.733 | 1.142 | CREB_FSK |
| 432 | HIST2H2BE | SEQ ID NO. 249 | 9.397 | 18.537 | 1.973 | CREB_PMA |
| 433 | SRA1 | SEQ ID NO. 250 | 0.432 | 0.52 | 1.203 | CREB_FSK |
| 434 | SRA1 | SEQ ID NO. 250 | 0.432 | 0.773 | 1.791 | CREB_PMA |
| 435 | MRPS18B | SEQ ID NO. 251 | 2.137 | 2.289 | 1.071 | CREB_FSK |
| 436 | MRPS18B | SEQ ID NO. 251 | 2.137 | 2.347 | 1.098 | CREB_PMA |
| 437 | ALS2 | SEQ ID NO. 252 | 0.217 | 0.169 | 0.778 | CREB_FSK |
| 438 | ALS2 | SEQ ID NO. 252 | 0.217 | 0.152 | 0.702 | CREB_PMA |
| 439 | BLOC1S2 | SEQ ID NO. 253 | 2.085 | 2.353 | 1.128 | CREB_FSK |
| 440 | BLOC1S2 | SEQ ID NO. 253 | 2.085 | 2.486 | 1.192 | CREB_PMA |
| 441 | KIAA0859 | SEQ ID NO. 254 | 9.587 | 6.669 | 0.696 | CREB_FSK |
| 442 | KIAA0859 | SEQ ID NO. 254 | 9.587 | 7.689 | 0.802 | CREB_PMA |
| 443 | MFAP3 | SEQ ID NO. 255 | 14.586 | 17.903 | 1.227 | CREB_FSK |
| 444 | MFAP3 | SEQ ID NO. 255 | 14.586 | 20.17 | 1.383 | CREB_PMA |
| 445 | NULL | SEQ ID NO. 256 | 0.013 | 0.021 | 1.596 | CREB_FSK |
| 446 | NULL | SEQ ID NO. 256 | 0.013 | 0.017 | 1.297 | CREB_PMA |
| 447 | CCDC59 | SEQ ID NO. 257 | 2.007 | 1.436 | 0.715 | CREB_FSK |
| 448 | CCDC59 | SEQ ID NO. 257 | 2.007 | 2.124 | 1.058 | CREB_PMA |
| 449 | DLL3 | SEQ ID NO. 258 | 0.26 | 0.213 | 0.818 | CREB_FSK |
| 450 | DLL3 | SEQ ID NO. 258 | 0.26 | 0.529 | 2.034 | CREB_PMA |
| 451 | BTG2 | SEQ ID NO. 259 | 0.297 | 0.55 | 1.855 | CREB_FSK |
| 452 | BTG2 | SEQ ID NO. 259 | 0.297 | 0.858 | 2.892 | CREB_PMA |
| 453 | IQCG | SEQ ID NO. 260 | 0.283 | 0.345 | 1.218 | CREB_FSK |
| 454 | IQCG | SEQ ID NO. 260 | 0.283 | 0.568 | 2.005 | CREB_PMA |
| 455 | AZI2 | SEQ ID NO. 261 | 1.678 | 1.943 | 1.158 | CREB_FSK |
| 456 | AZI2 | SEQ ID NO. 261 | 1.678 | 1.741 | 1.037 | CREB_PMA |

FIG. 1U -- TABLE 1 TRANSCRIPTIONAL BIOMARKER FUNCTIONAL DATA
SECTION 7A

| LINE_ID | GENE_SYMBOL | SEQUENCE_ID_LISTING | PROM_ACTIVITY_N O_INDUCTION | PROM_ACTIVITY_WI TH_INDUCTION | INDUCTION RATIO | INDUCTION_CONDITIONS* |
|---|---|---|---|---|---|---|
| 457 | APBB3 | SEQ ID NO. 262 | 0.457 | 0.556 | 1.216 | CREB_FSK |
| 458 | APBB3 | SEQ ID NO. 262 | 0.457 | 0.579 | 1.267 | CREB_PMA |
| 459 | FLAD1 | SEQ ID NO. 263 | 5.43 | 6.988 | 1.287 | CREB_FSK |
| 460 | FLAD1 | SEQ ID NO. 263 | 5.43 | 7.692 | 1.417 | CREB_PMA |
| 461 | ZC3H10 | SEQ ID NO. 264 | 13.979 | 15.245 | 1.091 | CREB_FSK |
| 462 | ZC3H10 | SEQ ID NO. 264 | 13.979 | 13.345 | 0.955 | CREB_PMA |
| 463 | AREG | SEQ ID NO. 265 | 0.066 | 0.129 | 1.951 | CREB_FSK |
| 464 | AREG | SEQ ID NO. 265 | 0.066 | 0.352 | 5.346 | CREB_PMA |
| 465 | SGK1 | SEQ ID NO. 255 | 0.215 | 0.336 | 1.563 | CREB_FSK |
| 466 | SGK1 | SEQ ID NO. 255 | 0.215 | 0.498 | 2.317 | CREB_PMA |
| 467 | UCP1 | SEQ ID NO. 256 | 0.024 | 0.039 | 1.674 | CREB_FSK |
| 468 | UCP1 | SEQ ID NO. 256 | 0.024 | 0.05 | 2.115 | CREB_PMA |
| 469 | TIPARP | SEQ ID NO. 266 | 0.006 | 0.004 | 0.736 | CREB_FSK |
| 470 | TIPARP | SEQ ID NO. 266 | 0.006 | 0.008 | 1.399 | CREB_PMA |
| 471 | INSIG1 | SEQ ID NO. 266 | 0.075 | 0.147 | 1.958 | CREB_FSK |
| 472 | INSIG1 | SEQ ID NO. 266 | 0.075 | 0.155 | 2.069 | CREB_PMA |
| 473 | ACOX3 | SEQ ID NO. 267 | 0.011 | 0.01 | 0.936 | CREB_FSK |
| 474 | ACOX3 | SEQ ID NO. 267 | 0.011 | 0.021 | 2.001 | CREB_PMA |
| 475 | NR4A3 | SEQ ID NO. 268 | 0.014 | 0.018 | 1.298 | CREB_FSK |
| 476 | NR4A3 | SEQ ID NO. 268 | 0.014 | 0.024 | 1.773 | CREB_PMA |
| 477 | NEDD9 | SEQ ID NO. 269 | 0.215 | 0.478 | 2.219 | CREB_FSK |
| 478 | NEDD9 | SEQ ID NO. 269 | 0.215 | 0.602 | 2.798 | CREB_PMA |
| 479 | NR4A1 | SEQ ID NO. 269 | 3.508 | 5.55 | 1.582 | CREB_FSK |
| 480 | NR4A1 | SEQ ID NO. 269 | 3.508 | 45.412 | 12.946 | CREB_PMA |
| 481 | SLC2A3 | SEQ ID NO. 270 | 0.014 | 0.019 | 1.368 | CREB_FSK |
| 482 | SLC2A3 | SEQ ID NO. 270 | 0.014 | 0.033 | 2.354 | CREB_PMA |
| 483 | HMGCR | SEQ ID NO. 270 | 0.605 | 0.532 | 0.88 | CREB_FSK |
| 484 | HMGCR | SEQ ID NO. 270 | 0.605 | 0.629 | 1.041 | CREB_PMA |
| 485 | ACOX3 | SEQ ID NO. 271 | 0.976 | 1.273 | 1.304 | CREB_FSK |
| 486 | ACOX3 | SEQ ID NO. 271 | 0.976 | 2.873 | 2.943 | CREB_PMA |
| 487 | NR4A1 | SEQ ID NO. 272 | 0.056 | 0.085 | 1.515 | CREB_FSK |
| 488 | NR4A1 | SEQ ID NO. 272 | 0.056 | 0.178 | 3.166 | CREB_PMA |
| 489 | BCL2 | SEQ ID NO. 273 | 0.055 | 0.071 | 1.294 | CREB_FSK |
| 490 | BCL2 | SEQ ID NO. 273 | 0.055 | 0.069 | 1.262 | CREB_PMA |
| 491 | DNAJB9 | SEQ ID NO. 274 | 8.925 | 10.912 | 1.223 | CREB_FSK |
| 492 | DNAJB9 | SEQ ID NO. 274 | 8.925 | 9.244 | 1.036 | CREB_PMA |
| 493 | TSC22D4 | SEQ ID NO. 275 | 0.972 | 0.719 | 0.74 | CREB_FSK |
| 494 | TSC22D4 | SEQ ID NO. 275 | 0.972 | 1.03 | 1.059 | CREB_PMA |
| 495 | POR | SEQ ID NO. 276 | 5.132 | 5.131 | 1 | CREB_FSK |
| 496 | POR | SEQ ID NO. 276 | 5.132 | 5.127 | 0.999 | CREB_PMA |
| 497 | NULL | SEQ ID NO. 277 | 0.071 | 0.065 | 0.912 | CREB_FSK |
| 498 | NULL | SEQ ID NO. 277 | 0.071 | 0.074 | 1.039 | CREB_PMA |
| 499 | POP7 | SEQ ID NO. 278 | 14.814 | 13.407 | 0.905 | CREB_FSK |
| 500 | POP7 | SEQ ID NO. 278 | 14.814 | 12.91 | 0.871 | CREB_PMA |
| 501 | NULL | SEQ ID NO. 279 | 1.671 | 1.915 | 1.146 | CREB_FSK |
| 502 | NULL | SEQ ID NO. 279 | 1.671 | 1.39 | 0.832 | CREB_PMA |

FIG. 1V -- TABLE 1 TRANSCRIPTIONAL BIOMARKER FUNCTIONAL DATA
SECTION 7A

| LINE ID | GENE SYMBOL | SEQUENCE ID LISTING | PROM_ACTIVITY_N 0 INDUCTION | PROM_ACTIVITY WITH INDUCTION | INDUCTION RATIO | INDUCTION CONDITIONS* |
|---|---|---|---|---|---|---|
| 503 | TRIM56 | SEQ ID NO. 280 | 0.158 | 0.233 | 1.473 | CREB_FSK |
| 504 | TRIM56 | SEQ ID NO. 280 | 0.158 | 0.213 | 1.347 | CREB_PMA |
| 505 | REPIN1 | SEQ ID NO. 281 | 0.091 | 0.056 | 0.612 | CREB_FSK |
| 506 | REPIN1 | SEQ ID NO. 281 | 0.091 | 0.087 | 0.952 | CREB_PMA |
| 507 | INHBA | SEQ ID NO. 282 | 0.067 | 0.16 | 2.401 | CREB_FSK |
| 508 | INHBA | SEQ ID NO. 282 | 0.067 | 1.446 | 21.645 | CREB_PMA |
| 509 | BIRC3 | SEQ ID NO. 283 | 0.378 | 0.44 | 1.161 | CREB_FSK |
| 510 | BIRC3 | SEQ ID NO. 283 | 0.378 | 19.858 | 52.47 | CREB_PMA |
| 511 | APTX | SEQ ID NO. 284 | 0.019 | 0.032 | 1.704 | CREB_FSK |
| 512 | APTX | SEQ ID NO. 284 | 0.019 | 0.205 | 10.794 | CREB_PMA |
| 513 | CCND1 | SEQ ID NO. 285 | 0.069 | 0.091 | 1.326 | CREB_FSK |
| 514 | CCND1 | SEQ ID NO. 285 | 0.069 | 0.154 | 2.241 | CREB_PMA |
| 515 | BMF | SEQ ID NO. 286 | 0.095 | 0.113 | 1.19 | CREB_FSK |
| 516 | BMF | SEQ ID NO. 286 | 0.095 | 0.109 | 1.151 | CREB_PMA |
| 517 | BRCA1 | SEQ ID NO. 287 | 0.35 | 0.728 | 2.08 | CREB_FSK |
| 518 | BRCA1 | SEQ ID NO. 287 | 0.35 | 0.822 | 2.345 | CREB_PMA |
| 519 | PCNP | SEQ ID NO. 288 | 1.592 | 1.795 | 1.127 | CREB_FSK |
| 520 | PCNP | SEQ ID NO. 288 | 1.592 | 1.493 | 0.938 | CREB_PMA |
| 521 | APTX | SEQ ID NO. 289 | 1.145 | 1.721 | 1.503 | CREB_FSK |
| 522 | APTX | SEQ ID NO. 289 | 1.145 | 1.711 | 1.493 | CREB_PMA |
| 523 | BMF | SEQ ID NO. 290 | 0.121 | 0.137 | 1.133 | CREB_FSK |
| 524 | BMF | SEQ ID NO. 290 | 0.121 | 0.179 | 1.487 | CREB_PMA |
| 525 | RECQL5 | SEQ ID NO. 291 | 0.293 | 0.327 | 1.116 | CREB_FSK |
| 526 | RECQL5 | SEQ ID NO. 291 | 0.293 | 0.507 | 1.731 | CREB_PMA |
| 527 | EIF2B1 | SEQ ID NO. 292 | 0.119 | 0.163 | 1.363 | CREB_FSK |
| 528 | EIF2B1 | SEQ ID NO. 292 | 0.119 | 0.186 | 1.575 | CREB_PMA |
| 529 | CCNL1 | SEQ ID NO. 293 | 0.008 | 0.011 | 1.387 | CREB_FSK |
| 530 | CCNL1 | SEQ ID NO. 293 | 0.008 | 0.012 | 1.446 | CREB_PMA |
| 531 | TNF | SEQ ID NO. 294 | 0.009 | 0.031 | 3.402 | CREB_FSK |
| 532 | TNF | SEQ ID NO. 294 | 0.009 | 0.048 | 5.323 | CREB_PMA |
| 533 | GTF2H1 | SEQ ID NO. 295 | 3.722 | 4.634 | 1.245 | CREB_FSK |
| 534 | GTF2H1 | SEQ ID NO. 295 | 3.722 | 9.793 | 2.631 | CREB_PMA |
| 535 | GADD45G | SEQ ID NO. 296 | 0.005 | 0.007 | 1.548 | CREB_FSK |
| 536 | GADD45G | SEQ ID NO. 296 | 0.005 | 0.007 | 1.596 | CREB_PMA |
| 537 | HSPA5 | SEQ ID NO. 297 | 0.056 | 0.075 | 1.343 | CREB_FSK |
| 538 | HSPA5 | SEQ ID NO. 297 | 0.056 | 0.081 | 1.458 | CREB_PMA |
| 539 | DDIT3 | SEQ ID NO. 298 | 14.752 | 15.287 | 1.036 | CREB_FSK |
| 540 | DDIT3 | SEQ ID NO. 298 | 14.752 | 53.538 | 3.629 | CREB_PMA |
| 541 | CCNG2 | SEQ ID NO. 299 | 0.062 | 0.095 | 1.554 | CREB_FSK |
| 542 | CCNG2 | SEQ ID NO. 299 | 0.062 | 0.214 | 3.464 | CREB_PMA |
| 543 | RGS2 | SEQ ID NO. 300 | 0.007 | 0.008 | 1.244 | CREB_FSK |
| 544 | RGS2 | SEQ ID NO. 300 | 0.007 | 0.011 | 1.658 | CREB_PMA |
| 545 | PTP4A1 | SEQ ID NO. 301 | 3.951 | 7.155 | 1.811 | CREB_FSK |
| 546 | PTP4A1 | SEQ ID NO. 301 | 3.951 | 6.324 | 1.601 | CREB_PMA |
| 547 | MAFF | SEQ ID NO. 302 | 1.975 | 2.722 | 1.378 | CREB_FSK |
| 548 | MAFF | SEQ ID NO. 302 | 1.975 | 4.366 | 2.211 | CREB_PMA |

FIG. 1W.— TABLE 1 TRANSCRIPTIONAL BIOMARKER FUNCTIONAL DATA
SECTION 7A

| LINE_ID | GENE_SYMBOL | SEQUENCE_ID_LISTING | PROM_ACTIVITY_N 0_INDUCTION | PROM_ACTIVITY_N TH_INDUCTION | PROM_ACTIVITY_WI INDUCTION | INDUCTION_RATIO | INDUCTION_CONDITIONS* |
|---|---|---|---|---|---|---|---|
| 549 | CCND1 | SEQ ID NO. 303 | | 0.597 | 1.117 | 1.871 | CREB_FSK |
| 550 | CCND1 | SEQ ID NO. 303 | | 0.597 | 2.637 | 4.419 | CREB_PMA |
| 551 | NF1 | SEQ ID NO. 304 | | 0.066 | 0.064 | 0.978 | CREB_FSK |
| 552 | NF1 | SEQ ID NO. 304 | | 0.066 | 0.069 | 1.054 | CREB_PMA |
| 553 | INHA | SEQ ID NO. 305 | | 0.044 | 0.067 | 1.547 | CREB_FSK |
| 554 | INHA | SEQ ID NO. 305 | | 0.044 | 0.113 | 2.589 | CREB_PMA |
| 555 | NFKBIB | SEQ ID NO. 306 | | 0.267 | 0.349 | 1.308 | CREB_FSK |
| 556 | NFKBIB | SEQ ID NO. 306 | | 0.267 | 0.589 | 2.208 | CREB_PMA |
| 557 | MYC | SEQ ID NO. 307 | | 0.341 | 0.354 | 1.038 | CREB_FSK |
| 558 | MYC | SEQ ID NO. 307 | | 0.341 | 0.769 | 2.259 | CREB_PMA |
| 559 | DUSP1 | SEQ ID NO. 308 | | 0.012 | 0.014 | 1.164 | CREB_FSK |
| 560 | DUSP1 | SEQ ID NO. 308 | | 0.012 | 0.017 | 1.479 | CREB_PMA |
| 561 | ETS2 | SEQ ID NO. 309 | | 0.809 | 1.028 | 1.27 | CREB_FSK |
| 562 | ETS2 | SEQ ID NO. 309 | | 0.809 | 1.429 | 1.767 | CREB_PMA |
| 563 | HDAC6 | SEQ ID NO. 310 | | 0.618 | 0.714 | 1.157 | CREB_FSK |
| 564 | HDAC6 | SEQ ID NO. 310 | | 0.618 | 0.937 | 1.517 | CREB_PMA |
| 565 | DUSP4 | SEQ ID NO. 311 | | 0.241 | 0.24 | 0.997 | CREB_FSK |
| 566 | DUSP4 | SEQ ID NO. 311 | | 0.241 | 0.734 | 3.046 | CREB_PMA |
| 567 | APTX | SEQ ID NO. 311 | | 1.35 | 3.261 | 1.762 | CREB_FSK |
| 568 | APTX | SEQ ID NO. 311 | | 1.35 | 2.025 | 1.094 | CREB_PMA |
| 569 | PCNA | SEQ ID NO. 312 | | 0.745 | 1.419 | 1.904 | CREB_FSK |
| 570 | PCNA | SEQ ID NO. 312 | | 0.745 | 0.89 | 1.195 | CREB_PMA |
| 571 | PTP4A1 | SEQ ID NO. 313 | | 0.353 | 0.584 | 1.654 | CREB_FSK |
| 572 | PTP4A1 | SEQ ID NO. 313 | | 0.353 | 0.915 | 2.591 | CREB_PMA |
| 573 | PIM1 | SEQ ID NO. 314 | | 1.98 | 3.29 | 1.661 | CREB_FSK |
| 574 | PIM1 | SEQ ID NO. 314 | | 1.98 | 2.217 | 1.12 | CREB_PMA |
| 575 | HTT | SEQ ID NO. 315 | | 17.284 | 18.652 | 1.079 | CREB_FSK |
| 576 | HTT | SEQ ID NO. 315 | | 17.284 | 22.117 | 1.28 | CREB_PMA |
| 577 | JUND | SEQ ID NO. 316 | | 0.09 | 0.094 | 1.05 | CREB_FSK |
| 578 | JUND | SEQ ID NO. 316 | | 0.09 | 0.108 | 1.198 | CREB_PMA |
| 579 | IFRD1 | SEQ ID NO. 317 | | 0.032 | 0.052 | 1.615 | CREB_FSK |
| 580 | IFRD1 | SEQ ID NO. 317 | | 0.032 | 0.064 | 1.97 | CREB_PMA |
| 581 | IGFBP1 | SEQ ID NO. 318 | | 0.155 | 0.159 | 1.022 | CREB_FSK |
| 582 | IGFBP1 | SEQ ID NO. 318 | | 0.155 | 0.288 | 1.853 | CREB_PMA |
| 583 | PDK4 | SEQ ID NO. 319 | | 0.027 | 0.042 | 1.546 | CREB_FSK |
| 584 | PDK4 | SEQ ID NO. 319 | | 0.027 | 0.061 | 2.223 | CREB_PMA |
| 585 | IFRD1 | SEQ ID NO. 320 | | 0.069 | 0.172 | 2.501 | CREB_FSK |
| 586 | IFRD1 | SEQ ID NO. 320 | | 0.069 | 0.157 | 2.231 | CREB_PMA |
| 587 | FGF6 | SEQ ID NO. 321 | | 0.083 | 0.081 | 0.982 | CREB_FSK |
| 588 | FGF6 | SEQ ID NO. 321 | | 0.083 | 0.085 | 1.03 | CREB_PMA |
| 589 | CDK5 | SEQ ID NO. 322 | | 0.136 | 0.241 | 1.774 | CREB_FSK |
| 590 | CDK5 | SEQ ID NO. 322 | | 0.136 | 0.176 | 1.301 | CREB_PMA |
| 591 | CKS2 | SEQ ID NO. 323 | | 8.077 | 11.347 | 1.405 | CREB_FSK |
| 592 | CKS2 | SEQ ID NO. 323 | | 8.077 | 28.302 | 3.504 | CREB_PMA |
| 593 | NEDD9 | SEQ ID NO. 324 | | 0.052 | 0.061 | 1.171 | CREB_FSK |
| 594 | NEDD9 | SEQ ID NO. 324 | | 0.052 | 0.105 | 2.02 | CREB_PMA |

*FIG. 1X* -- TABLE 1 TRANSCRIPTIONAL BIOMARKER FUNCTIONAL DATA
SECTION 7A

| LINE_ID | GENE_SYMBOL | SEQUENCE_ID_LISTING | PROM_ACTIVITY_N O_INDUCTION | PROM_ACTIVITY_WI TH_INDUCTION | INDUCTION _RATIO | INDUCTION_CONDITIONS* |
|---|---|---|---|---|---|---|
| 595 | CDKN2B | SEQ ID NO. 325 | 0.83 | 1.378 | 1.66 | CREB_FSK |
| 596 | CDKN2B | SEQ ID NO. 325 | 0.83 | 4.764 | 5.739 | CREB_PMA |
| 597 | EXO1 | SEQ ID NO. 326 | 0.11 | 0.17 | 1.544 | CREB_FSK |
| 598 | EXO1 | SEQ ID NO. 326 | 0.11 | 1.35 | 12.25 | CREB_PMA |
| 599 | SSSCA1 | SEQ ID NO. 327 | 0.085 | 0.114 | 1.334 | CREB_FSK |
| 600 | SSSCA1 | SEQ ID NO. 327 | 0.085 | 0.164 | 1.925 | CREB_PMA |
| 601 | JUN | SEQ ID NO. 328 | 0.037 | 0.066 | 1.779 | CREB_FSK |
| 602 | JUN | SEQ ID NO. 328 | 0.037 | 0.173 | 4.694 | CREB_PMA |
| 603 | PTGS2 | SEQ ID NO. 329 | 0.094 | 0.111 | 1.174 | CREB_FSK |
| 604 | PTGS2 | SEQ ID NO. 329 | 0.094 | 0.454 | 4.81 | CREB_PMA |
| 605 | AGT | SEQ ID NO. 330 | 0.092 | 0.196 | 2.134 | CREB_FSK |
| 606 | AGT | SEQ ID NO. 330 | 0.092 | 0.495 | 5.393 | CREB_PMA |
| 607 | ADRB1 | SEQ ID NO. 331 | 0.007 | 0.01 | 1.441 | CREB_FSK |
| 608 | ADRB1 | SEQ ID NO. 331 | 0.007 | 0.018 | 2.438 | CREB_PMA |
| 609 | ADM | SEQ ID NO. 332 | 0.012 | 0.014 | 1.156 | CREB_FSK |
| 610 | ADM | SEQ ID NO. 332 | 0.012 | 0.017 | 1.332 | CREB_PMA |
| 611 | LDHA | SEQ ID NO. 332 | 0.007 | 0.01 | 1.422 | CREB_FSK |
| 612 | LDHA | SEQ ID NO. 332 | 0.007 | 0.019 | 2.733 | CREB_PMA |
| 613 | FOS | SEQ ID NO. 333 | 0.007 | 0.007 | 1.075 | CREB_FSK |
| 614 | FOS | SEQ ID NO. 333 | 0.007 | 0.015 | 2.236 | CREB_PMA |
| 615 | NOS2A | SEQ ID NO. 334 | 0.053 | 0.08 | 1.498 | CREB_FSK |
| 616 | NOS2A | SEQ ID NO. 334 | 0.053 | 0.239 | 4.479 | CREB_PMA |
| 617 | HK2 | SEQ ID NO. 334 | 0.014 | 0.019 | 1.388 | CREB_FSK |
| 618 | HK2 | SEQ ID NO. 334 | 0.014 | 0.022 | 1.658 | CREB_PMA |
| 619 | EGF | SEQ ID NO. 335 | 0.509 | 0.523 | 1.028 | CREB_FSK |
| 620 | EGF | SEQ ID NO. 335 | 0.509 | 1.267 | 2.491 | CREB_PMA |
| 621 | IL6 | SEQ ID NO. 336 | 0.888 | 0.715 | 0.804 | CREB_FSK |
| 622 | IL6 | SEQ ID NO. 336 | 0.888 | 7.263 | 8.181 | CREB_PMA |
| 623 | CYCS | SEQ ID NO. 337 | 6.803 | 8.264 | 1.215 | CREB_FSK |
| 624 | CYCS | SEQ ID NO. 337 | 6.803 | 17.06 | 2.508 | CREB_PMA |
| 625 | NR3C1 | SEQ ID NO. 338 | 0.006 | 0.003 | 1.445 | CREB_FSK |
| 626 | NR3C1 | SEQ ID NO. 338 | 0.006 | 0.012 | 2.11 | CREB_PMA |
| 627 | PC | SEQ ID NO. 339 | 0.345 | 0.832 | 2.414 | CREB_FSK |
| 628 | PC | SEQ ID NO. 339 | 0.345 | 0.877 | 2.547 | CREB_PMA |
| 629 | PLAUR | SEQ ID NO. 340 | 0.036 | 0.055 | 1.53 | CREB_FSK |
| 630 | PLAUR | SEQ ID NO. 340 | 0.036 | 0.374 | 10.448 | CREB_PMA |
| 631 | EMD | SEQ ID NO. 341 | 1.41 | 2.551 | 1.809 | CREB_FSK |
| 632 | EMD | SEQ ID NO. 341 | 1.41 | 1.904 | 1.351 | CREB_PMA |
| 633 | SFRS11 | SEQ ID NO. 342 | 0.009 | 0.009 | 0.99 | CREB_FSK |
| 634 | SFRS11 | SEQ ID NO. 342 | 0.009 | 0.013 | 1.436 | CREB_PMA |
| 635 | SFRS11 | SEQ ID NO. 343 | 0.017 | 0.023 | 1.327 | CREB_FSK |
| 636 | SFRS11 | SEQ ID NO. 343 | 0.017 | 0.024 | 1.408 | CREB_PMA |
| 637 | ATP1A1 | SEQ ID NO. 344 | 0.476 | 0.975 | 2.05 | CREB_FSK |
| 638 | ATP1A1 | SEQ ID NO. 344 | 0.476 | 0.91 | 1.912 | CREB_PMA |
| 639 | ATP1A1 | SEQ ID NO. 345 | 0.04 | 0.061 | 1.529 | CREB_FSK |
| 640 | ATP1A1 | SEQ ID NO. 345 | 0.04 | 0.084 | 2.112 | CREB_PMA |
| 641 | RGS1 | SEQ ID NO. 346 | 0.019 | 0.02 | 1.059 | CREB_FSK |
| 642 | RGS1 | SEQ ID NO. 346 | 0.019 | 0.037 | 1.9 | CREB_PMA |

*FIG. 1Y* -- TABLE 1 TRANSCRIPTIONAL BIOMARKER FUNCTIONAL DATA
SECTION 7A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS* |
|---|---|---|---|---|---|---|
| 643 | ATF3 | SEQ ID NO. 347 | 0.319 | 0.171 | 0.536 | CREB_FSK |
| 644 | ATF3 | SEQ ID NO. 347 | 0.319 | 0.18 | 0.563 | CREB_PMA |
| 645 | BMP8B | SEQ ID NO. 348 | 0.247 | 0.499 | 2.023 | CREB_FSK |
| 646 | BMP8B | SEQ ID NO. 348 | 0.247 | 0.688 | 2.789 | CREB_PMA |
| 647 | MAGOH | SEQ ID NO. 349 | 1.515 | 1.74 | 1.149 | CREB_FSK |
| 648 | MAGOH | SEQ ID NO. 349 | 1.515 | 2.209 | 1.458 | CREB_PMA |
| 649 | PTGER3 | SEQ ID NO. 350 | 0.056 | 0.079 | 1.397 | CREB_FSK |
| 650 | PTGER3 | SEQ ID NO. 350 | 0.056 | 0.143 | 2.53 | CREB_PMA |
| 651 | PMVK | SEQ ID NO. 351 | 0.145 | 0.205 | 1.413 | CREB_FSK |
| 652 | PMVK | SEQ ID NO. 351 | 0.145 | 0.253 | 1.74 | CREB_PMA |
| 653 | ZEB1 | SEQ ID NO. 352 | 0.664 | 0.656 | 0.988 | CREB_FSK |
| 654 | ZEB1 | SEQ ID NO. 352 | 0.664 | 1.146 | 1.726 | CREB_PMA |
| 655 | CREM | SEQ ID NO. 353 | 2.387 | 3.441 | 1.442 | CREB_FSK |
| 656 | CREM | SEQ ID NO. 353 | 2.387 | 4.634 | 1.941 | CREB_PMA |
| 657 | CREM | SEQ ID NO. 354 | 0.079 | 0.288 | 3.633 | CREB_FSK |
| 658 | CREM | SEQ ID NO. 354 | 0.079 | 3.352 | 42.25 | CREB_PMA |
| 659 | GHITM | SEQ ID NO. 355 | 9.601 | 12.339 | 1.285 | CREB_FSK |
| 660 | GHITM | SEQ ID NO. 355 | 9.601 | 16.964 | 1.767 | CREB_PMA |
| 661 | ID11 | SEQ ID NO. 355 | 0.03 | 0.045 | 1.511 | CREB_FSK |
| 662 | ID11 | SEQ ID NO. 356 | 0.03 | 0.049 | 1.653 | CREB_PMA |
| 663 | ID11 | SEQ ID NO. 356 | 0.198 | 0.409 | 2.063 | CREB_FSK |
| 664 | ID11 | SEQ ID NO. 357 | 0.198 | 0.712 | 3.59 | CREB_PMA |
| 665 | RRM1 | SEQ ID NO. 357 | 0.055 | 0.051 | 0.924 | CREB_FSK |
| 666 | RRM1 | SEQ ID NO. 358 | 0.055 | 0.04 | 0.737 | CREB_PMA |
| 667 | GAL | SEQ ID NO. 358 | 0.006 | 0.009 | 1.547 | CREB_FSK |
| 668 | GAL | SEQ ID NO. 359 | 0.006 | 0.012 | 2.197 | CREB_PMA |
| 669 | FAU | SEQ ID NO. 359 | 2.381 | 2.159 | 0.907 | CREB_FSK |
| 670 | FAU | SEQ ID NO. 360 | 2.381 | 1.613 | 0.677 | CREB_PMA |
| 671 | UCP2 | SEQ ID NO. 360 | 0.122 | 0.281 | 2.301 | CREB_FSK |
| 672 | UCP2 | SEQ ID NO. 361 | 0.122 | 0.291 | 2.379 | CREB_PMA |
| 673 | SRPR | SEQ ID NO. 361 | 0.115 | 0.295 | 2.572 | CREB_FSK |
| 674 | SRPR | SEQ ID NO. 362 | 0.115 | 0.248 | 2.162 | CREB_PMA |
| 675 | AQP2 | SEQ ID NO. 362 | 0.094 | 0.072 | 0.761 | CREB_FSK |
| 676 | AQP2 | SEQ ID NO. 363 | 0.094 | 0.137 | 1.454 | CREB_PMA |
| 677 | PWP1 | SEQ ID NO. 363 | 0.034 | 0.038 | 1.126 | CREB_FSK |
| 678 | PWP1 | SEQ ID NO. 364 | 0.034 | 0.048 | 1.404 | CREB_PMA |
| 679 | MAPKAPK5 | SEQ ID NO. 364 | 0.044 | 0.067 | 1.509 | CREB_FSK |
| 680 | MAPKAPK5 | SEQ ID NO. 365 | 0.044 | 0.045 | 1.022 | CREB_PMA |
| 681 | MAPKAPK5 | SEQ ID NO. 365 | 0.408 | 0.487 | 1.194 | CREB_FSK |
| 682 | MAPKAPK5 | SEQ ID NO. 366 | 0.408 | 0.498 | 1.222 | CREB_PMA |
| 683 | ZNF26 | SEQ ID NO. 366 | 0.072 | 0.107 | 1.494 | CREB_FSK |
| 684 | ZNF26 | SEQ ID NO. 367 | 0.072 | 0.071 | 0.99 | CREB_PMA |
| 685 | CNPY2 | SEQ ID NO. 367 | 0.044 | 0.043 | 0.984 | CREB_FSK |
| 686 | CNPY2 | SEQ ID NO. 368 | 0.044 | 0.037 | 0.842 | CREB_PMA |
| 687 | SDS | SEQ ID NO. 368 | 0.391 | 0.381 | 0.974 | CREB_FSK |
| 688 | SDS | SEQ ID NO. 369 | 0.391 | 1.144 | 2.928 | CREB_PMA |
| 689 | SPRY2 | SEQ ID NO. 369 | 0.481 | 0.849 | 1.767 | CREB_FSK |
| 690 | SPRY2 | SEQ ID NO. 369 | 0.481 | 1.29 | 2.684 | CREB_PMA |

FIG. 1Z -- TABLE 1 TRANSCRIPTIONAL BIOMARKER FUNCTIONAL DATA
SECTION 7A

| LINE_ID | GENE_SYMBOL | SEQUENCE_ID_LISTING | PROM_ACTIVITY_N O_INDUCTION | PROM_ACTIVITY_WI TH_INDUCTION | INDUCTION RATIO | INDUCTION_CONDITIONS* |
|---|---|---|---|---|---|---|
| 691 | PCK2 | SEQ ID NO. 370 | 0.009 | 0.013 | 1.437 | CREB_FSK |
| 692 | PCK2 | SEQ ID NO. 370 | 0.009 | 0.01 | 1.044 | CREB_PMA |
| 693 | CHGA | SEQ ID NO. 371 | 0.046 | 0.076 | 1.644 | CREB_FSK |
| 694 | CHGA | SEQ ID NO. 371 | 0.046 | 0.088 | 1.908 | CREB_PMA |
| 695 | RPS6KA5 | SEQ ID NO. 372 | 0.134 | 0.189 | 1.407 | CREB_FSK |
| 696 | RPS6KA5 | SEQ ID NO. 372 | 0.134 | 0.153 | 1.136 | CREB_PMA |
| 697 | NULL | SEQ ID NO. 373 | 0.061 | 0.111 | 1.382 | CREB_FSK |
| 698 | NULL | SEQ ID NO. 373 | 0.081 | 0.347 | 4.306 | CREB_PMA |
| 699 | RRAD | SEQ ID NO. 374 | 0.085 | 0.144 | 1.706 | CREB_FSK |
| 700 | RRAD | SEQ ID NO. 374 | 0.085 | 1.003 | 11.844 | CREB_PMA |
| 701 | TAT | SEQ ID NO. 375 | 0.279 | 0.371 | 1.332 | CREB_FSK |
| 702 | TAT | SEQ ID NO. 375 | 0.279 | 0.884 | 3.17 | CREB_PMA |
| 703 | SSTR2 | SEQ ID NO. 376 | 0.135 | 0.196 | 1.453 | CREB_FSK |
| 704 | SSTR2 | SEQ ID NO. 376 | 0.135 | 0.246 | 1.827 | CREB_PMA |
| 705 | AANAT | SEQ ID NO. 377 | 0.074 | 0.086 | 1.161 | CREB_FSK |
| 706 | AANAT | SEQ ID NO. 377 | 0.074 | 0.175 | 2.374 | CREB_PMA |
| 707 | PER1 | SEQ ID NO. 378 | 0.272 | 0.258 | 0.949 | CREB_FSK |
| 708 | PER1 | SEQ ID NO. 378 | 0.272 | 0.672 | 2.469 | CREB_PMA |
| 709 | TOB1 | SEQ ID NO. 379 | 0.074 | 0.28 | 3.775 | CREB_FSK |
| 710 | TOB1 | SEQ ID NO. 379 | 0.074 | 0.368 | 4.971 | CREB_PMA |
| 711 | PMAIP1 | SEQ ID NO. 380 | 4.969 | 8.736 | 1.761 | CREB_FSK |
| 712 | PMAIP1 | SEQ ID NO. 380 | 4.989 | 20.907 | 4.19 | CREB_PMA |
| 713 | VPS4B | SEQ ID NO. 381 | 0.034 | 0.03 | 0.886 | CREB_FSK |
| 714 | VPS4B | SEQ ID NO. 381 | 0.034 | 0.063 | 1.999 | CREB_PMA |
| 715 | BCKDHA | SEQ ID NO. 382 | 0.948 | 0.944 | 0.996 | CREB_FSK |
| 716 | BCKDHA | SEQ ID NO. 382 | 0.948 | 1.519 | 1.602 | CREB_PMA |
| 717 | GIPR | SEQ ID NO. 383 | 0.136 | 0.184 | 1.337 | CREB_FSK |
| 718 | GIPR | SEQ ID NO. 383 | 0.138 | 3.276 | 23.815 | CREB_PMA |
| 719 | ZNF331 | SEQ ID NO. 384 | 0.846 | 1.174 | 1.388 | CREB_FSK |
| 720 | ZNF331 | SEQ ID NO. 384 | 0.846 | 1.252 | 1.481 | CREB_PMA |
| 721 | GPA3 | SEQ ID NO. 385 | 1.015 | 1.023 | 1.007 | CREB_FSK |
| 722 | GPA3 | SEQ ID NO. 385 | 1.015 | 1.628 | 1.603 | CREB_PMA |
| 723 | ID2 | SEQ ID NO. 386 | 1.208 | 1.413 | 1.174 | CREB_FSK |
| 724 | ID2 | SEQ ID NO. 386 | 1.208 | 0.92 | 0.762 | CREB_PMA |
| 725 | C2orf49 | SEQ ID NO. 387 | 0.025 | 0.026 | 1.033 | CREB_FSK |
| 726 | C2orf49 | SEQ ID NO. 387 | 0.025 | 0.031 | 1.25 | CREB_PMA |
| 727 | CREB1 | SEQ ID NO. 388 | 0.511 | 0.713 | 1.394 | CREB_FSK |
| 728 | CREB1 | SEQ ID NO. 388 | 0.511 | 2.713 | 5.306 | CREB_PMA |
| 729 | CDC1 | SEQ ID NO. 389 | 0.056 | 0.07 | 1.239 | CREB_FSK |
| 730 | CDC1 | SEQ ID NO. 389 | 0.056 | 0.399 | 7.108 | CREB_PMA |
| 731 | ZFP36L2 | SEQ ID NO. 390 | 0.176 | 0.154 | 0.878 | CREB_FSK |
| 732 | ZFP36L2 | SEQ ID NO. 390 | 0.176 | 0.256 | 1.456 | CREB_PMA |
| 733 | TACR1 | SEQ ID NO. 391 | 0.052 | 0.115 | 2.213 | CREB_FSK |
| 734 | TACR1 | SEQ ID NO. 391 | 0.052 | 0.207 | 3.976 | CREB_PMA |
| 735 | NULL | SEQ ID NO. 392 | 0.521 | 0.787 | 1.509 | CREB_FSK |
| 736 | NULL | SEQ ID NO. 392 | 0.521 | 0.709 | 1.359 | CREB_PMA |
| 737 | GCG | SEQ ID NO. 393 | 0.033 | 0.063 | 1.928 | CREB_FSK |
| 738 | GCG | SEQ ID NO. 393 | 0.033 | 0.192 | 5.903 | CREB_PMA |

*FIG. 1AA* – TABLE 1 TRANSCRIPTIONAL BIOMARKER FUNCTIONAL DATA
SECTION 7A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS |
|---|---|---|---|---|---|---|
| 739 | FN1 | SEQ ID NO. 394 | 0.132 | 0.14 | 1.063 | CREB_FSK |
| 740 | FN1 | SEQ ID NO. 394 | 0.132 | 0.705 | 5.356 | CREB_PMA |
| 741 | FN1 | SEQ ID NO. 395 | 0.039 | 0.062 | 1.613 | CREB_FSK |
| 742 | FN1 | SEQ ID NO. 395 | 0.039 | 0.097 | 2.515 | CREB_PMA |
| 743 | ID1 | SEQ ID NO. 396 | 0.022 | 0.043 | 1.93 | CREB_FSK |
| 744 | ID1 | SEQ ID NO. 396 | 0.022 | 0.032 | 1.446 | CREB_PMA |
| 745 | CEBPB | SEQ ID NO. 397 | 0.014 | 0.053 | 3.605 | CREB_FSK |
| 746 | CEBPB | SEQ ID NO. 397 | 0.014 | 0.071 | 4.937 | CREB_PMA |
| 747 | CRYAA | SEQ ID NO. 398 | 0.016 | 0.03 | 1.86 | CREB_FSK |
| 748 | CRYAA | SEQ ID NO. 398 | 0.016 | 0.063 | 3.86 | CREB_PMA |
| 749 | ADAMTS1 | SEQ ID NO. 399 | 0.042 | 0.083 | 1.956 | CREB_FSK |
| 750 | ADAMTS1 | SEQ ID NO. 399 | 0.042 | 0.095 | 2.265 | CREB_PMA |
| 751 | U2AF1 | SEQ ID NO. 400 | 0.462 | 0.594 | 1.287 | CREB_FSK |
| 752 | U2AF1 | SEQ ID NO. 400 | 0.462 | 0.633 | 1.37 | CREB_PMA |
| 753 | NUP50 | SEQ ID NO. 401 | 0.567 | 0.883 | 1.558 | CREB_FSK |
| 754 | NUP50 | SEQ ID NO. 401 | 0.567 | 0.961 | 1.695 | CREB_PMA |
| 755 | BHLHB2 | SEQ ID NO. 402 | 3.429 | 2.477 | 0.722 | CREB_FSK |
| 756 | BHLHB2 | SEQ ID NO. 402 | 3.429 | 22.411 | 6.536 | CREB_PMA |
| 757 | SNRK | SEQ ID NO. 403 | 0.695 | 1.019 | 1.467 | CREB_FSK |
| 758 | SNRK | SEQ ID NO. 403 | 0.695 | 1.292 | 1.86 | CREB_PMA |
| 759 | ALAS1 | SEQ ID NO. 404 | 1.228 | 1.673 | 1.362 | CREB_FSK |
| 760 | ALAS1 | SEQ ID NO. 404 | 1.228 | 2.732 | 2.224 | CREB_PMA |
| 761 | STK19 | SEQ ID NO. 405 | 0.015 | 0.018 | 1.215 | CREB_FSK |
| 762 | STK19 | SEQ ID NO. 405 | 0.015 | 0.023 | 1.494 | CREB_PMA |
| 763 | STK19 | SEQ ID NO. 406 | 0.016 | 0.017 | 1.065 | CREB_FSK |
| 764 | STK19 | SEQ ID NO. 406 | 0.016 | 0.039 | 2.428 | CREB_PMA |
| 765 | AMD1 | SEQ ID NO. 407 | 0.083 | 0.093 | 1.123 | CREB_FSK |
| 766 | AMD1 | SEQ ID NO. 407 | 0.083 | 0.137 | 1.652 | CREB_PMA |
| 767 | AMD1 | SEQ ID NO. 408 | 0.06 | 0.08 | 1.344 | CREB_FSK |
| 768 | AMD1 | SEQ ID NO. 408 | 0.06 | 0.153 | 2.657 | CREB_PMA |
| 769 | VIP | SEQ ID NO. 409 | 0.03 | 0.056 | 1.896 | CREB_FSK |
| 770 | VIP | SEQ ID NO. 409 | 0.03 | 0.098 | 3.31 | CREB_PMA |
| 771 | CITED2 | SEQ ID NO. 410 | 0.028 | 0.044 | 1.595 | CREB_FSK |
| 772 | CITED2 | SEQ ID NO. 410 | 0.028 | 0.034 | 1.228 | CREB_PMA |
| 773 | SLC7A2 | SEQ ID NO. 411 | 0.192 | 0.499 | 2.545 | CREB_FSK |
| 774 | SLC7A2 | SEQ ID NO. 411 | 0.192 | 0.449 | 2.335 | CREB_PMA |
| 775 | SLC18A1 | SEQ ID NO. 412 | 0.049 | 0.129 | 2.651 | CREB_FSK |
| 776 | SLC18A1 | SEQ ID NO. 412 | 0.049 | 0.114 | 2.344 | CREB_PMA |
| 777 | CEBPD | SEQ ID NO. 413 | 0.081 | 0.079 | 0.97 | CREB_FSK |
| 778 | CEBPD | SEQ ID NO. 413 | 0.081 | 0.185 | 2.281 | CREB_PMA |
| 779 | CRH | SEQ ID NO. 414 | 0.031 | 0.041 | 1.338 | CREB_FSK |
| 780 | CRH | SEQ ID NO. 414 | 0.031 | 0.073 | 2.362 | CREB_PMA |
| 781 | PLAA | SEQ ID NO. 415 | 0.267 | 0.308 | 1.154 | CREB_FSK |
| 782 | PLAA | SEQ ID NO. 415 | 0.267 | 0.552 | 2.067 | CREB_PMA |
| 783 | NFIL3 | SEQ ID NO. 416 | 0.531 | 0.486 | 0.916 | CREB_FSK |
| 784 | NFIL3 | SEQ ID NO. 416 | 0.531 | 1.037 | 1.954 | CREB_PMA |
| 785 | KLF4 | SEQ ID NO. 417 | 1.057 | 1.414 | 1.337 | CREB_FSK |
| 786 | KLF4 | SEQ ID NO. 417 | 1.057 | 2.094 | 1.981 | CREB_PMA |

FIG. 1AB -- TABLE 1 TRANSCRIPTIONAL BIOMARKER FUNCTIONAL DATA
SECTION 7A

| LINE_ID | GENE_SYMBOL | SEQUENCE ID LISTING | PROM_ACTIVITY_N O_INDUCTION | PROM_ACTIVITY_WI TH_INDUCTION | INDUCTION RATIO | INDUCTION CONDITIONS* |
|---|---|---|---|---|---|---|
| 787 | MED27 | SEQ ID NO. 418 | 0.027 | 0.035 | 1.275 | CREB_FSK |
| 788 | MED27 | SEQ ID NO. 418 | 0.027 | 0.03 | 1.121 | CREB_PMA |
| 789 | SMS | SEQ ID NO. 419 | 0.053 | 0.07 | 1.308 | CREB_FSK |
| 790 | SMS | SEQ ID NO. 419 | 0.053 | 0.268 | 5.022 | CREB_PMA |
| 791 | PIGA | SEQ ID NO. 420 | 0.015 | 0.025 | 1.693 | CREB_FSK |
| 792 | PIGA | SEQ ID NO. 420 | 0.015 | 0.025 | 1.661 | CREB_PMA |
| 793 | EFNA1 | SEQ ID NO. 421 | 0.018 | 0.022 | 1.222 | CREB_FSK |
| 794 | EFNA1 | SEQ ID NO. 421 | 0.018 | 0.033 | 1.826 | CREB_PMA |
| 795 | CALCA | SEQ ID NO. 422 | 0.048 | 0.366 | 7.672 | CREB_FSK |
| 796 | CALCA | SEQ ID NO. 422 | 0.048 | 0.132 | 2.766 | CREB_PMA |
| 797 | PC | SEQ ID NO. 423 | 0.294 | 0.301 | 1.023 | CREB_FSK |
| 798 | PC | SEQ ID NO. 423 | 0.294 | 0.613 | 2.083 | CREB_PMA |
| 799 | DIO2 | SEQ ID NO. 424 | 0.109 | 0.118 | 1.084 | CREB_FSK |
| 800 | DIO2 | SEQ ID NO. 424 | 0.109 | 0.164 | 1.507 | CREB_PMA |
| 801 | TIMM13 | SEQ ID NO. 425 | 1.713 | 1.544 | 0.901 | CREB_FSK |
| 802 | TIMM13 | SEQ ID NO. 425 | 1.713 | 2.273 | 1.327 | CREB_PMA |
| 803 | FN1 | SEQ ID NO. 426 | 0.042 | 0.039 | 0.911 | CREB_FSK |
| 804 | FN1 | SEQ ID NO. 426 | 0.042 | 0.074 | 1.743 | CREB_PMA |
| 805 | CHGB | SEQ ID NO. 427 | 0.127 | 0.142 | 1.119 | CREB_FSK |
| 806 | CHGB | SEQ ID NO. 427 | 0.127 | 0.298 | 2.339 | CREB_PMA |
| 807 | NUP50 | SEQ ID NO. 428 | 0.016 | 0.016 | 1.033 | CREB_FSK |
| 808 | NUP50 | SEQ ID NO. 428 | 0.016 | 0.038 | 2.409 | CREB_PMA |
| 809 | AGXT2L1 | SEQ ID NO. 429 | 0.037 | 0.05 | 1.349 | CREB_FSK |
| 810 | AGXT2L1 | SEQ ID NO. 429 | 0.037 | 0.085 | 2.296 | CREB_PMA |
| 811 | HIST1H4E | SEQ ID NO. 430 | 0.217 | 0.209 | 0.962 | CREB_FSK |
| 812 | HIST1H4E | SEQ ID NO. 430 | 0.217 | 0.406 | 1.874 | CREB_PMA |
| 813 | ABT1 | SEQ ID NO. 431 | 0.288 | 0.419 | 1.454 | CREB_FSK |
| 814 | ABT1 | SEQ ID NO. 431 | 0.288 | 0.653 | 2.266 | CREB_PMA |
| 815 | CGA | SEQ ID NO. 432 | 0.238 | 0.611 | 2.563 | CREB_FSK |
| 816 | CGA | SEQ ID NO. 432 | 0.238 | 0.822 | 3.448 | CREB_PMA |
| 817 | PFKFB3 | SEQ ID NO. 433 | 1.2 | 2.058 | 1.714 | CREB_FSK |
| 818 | PFKFB3 | SEQ ID NO. 433 | 1.2 | 6.356 | 5.295 | CREB_PMA |
| 819 | GOT1 | SEQ ID NO. 434 | 0.078 | 0.111 | 1.412 | CREB_FSK |
| 820 | GOT1 | SEQ ID NO. 434 | 0.078 | 0.14 | 1.781 | CREB_PMA |
| 821 | NUP98 | SEQ ID NO. 435 | 0.211 | 0.156 | 0.74 | CREB_FSK |
| 822 | NUP98 | SEQ ID NO. 435 | 0.211 | 0.3 | 1.421 | CREB_PMA |
| 823 | DIO2 | SEQ ID NO. 436 | 0.063 | 0.092 | 1.447 | CREB_FSK |
| 824 | DIO2 | SEQ ID NO. 436 | 0.063 | 0.123 | 1.943 | CREB_PMA |
| 825 | PER1 | SEQ ID NO. 437 | 0.076 | 0.106 | 1.398 | CREB_FSK |
| 826 | PER1 | SEQ ID NO. 437 | 0.076 | 0.178 | 2.348 | CREB_PMA |
| 827 | HES1 | SEQ ID NO. 438 | 0.076 | 0.071 | 0.937 | CREB_FSK |
| 828 | HES1 | SEQ ID NO. 438 | 0.076 | 0.071 | 0.928 | CREB_PMA |
| 829 | PTGS2 | SEQ ID NO. 439 | 0.041 | 0.052 | 1.267 | CREB_FSK |
| 830 | PTGS2 | SEQ ID NO. 439 | 0.041 | 0.603 | 14.869 | CREB_PMA |
| 831 | TNF | SEQ ID NO. 439 | 0.57 | 1.281 | 2.247 | CREB_FSK |
| 832 | TNF | SEQ ID NO. 439 | 0.57 | 5.141 | 10.771 | CREB_PMA |

FIG. 1AC -- TABLE 1 TRANSCRIPTIONAL BIOMARKER FUNCTIONAL DATA
SECTION 7A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS* |
|---|---|---|---|---|---|---|
| 833 | NULL | SEQ ID NO. 440 | 0.158 | 0.144 | 0.912 | CREB_FSK |
| 834 | NULL | SEQ ID NO. 440 | 0.158 | 0.347 | 2.199 | CREB_PMA |
| 835 | NULL | SEQ ID NO. 441 | 0.039 | 0.059 | 1.515 | CREB_FSK |
| 836 | NULL | SEQ ID NO. 441 | 0.039 | 0.047 | 1.208 | CREB_PMA |
| 837 | PPP1R10 | SEQ ID NO. 442 | 50.517 | 53.471 | 1.058 | CREB_FSK |
| 838 | PPP1R10 | SEQ ID NO. 442 | 50.517 | 93.903 | 1.859 | CREB_PMA |
| 839 | C12orf60 | SEQ ID NO. 443 | 0.712 | 1.029 | 1.444 | CREB_FSK |
| 840 | C12orf60 | SEQ ID NO. 443 | 0.712 | 0.955 | 1.34 | CREB_PMA |
| 841 | C3orf26 | SEQ ID NO. 444 | 1.103 | 1.443 | 1.308 | CREB_FSK |
| 842 | C3orf26 | SEQ ID NO. 444 | 1.103 | 0.779 | 0.706 | CREB_PMA |
| 843 | C19orf47 | SEQ ID NO. 445 | 0.08 | 0.101 | 1.262 | CREB_FSK |
| 844 | C19orf47 | SEQ ID NO. 445 | 0.08 | 0.132 | 1.653 | CREB_PMA |
| 845 | NULL | SEQ ID NO. 446 | 0.007 | 0.009 | 1.246 | CREB_FSK |
| 846 | NULL | SEQ ID NO. 446 | 0.007 | 0.01 | 1.444 | CREB_PMA |
| 847 | C4orf21 | SEQ ID NO. 447 | 0.1 | 0.227 | 2.273 | CREB_FSK |
| 848 | C4orf21 | SEQ ID NO. 447 | 0.1 | 0.152 | 1.519 | CREB_PMA |
| 849 | LARP7 | SEQ ID NO. 448 | 0.009 | 0.011 | 1.212 | CREB_FSK |
| 850 | LARP7 | SEQ ID NO. 448 | 0.009 | 0.015 | 1.597 | CREB_PMA |
| 851 | NULL | SEQ ID NO. 449 | 0.064 | 0.088 | 1.373 | CREB_FSK |
| 852 | NULL | SEQ ID NO. 449 | 0.064 | 0.093 | 1.463 | CREB_PMA |
| 853 | NULL | SEQ ID NO. 450 | 3.47 | 2.508 | 0.723 | CREB_FSK |
| 854 | NULL | SEQ ID NO. 450 | 3.47 | 1.34 | 0.386 | CREB_PMA |
| 855 | FAM119B | SEQ ID NO. 451 | 0.01 | 0.013 | 1.334 | CREB_FSK |
| 856 | FAM119B | SEQ ID NO. 451 | 0.01 | 0.015 | 1.58 | CREB_PMA |
| 857 | RPL23 | SEQ ID NO. 452 | 1.227 | 1.414 | 1.153 | CREB_FSK |
| 858 | RPL23 | SEQ ID NO. 452 | 1.227 | 1.502 | 1.224 | CREB_PMA |
| 859 | BLOC1S2 | SEQ ID NO. 453 | 1.209 | 0.998 | 0.826 | CREB_FSK |
| 860 | BLOC1S2 | SEQ ID NO. 453 | 1.209 | 1.822 | 1.507 | CREB_PMA |

*FIG. 1AD* -- TABLE 1 TRANSCRIPTIONAL BIOMARKER FUNCTIONAL DATA
SECTION 2A

| LINE_ID | GENE_SYMBOL | SEQUENCE_ID_LISTING | PROM_ACTIVITY_N Q_INDUCTION | PROM_ACTIVITY_WI TH_INDUCTION | INDUCTION RATIO | INDUCTION_CONDITIONS" |
|---|---|---|---|---|---|---|
| 861 | ESR1 | SEQ ID NO. 454 | 0.32 | 0.465 | 1.46 | ER |
| 862 | SLC5A11 | SEQ ID NO. 455 | 0.154 | 0.163 | 1.056 | ER |
| 863 | PDCD6 | SEQ ID NO. 456 | 0.164 | 0.199 | 1.212 | ER |
| 864 | SEMA3B | SEQ ID NO. 457 | 0.307 | 0.226 | 0.737 | ER |
| 865 | GUCA1B | SEQ ID NO. 458 | 0.36 | 0.205 | 0.57 | ER |
| 866 | DCK7 | SEQ ID NO. 459 | 0.244 | 0.271 | 1.111 | ER |
| 867 | ZMIZ1 | SEQ ID NO. 460 | 0.86 | 0.751 | 0.873 | ER |
| 868 | S1PR3 | SEQ ID NO. 461 | 0.598 | 0.882 | 1.475 | ER |
| 869 | PCK1 | SEQ ID NO. 462 | 0.199 | 0.197 | 0.991 | ER |
| 870 | ST3GAL4 | SEQ ID NO. 463 | 0.525 | 2.193 | 4.181 | ER |
| 871 | KEAP1 | SEQ ID NO. 464 | 0.439 | 5.478 | 12.468 | ER |
| 872 | ADFP | SEQ ID NO. 465 | 4.773 | 1.603 | 0.336 | ER |
| 873 | FLJ45248 | SEQ ID NO. 466 | 0.255 | 0.304 | 1.192 | ER |
| 874 | SEMA3B | SEQ ID NO. 467 | 0.542 | 1.411 | 2.602 | ER |
| 875 | TTC21A | SEQ ID NO. 468 | 0.204 | 0.242 | 1.184 | ER |
| 876 | SLC7A5 | SEQ ID NO. 469 | 0.393 | 0.669 | 1.703 | ER |
| 877 | SH2B3 | SEQ ID NO. 470 | 0.62 | 1.523 | 2.456 | ER |
| 878 | HMGCS2 | SEQ ID NO. 471 | 0.371 | 0.961 | 2.592 | ER |
| 879 | NULL | SEQ ID NO. 472 | 0.26 | 0.209 | 0.805 | ER |
| 880 | PLXNA1 | SEQ ID NO. 473 | 0.248 | 0.2 | 0.807 | ER |
| 881 | DENND5B | SEQ ID NO. 474 | 0.818 | 0.749 | 0.916 | ER |
| 882 | NULL | SEQ ID NO. 475 | 0.213 | 0.177 | 0.833 | ER |
| 883 | PNKD | SEQ ID NO. 476 | 0.47 | 1.817 | 3.866 | ER |
| 884 | FLRT2 | SEQ ID NO. 477 | 0.201 | 0.286 | 1.424 | ER |
| 885 | PDLIM2 | SEQ ID NO. 478 | 0.341 | 0.812 | 2.382 | ER |
| 886 | PRELID1 | SEQ ID NO. 479 | 0.413 | 0.477 | 1.155 | ER |
| 887 | CDK6 | SEQ ID NO. 480 | 1.324 | 0.722 | 0.546 | ER |
| 888 | MCF2L | SEQ ID NO. 481 | 0.372 | 0.708 | 1.906 | ER |
| 889 | CYB561 | SEQ ID NO. 482 | 0.996 | 1.115 | 1.12 | ER |
| 890 | PSCA | SEQ ID NO. 483 | 0.293 | 0.408 | 1.393 | ER |
| 891 | NULL | SEQ ID NO. 484 | 0.153 | 0.137 | 0.894 | ER |
| 892 | AREG | SEQ ID NO. 485 | 0.45 | 0.722 | 1.603 | ER |
| 893 | NULL | SEQ ID NO. 486 | 0.234 | 0.55 | 2.351 | ER |
| 894 | CRKL | SEQ ID NO. 487 | 0.613 | 0.563 | 0.918 | ER |
| 895 | CELSR1 | SEQ ID NO. 488 | 0.168 | 0.155 | 0.92 | ER |
| 896 | IL24 | SEQ ID NO. 489 | 2.661 | 1.193 | 0.448 | ER |
| 897 | RPS11 | SEQ ID NO. 490 | 0.262 | 0.381 | 1.455 | ER |
| 898 | NULL | SEQ ID NO. 491 | 0.133 | 0.16 | 1.205 | ER |
| 899 | POLD4 | SEQ ID NO. 492 | 24.371 | 3.243 | 0.338 | ER |
| 900 | C15orf52 | SEQ ID NO. 493 | 0.473 | 1.647 | 3.485 | ER |
| 901 | SLC9A8 | SEQ ID NO. 494 | 16.651 | 13.993 | 0.84 | ER |
| 902 | HLA-F | SEQ ID NO. 495 | 0.217 | 0.223 | 1.026 | ER |
| 903 | LTF | SEQ ID NO. 496 | 0.299 | 0.459 | 1.534 | ER |
| 904 | C3orf23 | SEQ ID NO. 497 | 12.176 | 14.169 | 1.164 | ER |
| 905 | STC2 | SEQ ID NO. 498 | 1.744 | 4.199 | 2.408 | ER |
| 906 | POU6F1 | SEQ ID NO. 499 | 0.326 | 0.512 | 1.571 | ER |
| 907 | TFF1 | SEQ ID NO. 499 | 0.282 | 4.381 | 15.531 | ER |
| 908 | NULL | SEQ ID NO. 500 | 0.208 | 0.136 | 0.655 | ER |

FIG. 1AE -- TABLE 1 TRANSCRIPTIONAL BIOMARKER FUNCTIONAL DATA
SECTION 2A

| LINE_ID | GENE_SYMBOL | SEQUENCE_ID_LISTING | PROM_ACTIVITY_M_O_INDUCTION | PROM_ACTIVITY_M_TH_INDUCTION | PROM_ACTIVITY_WT_INDUCTION_RATIO | INDUCTION_CONDITIONS* |
|---|---|---|---|---|---|---|
| 909 | UGT2B17 | SEQ ID NO: 501 | 0.223 | 0.163 | 0.733 | ER |
| 910 | BRTX2 | SEQ ID NO: 502 | 0.549 | 1.685 | 3.072 | ER |
| 911 | NULL | SEQ ID NO: 503 | 2.518 | 3.664 | 1.455 | ER |
| 912 | SLC25A34 | SEQ ID NO: 504 | 0.166 | 0.208 | 1.251 | ER |
| 913 | MLN | SEQ ID NO: 505 | 0.325 | 0.409 | 1.258 | ER |
| 914 | MYLK | SEQ ID NO: 506 | 0.449 | 0.559 | 1.245 | ER |
| 915 | C7orf53 | SEQ ID NO: 507 | 0.162 | 0.153 | 0.944 | ER |
| 916 | GAPDH | SEQ ID NO: 508 | 1.302 | 1.388 | 1.065 | ER |
| 917 | MED24 | SEQ ID NO: 509 | 0.143 | 0.132 | 0.921 | ER |
| 918 | PKMYT1 | SEQ ID NO: 510 | 0.143 | 0.205 | 1.433 | ER |
| 919 | NULL | SEQ ID NO: 511 | 1.018 | 0.71 | 0.697 | ER |
| 920 | ADAMTS3 | SEQ ID NO: 512 | 0.16 | 1.651 | 10.294 | ER |
| 921 | LOC124220 | SEQ ID NO: 513 | 0.157 | 0.216 | 1.379 | ER |
| 922 | SPPL2A | SEQ ID NO: 514 | 3.017 | 3.812 | 1.263 | ER |
| 923 | STK11 | SEQ ID NO: 515 | 0.588 | 0.72 | 1.225 | ER |
| 924 | PCYT1A | SEQ ID NO: 516 | 19.836 | 20.516 | 1.034 | ER |
| 925 | EML1 | SEQ ID NO: 517 | 0.182 | 0.126 | 0.691 | ER |
| 926 | CLP2 | SEQ ID NO: 518 | 0.208 | 0.455 | 2.188 | ER |
| 927 | NULL | SEQ ID NO: 519 | 0.275 | 0.422 | 1.531 | ER |
| 928 | C20orf197 | SEQ ID NO: 520 | 0.273 | 0.137 | 0.501 | ER |
| 929 | SERBP1 | SEQ ID NO: 521 | 49.333 | 29.218 | 0.592 | ER |
| 930 | FAM83F | SEQ ID NO: 522 | 0.722 | 1.154 | 1.597 | ER |
| 931 | RAB24 | SEQ ID NO: 523 | 7.819 | 11.322 | 1.448 | ER |
| 932 | MTZA | SEQ ID NO: 524 | 75.838 | 54.369 | 0.717 | ER |
| 933 | RPS6KL1 | SEQ ID NO: 525 | 0.24 | 1.377 | 5.729 | ER |
| 934 | TDRKH | SEQ ID NO: 526 | 0.154 | 0.125 | 0.815 | ER |
| 935 | NULL | SEQ ID NO: 527 | 0.214 | 1.646 | 7.711 | ER |
| 936 | NULL | SEQ ID NO: 528 | 0.136 | 0.131 | 0.959 | ER |
| 937 | NULL | SEQ ID NO: 529 | 0.268 | 0.33 | 1.23 | ER |
| 938 | TRAF3IP2 | SEQ ID NO: 530 | 0.24 | 0.211 | 0.879 | ER |
| 939 | DBI | SEQ ID NO: 531 | 1.584 | 1.7 | 1.073 | ER |
| 940 | SCGB1D2 | SEQ ID NO: 532 | 0.108 | 0.211 | 1.947 | ER |
| 941 | RBM35B | SEQ ID NO: 533 | 0.903 | 2.09 | 2.313 | ER |
| 942 | ESR1 | SEQ ID NO: 534 | 0.694 | 1.426 | 2.055 | ER |
| 943 | NULL | SEQ ID NO: 535 | 0.265 | 0.845 | 3.19 | ER |
| 944 | RUDT18 | SEQ ID NO: 536 | 0.689 | 0.441 | 0.641 | ER |
| 945 | NULL | SEQ ID NO: 537 | 0.303 | 0.353 | 1.17 | ER |
| 946 | CUEDC1 | SEQ ID NO: 538 | 1.011 | 0.167 | 0.165 | ER |
| 947 | NULL | SEQ ID NO: 539 | 0.369 | 0.418 | 1.134 | ER |
| 948 | SAMD12 | SEQ ID NO: 540 | 0.345 | 1.708 | 4.946 | ER |
| 949 | TECTB | SEQ ID NO: 541 | 0.14 | 0.138 | 0.989 | ER |
| 950 | COX7A2L | SEQ ID NO: 542 | 3.328 | 8.575 | 1.63 | ER |
| 951 | ATMN7L1 | SEQ ID NO: 543 | 0.171 | 0.217 | 1.267 | ER |
| 952 | NULL | SEQ ID NO: 544 | 0.674 | 3.789 | 5.595 | ER |
| 953 | ARL1 | SEQ ID NO: 545 | 0.293 | 6.311 | 21.573 | ER |
| 954 | NULL | SEQ ID NO: 546 | 0.164 | 0.148 | 0.9 | ER |
| 955 | PPP1R3B | SEQ ID NO: 547 | 0.725 | 0.568 | 0.784 | ER |
| 956 | GREM1A | SEQ ID NO: 548 | 0.171 | 0.242 | 1.42 | ER |

FIG. 1AF -- TABLE 1 TRANSCRIPTIONAL BIOMARKER FUNCTIONAL DATA
SECTION 2A

| LINE_ID | GENE_SYMBOL | SEQUENCE_ID_LISTING | PROM_ACTIVITY_N O_INDUCTION | PROM_ACTIVITY_WI TH_INDUCTION | INDUCTION RATIO | INDUCTION_CONDITIONS* |
|---|---|---|---|---|---|---|
| 957 | ADAM8 | SEQ ID NO.549 | 0.188 | 0.286 | 1.525 | ER |
| 958 | IL20 | SEQ ID NO.550 | 0.115 | 0.105 | 0.914 | ER |
| 959 | AGT | SEQ ID NO.551 | 0.383 | 0.955 | 2.492 | ER |
| 960 | FOXN1 | SEQ ID NO.552 | 0.227 | 0.22 | 0.967 | ER |
| 961 | MECR | SEQ ID NO.553 | 1.515 | 1.09 | 0.719 | ER |
| 962 | NULL | SEQ ID NO.554 | 7.992 | 5.216 | 0.653 | ER |
| 963 | PLEKHH1 | SEQ ID NO.555 | 0.282 | 2.047 | 7.248 | ER |
| 964 | APOA5 | SEQ ID NO.556 | 0.218 | 0.186 | 0.853 | ER |
| 965 | PDCD6IP | SEQ ID NO.557 | 15.694 | 15.243 | 0.971 | ER |
| 966 | BCL2 | SEQ ID NO.558 | 0.132 | 0.253 | 1.918 | ER |
| 967 | TIPARP | SEQ ID NO.559 | 3.19 | 5.698 | 1.786 | ER |
| 968 | NULL | SEQ ID NO.559 | 0.269 | 3.924 | 14.598 | ER |
| 969 | GREB1 | SEQ ID NO.560 | 0.314 | 3.863 | 12.303 | ER |
| 970 | RP1 | SEQ ID NO.561 | 0.266 | 0.471 | 1.77 | ER |
| 971 | RBL2 | SEQ ID NO.562 | 3.111 | 2.634 | 0.847 | ER |
| 972 | NULL | SEQ ID NO.563 | 0.28 | 0.744 | 2.658 | ER |
| 973 | PDZK1 | SEQ ID NO.564 | 0.427 | 0.686 | 1.609 | ER |
| 974 | LOC283551 | SEQ ID NO.565 | 0.294 | 11.043 | 37.509 | ER |
| 975 | NULL | SEQ ID NO.566 | 0.561 | 1.519 | 2.706 | ER |
| 976 | NULL | SEQ ID NO.567 | 0.39 | 0.55 | 1.409 | ER |
| 977 | UST2B15 | SEQ ID NO.568 | 0.183 | 0.255 | 1.403 | ER |
| 978 | LIPC | SEQ ID NO.568 | 0.157 | 0.179 | 1.137 | ER |
| 979 | NULL | SEQ ID NO.569 | 0.339 | 0.433 | 1.277 | ER |
| 980 | NULL | SEQ ID NO.570 | 0.281 | 0.354 | 1.258 | ER |
| 981 | SCD | SEQ ID NO.571 | 0.235 | 0.242 | 1.031 | ER |
| 982 | NULL | SEQ ID NO.572 | 0.154 | 0.164 | 1.065 | ER |
| 983 | BCMO1 | SEQ ID NO.573 | 3.438 | 1.933 | 0.562 | ER |
| 984 | CRB2 | SEQ ID NO.574 | 0.367 | 0.532 | 1.451 | ER |
| 985 | SLC29A1 | SEQ ID NO.575 | 0.251 | 0.313 | 1.249 | ER |
| 986 | NULL | SEQ ID NO.576 | 0.621 | 4.334 | 6.977 | ER |
| 987 | ETNK2 | SEQ ID NO.577 | 0.186 | 0.254 | 1.365 | ER |
| 988 | TPM3 | SEQ ID NO.578 | 1.623 | 1.952 | 1.203 | ER |
| 989 | HIST1H4K | SEQ ID NO.579 | 0.867 | 0.948 | 1.094 | ER |
| 990 | NULL | SEQ ID NO.580 | 0.728 | 4.399 | 6.043 | ER |
| 991 | CYP1B1 | SEQ ID NO.581 | 0.196 | 0.195 | 0.993 | ER |
| 992 | AQP7 | SEQ ID NO.582 | 0.582 | 1.147 | 1.971 | ER |
| 993 | SMARCA2 | SEQ ID NO.582 | 0.284 | 0.432 | 1.522 | ER |
| 994 | MAL2 | SEQ ID NO.583 | 0.287 | 0.271 | 0.945 | ER |
| 995 | CARD10 | SEQ ID NO.584 | 0.24 | 0.241 | 1.007 | ER |
| 996 | NULL | SEQ ID NO.585 | 0.895 | 0.752 | 0.841 | ER |
| 997 | STS | SEQ ID NO.586 | 0.209 | 0.319 | 1.526 | ER |
| 998 | SULT1A1 | SEQ ID NO.587 | 0.282 | 0.259 | 0.918 | ER |
| 999 | CDKSRAP1 | SEQ ID NO.587 | 104.046 | 111.873 | 1.075 | ER |

*FIG. 1AG* -- TABLE 1 TRANSCRIPTIONAL BIOMARKER FUNCTIONAL DATA
SECTION 2A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS |
|---|---|---|---|---|---|---|
| 1000 | ZBTB40 | SEQ ID NO. 588 | 1.79 | 2.507 | 1.401 | ER |
| 1001 | GLRX2 | SEQ ID NO. 589 | 0.104 | 0.09 | 0.866 | ER |
| 1002 | ABCD4 | SEQ ID NO. 590 | 4.608 | 3.604 | 0.782 | ER |
| 1003 | SLC35A1 | SEQ ID NO. 591 | 0.161 | 0.317 | 1.976 | ER |
| 1004 | XRCC5 | SEQ ID NO. 592 | 0.763 | 2.243 | 2.941 | ER |
| 1005 | NR1I3 | SEQ ID NO. 593 | 0.084 | 0.079 | 0.94 | ER |
| 1006 | NULL | SEQ ID NO. 594 | 0.225 | 0.526 | 2.34 | ER |
| 1007 | NULL | SEQ ID NO. 595 | 0.119 | 0.126 | 1.06 | ER |
| 1008 | NULL | SEQ ID NO. 596 | 0.343 | 0.748 | 2.146 | ER |
| 1009 | NULL | SEQ ID NO. 597 | 0.322 | 2.042 | 6.347 | ER |
| 1010 | SCNN1A | SEQ ID NO. 598 | 0.25 | 0.347 | 1.386 | ER |
| 1011 | NR1H2 | SEQ ID NO. 599 | 8.07 | 6.057 | 0.75 | ER |
| 1012 | NR2E3 | SEQ ID NO. 600 | 0.263 | 0.222 | 0.846 | ER |
| 1013 | NULL | SEQ ID NO. 601 | 0.141 | 0.125 | 0.883 | ER |
| 1014 | C17orf55 | SEQ ID NO. 602 | 0.384 | 0.608 | 1.583 | ER |
| 1015 | TMPRSS3 | SEQ ID NO. 603 | 0.209 | 0.347 | 1.66 | ER |
| 1016 | HMGCR | SEQ ID NO. 604 | 9.834 | 16.086 | 1.636 | ER |
| 1017 | WISP2 | SEQ ID NO. 605 | 0.204 | 0.191 | 0.936 | ER |
| 1018 | DGAT2 | SEQ ID NO. 606 | 0.158 | 0.19 | 1.197 | ER |
| 1019 | NULL | SEQ ID NO. 607 | 0.209 | 0.292 | 1.397 | ER |
| 1020 | ACP6 | SEQ ID NO. 608 | 0.311 | 3.904 | 12.569 | ER |
| 1021 | NULL | SEQ ID NO. 609 | 0.205 | 0.28 | 1.37 | ER |
| 1022 | PROP1 | SEQ ID NO. 610 | 0.267 | 0.752 | 2.818 | ER |
| 1023 | NULL | SEQ ID NO. 611 | 0.254 | 0.466 | 1.843 | ER |
| 1024 | NULL | SEQ ID NO. 612 | 0.087 | 0.139 | 1.592 | ER |
| 1025 | GREB1 | SEQ ID NO. 613 | 0.193 | 0.372 | 1.927 | ER |
| 1026 | EGF1 | SEQ ID NO. 614 | 0.169 | 0.132 | 0.779 | ER |
| 1027 | NULL | SEQ ID NO. 615 | 0.276 | 0.365 | 1.322 | ER |
| 1028 | SMAD3 | SEQ ID NO. 616 | 0.756 | 0.574 | 0.759 | ER |
| 1029 | DPP9 | SEQ ID NO. 617 | 0.215 | 0.316 | 1.471 | ER |
| 1030 | NULL | SEQ ID NO. 618 | 0.189 | 0.564 | 2.988 | ER |
| 1031 | CCR6 | SEQ ID NO. 619 | 0.152 | 0.204 | 1.347 | ER |
| 1032 | HK1 | SEQ ID NO. 620 | 0.38 | 0.707 | 1.86 | ER |
| 1033 | MAMSTR1 | SEQ ID NO. 621 | 0.713 | 2.794 | 3.918 | ER |
| 1034 | NULL | SEQ ID NO. 622 | 0.15 | 0.104 | 0.694 | ER |
| 1035 | NULL | SEQ ID NO. 623 | 4.881 | 5.716 | 1.171 | ER |
| 1036 | GREB1 | SEQ ID NO. 624 | 0.328 | 0.31 | 0.951 | ER |
| 1037 | SULT2B1 | SEQ ID NO. 625 | 0.456 | 0.398 | 0.872 | ER |
| 1038 | S100A10 | SEQ ID NO. 626 | 0.579 | 4.323 | 7.473 | ER |
| 1039 | DAAM1 | SEQ ID NO. 627 | 0.163 | 0.227 | 1.391 | ER |
| 1040 | BRF2 | SEQ ID NO. 628 | 57.625 | 52.915 | 0.915 | ER |
| 1041 | LSS | SEQ ID NO. 629 | 0.203 | 0.422 | 2.078 | ER |
| 1042 | PVALB | SEQ ID NO. 630 | 0.166 | 0.2 | 1.205 | ER |
| 1043 | VEPH1 | SEQ ID NO. 631 | 0.097 | 0.153 | 1.585 | ER |
| 1044 | TCEA2 | SEQ ID NO. 632 | 0.212 | 0.297 | 1.401 | ER |
| 1045 | PTGES | SEQ ID NO. 633 | 0.189 | 0.352 | 1.864 | ER |
| 1046 | NKAIN1 | SEQ ID NO. 634 | 0.39 | 0.556 | 1.422 | ER |
| 1047 | SEMA1A | SEQ ID NO. 635 | 0.956 | 2.256 | 2.362 | ER |

FIG. 1AH -- TABLE 1 TRANSCRIPTIONAL BIOMARKER FUNCTIONAL DATA
SECTION 2A

| LINE_ID | GENE_SYMBOL | SEQUENCE_ID_LISTING | PROM_ACTIVITY_N O_INDUCTION | PROM_ACTIVITY_WI TH_INDUCTION | PROM_ACTIVITY_WI INDUCTION _RATIO | INDUCTION_CONDITIONS |
|---|---|---|---|---|---|---|
| 1048 | NULL | SEQ ID NO. 635 | 0.487 | 2.199 | 4.515 | ER |
| 1049 | RAB5B | SEQ ID NO. 636 | 0.175 | 0.451 | 2.586 | ER |
| 1050 | NULL | SEQ ID NO. 637 | 4.431 | 5.161 | 1.165 | ER |
| 1051 | FHL1 | SEQ ID NO. 638 | 0.262 | 1.044 | 3.991 | ER |
| 1052 | MEM | SEQ ID NO. 639 | 1.072 | 1.415 | 1.32 | ER |
| 1053 | RELN | SEQ ID NO. 640 | 0.125 | 0.12 | 0.959 | ER |
| 1054 | SLP45 | SEQ ID NO. 641 | 1.199 | 2.674 | 2.23 | ER |
| 1055 | HIST1H4J | SEQ ID NO. 642 | 0.729 | 0.996 | 1.366 | ER |
| 1056 | NULL | SEQ ID NO. 643 | 0.191 | 0.221 | 1.156 | ER |
| 1057 | CPA6 | SEQ ID NO. 644 | 0.697 | 0.518 | 0.743 | ER |
| 1058 | DNAJB5 | SEQ ID NO. 645 | 0.115 | 0.081 | 0.702 | ER |
| 1059 | GDF15 | SEQ ID NO. 646 | 0.089 | 0.079 | 0.895 | ER |
| 1060 | SLC12A7 | SEQ ID NO. 647 | 0.206 | 0.145 | 0.705 | ER |
| 1061 | EPN3 | SEQ ID NO. 648 | 0.447 | 0.468 | 1.048 | ER |
| 1062 | NULL | SEQ ID NO. 649 | 0.102 | 0.084 | 0.83 | ER |
| 1063 | HLA-C | SEQ ID NO. 650 | 0.203 | 0.465 | 2.306 | ER |
| 1064 | ECH1 | SEQ ID NO. 650 | 9.752 | 6.208 | 0.637 | ER |
| 1065 | ATAD4 | SEQ ID NO. 651 | 1.063 | 0.898 | 0.845 | ER |
| 1066 | IFT122 | SEQ ID NO. 652 | 0.223 | 0.248 | 1.116 | ER |
| 1067 | FAM134B | SEQ ID NO. 653 | 0.254 | 17.159 | 67.428 | ER |
| 1068 | CYP2C18 | SEQ ID NO. 654 | 0.124 | 0.105 | 0.847 | ER |
| 1069 | NULL | SEQ ID NO. 655 | 0.339 | 1.461 | 4.305 | ER |
| 1070 | NULL | SEQ ID NO. 656 | 0.29 | 6.695 | 23.035 | ER |
| 1071 | PPP1R15B | SEQ ID NO. 657 | 0.109 | 0.353 | 3.247 | ER |
| 1072 | TBC1D16 | SEQ ID NO. 658 | 0.153 | 0.244 | 1.591 | ER |
| 1073 | NULL | SEQ ID NO. 659 | 0.17 | 0.221 | 1.3 | ER |
| 1074 | NULL | SEQ ID NO. 660 | 0.131 | 0.167 | 1.275 | ER |
| 1075 | TSNAXIP1 | SEQ ID NO. 661 | 0.326 | 0.299 | 0.917 | ER |
| 1076 | LOC652966 | SEQ ID NO. 662 | 0.463 | 3.767 | 8.178 | ER |
| 1077 | AR2F2 | SEQ ID NO. 663 | 0.17 | 0.164 | 0.968 | ER |
| 1078 | EVL | SEQ ID NO. 664 | 0.128 | 0.143 | 1.117 | ER |
| 1079 | SLC4A2 | SEQ ID NO. 665 | 0.897 | 1.635 | 1.844 | ER |
| 1080 | TRIM25 | SEQ ID NO. 666 | 0.111 | 0.314 | 2.825 | ER |
| 1081 | PPM13 | SEQ ID NO. 667 | 0.474 | 0.645 | 1.36 | ER |
| 1082 | VCPIP1 | SEQ ID NO. 668 | 0.315 | 1.103 | 3.502 | ER |
| 1083 | SAT1 | SEQ ID NO. 668 | 0.486 | 0.861 | 1.774 | ER |
| 1084 | BCL2 | SEQ ID NO. 668 | 0.116 | 0.110 | 0.872 | ER |
| 1085 | EBAG9 | SEQ ID NO. 669 | 1.24 | 1.841 | 1.77 | ER |
| 1086 | CYB561D2 | SEQ ID NO. 670 | 1.557 | 1.803 | 1.158 | ER |
| 1087 | OXT | SEQ ID NO. 671 | 0.275 | 1.66 | 6.034 | ER |
| 1088 | HNRNPH2 | SEQ ID NO. 672 | 36.713 | 60.526 | 1.649 | ER |
| 1089 | NULL | SEQ ID NO. 673 | 0.211 | 0.582 | 2.752 | ER |
| 1090 | PSPH | SEQ ID NO. 674 | 0.537 | 0.754 | 1.405 | ER |
| 1091 | AKAP9 | SEQ ID NO. 674 | 10.727 | 11.503 | 1.072 | ER |
| 1092 | FAM3C | SEQ ID NO. 675 | 5.48 | 5.536 | 1.01 | ER |
| 1093 | ECOP | SEQ ID NO. 676 | 0.516 | 2.406 | 4.663 | ER |

FIG. 1AI -- TABLE 1 TRANSCRIPTIONAL BIOMARKER FUNCTIONAL DATA
SECTION 2A

| LINE_ID | GENE_SYMBOL | SEQUENCE_ID_LISTING | PROM_ACTIVITY_N O_INDUCTION | PROM_ACTIVITY_N TH_INDUCTION | PROM_ACTIVITY_WI TH_INDUCTION | INDUCTION_RATIO | INDUCTION_CONDITIONS* |
|---|---|---|---|---|---|---|---|
| 1094 | NULL | SEQ ID NO. 677 | 2.146 | | 2.648 | 1.234 | ER |
| 1095 | PLOD3 | SEQ ID NO. 677 | 149.686 | | 70.232 | 0.469 | ER |
| 1096 | NULL | SEQ ID NO. 677 | 107.518 | | 110.548 | 1.028 | ER |
| 1097 | NULL | SEQ ID NO. 677 | 50.51 | | 26.013 | 0.515 | ER |
| 1098 | HERPUD2 | SEQ ID NO. 677 | 11.393 | | 8.041 | 0.706 | ER |
| 1099 | NULL | SEQ ID NO. 678 | 0.995 | | 1.705 | 1.713 | ER |
| 1100 | NCAPG2 | SEQ ID NO. 678 | 81.865 | | 55.316 | 0.676 | ER |
| 1101 | NUB1 | SEQ ID NO. 678 | 134.582 | | 84.692 | 0.63 | ER |
| 1102 | NULL | SEQ ID NO. 679 | 8.182 | | 11.751 | 1.436 | ER |
| 1103 | SLC4A2 | SEQ ID NO. 680 | 6.408 | | 5.878 | 0.917 | ER |
| 1104 | NULL | SEQ ID NO. 681 | 3.708 | | 4.005 | 1.08 | ER |
| 1105 | REPIN1 | SEQ ID NO. 682 | 6.358 | | 12 | 1.888 | ER |
| 1106 | CAT | SEQ ID NO. 683 | 2.808 | | 3.588 | 1.278 | ER |
| 1107 | APOA2 | SEQ ID NO. 684 | 0.155 | | 0.271 | 1.744 | ER |

FIG. 1AJ -- TABLE 1 TRANSCRIPTIONAL BIOMARKER FUNCTIONAL DATA
SECTION 8A

| LINE_ID | GENE_SYMBOL | SEQUENCE_ID_LISTING | PROM_ACTIVITY_NO_INDUCTION | PROM_ACTIVITY_WITH_INDUCTION | INDUCTION_RATIO | INDUCTION_CONDITIONS |
|---|---|---|---|---|---|---|
| 1108 | RAB6GTB | SEQ ID NO. 685 | 0.34 | 0.28 | 0.822 | GR_CORT |
| 1109 | RAB6GTB | SEQ ID NO. 685 | 0.34 | 0.151 | 0.445 | GR_DEX |
| 1110 | RAB6GTB | SEQ ID NO. 685 | 0.34 | 0.249 | 0.731 | GR_PRED |
| 1111 | CHIC2 | SEQ ID NO. 686 | 6.757 | 7.902 | 1.169 | GR_CORT |
| 1112 | CHIC2 | SEQ ID NO. 686 | 6.757 | 6.961 | 1.03 | GR_DEX |
| 1113 | CHIC2 | SEQ ID NO. 686 | 6.757 | 7.174 | 1.062 | GR_PRED |
| 1114 | MKNK2 | SEQ ID NO. 687 | 0.094 | 0.111 | 1.174 | GR_CORT |
| 1115 | MKNK2 | SEQ ID NO. 687 | 0.094 | 0.126 | 1.329 | GR_DEX |
| 1116 | MKNK2 | SEQ ID NO. 687 | 0.094 | 0.103 | 1.09 | GR_PRED |
| 1117 | RAB11A | SEQ ID NO. 688 | 11.747 | 13.805 | 1.175 | GR_CORT |
| 1118 | RAB11A | SEQ ID NO. 688 | 11.747 | 8.634 | 0.735 | GR_DEX |
| 1119 | RAB11A | SEQ ID NO. 688 | 11.747 | 9.447 | 0.804 | GR_PRED |
| 1120 | TXN | SEQ ID NO. 689 | 70.818 | 61.633 | 0.87 | GR_CORT |
| 1121 | TXN | SEQ ID NO. 689 | 70.818 | 41.811 | 0.59 | GR_DEX |
| 1122 | TXN | SEQ ID NO. 689 | 70.818 | 53.536 | 0.756 | GR_PRED |
| 1123 | RNF11 | SEQ ID NO. 690 | 1.038 | 1.141 | 1.099 | GR_CORT |
| 1124 | RNF11 | SEQ ID NO. 690 | 1.038 | 0.921 | 0.887 | GR_DEX |
| 1125 | RNF11 | SEQ ID NO. 690 | 1.038 | 0.86 | 0.828 | GR_PRED |
| 1126 | TPST2 | SEQ ID NO. 691 | 3.562 | 4.307 | 1.202 | GR_CORT |
| 1127 | TPST2 | SEQ ID NO. 691 | 3.562 | 3.465 | 0.973 | GR_DEX |
| 1128 | TPST2 | SEQ ID NO. 691 | 3.562 | 3.281 | 0.922 | GR_PRED |
| 1129 | IDH1 | SEQ ID NO. 692 | 10.542 | 12.686 | 1.203 | GR_CORT |
| 1130 | IDH1 | SEQ ID NO. 692 | 10.542 | 9.389 | 0.891 | GR_DEX |
| 1131 | IDH1 | SEQ ID NO. 692 | 10.542 | 10.127 | 0.961 | GR_PRED |
| 1132 | BRD2 | SEQ ID NO. 693 | 2.219 | 1.91 | 0.861 | GR_CORT |
| 1133 | BRD2 | SEQ ID NO. 693 | 2.219 | 1.243 | 0.56 | GR_DEX |
| 1134 | BRD2 | SEQ ID NO. 693 | 2.219 | 1.61 | 0.726 | GR_PRED |
| 1135 | IER2 | SEQ ID NO. 694 | 13.834 | 15.584 | 1.126 | GR_CORT |
| 1136 | IER2 | SEQ ID NO. 694 | 13.834 | 10.513 | 0.76 | GR_DEX |
| 1137 | IER2 | SEQ ID NO. 694 | 13.834 | 12.631 | 0.913 | GR_PRED |
| 1138 | HSP90AB1 | SEQ ID NO. 695 | 0.132 | 0.148 | 1.119 | GR_CORT |
| 1139 | HSP90AB1 | SEQ ID NO. 695 | 0.132 | 0.302 | 2.288 | GR_DEX |
| 1140 | HSP90AB1 | SEQ ID NO. 695 | 0.132 | 0.148 | 1.119 | GR_PRED |
| 1141 | COMT | SEQ ID NO. 696 | 5.302 | 6.209 | 1.171 | GR_CORT |
| 1142 | COMT | SEQ ID NO. 696 | 5.302 | 4.192 | 0.791 | GR_DEX |
| 1143 | COMT | SEQ ID NO. 696 | 5.302 | 4.199 | 0.792 | GR_PRED |
| 1144 | RNF10 | SEQ ID NO. 697 | 33.433 | 42.921 | 1.284 | GR_CORT |
| 1145 | RNF10 | SEQ ID NO. 697 | 33.433 | 33.818 | 1.010 | GR_DEX |
| 1146 | RNF10 | SEQ ID NO. 697 | 33.433 | 27.014 | 0.808 | GR_PRED |
| 1147 | VMT5A | SEQ ID NO. 698 | 0.212 | 0.252 | 1.189 | GR_CORT |
| 1148 | VMT5A | SEQ ID NO. 698 | 0.212 | 0.219 | 1.034 | GR_DEX |
| 1149 | VMT5A | SEQ ID NO. 698 | 0.212 | 0.169 | 0.799 | GR_PRED |
| 1150 | BRD2 | SEQ ID NO. 699 | 11.892 | 14.055 | 1.182 | GR_CORT |
| 1151 | BRD2 | SEQ ID NO. 699 | 11.892 | 10.308 | 0.867 | GR_DEX |
| 1152 | BRD2 | SEQ ID NO. 699 | 11.892 | 12.362 | 1.04 | GR_PRED |
| 1153 | SERPINA1 | SEQ ID NO. 700 | 2.899 | 2.49 | 0.859 | GR_CORT |
| 1154 | SERPINA1 | SEQ ID NO. 700 | 2.899 | 1.427 | 0.492 | GR_DEX |
| 1155 | SERPINA1 | SEQ ID NO. 700 | 2.899 | 2.386 | 0.823 | GR_PRED |

*FIG. 1AK* – TABLE 1 TRANSCRIPTIONAL BIOMARKER FUNCTIONAL DATA
SECTION 8A

| LINE_ID | GENE_SYMBOL | SEQUENCE_ID_LISTING | PROM_ACTIVITY_O_INDUCTION | PROM_ACTIVITY_N_TH_INDUCTION | PROM_ACTIVITY_WI_INDUCTION_RATIO | INDUCTION_CONDITION |
|---|---|---|---|---|---|---|
| 1156 | HERPUD1 | SEQ ID NO. 701 | | 2.481 | 3.412 | 1.375 | GR_CORT |
| 1157 | HERPUD1 | SEQ ID NO. 701 | | 2.481 | 2.362 | 0.952 | GR_DEX |
| 1158 | HERPUD1 | SEQ ID NO. 701 | | 2.481 | 3.102 | 1.25 | GR_PRED |
| 1159 | MKNK2 | SEQ ID NO. 702 | | 13.701 | 12.376 | 0.903 | GR_CORT |
| 1160 | MKNK2 | SEQ ID NO. 702 | | 13.701 | 11.612 | 0.846 | GR_DEX |
| 1161 | MKNK2 | SEQ ID NO. 702 | | 13.701 | 12.157 | 0.887 | GR_PRED |
| 1162 | ADH1C | SEQ ID NO. 703 | | 0.24 | 0.222 | 0.928 | GR_CORT |
| 1163 | ADH1C | SEQ ID NO. 703 | | 0.24 | 0.139 | 0.579 | GR_DEX |
| 1164 | ADH1C | SEQ ID NO. 703 | | 0.24 | 0.188 | 0.783 | GR_PRED |
| 1165 | CKS1B | SEQ ID NO. 704 | | 4.002 | 4.638 | 1.159 | GR_CORT |
| 1166 | CKS1B | SEQ ID NO. 704 | | 4.002 | 3.669 | 0.917 | GR_DEX |
| 1167 | CKS1B | SEQ ID NO. 704 | | 4.002 | 2.454 | 0.613 | GR_PRED |
| 1168 | SERPINA1 | SEQ ID NO. 705 | | 0.242 | 0.245 | 1.012 | GR_CORT |
| 1169 | SERPINA1 | SEQ ID NO. 705 | | 0.242 | 0.194 | 0.802 | GR_DEX |
| 1170 | SERPINA1 | SEQ ID NO. 705 | | 0.242 | 0.216 | 0.893 | GR_PRED |
| 1171 | TPST2 | SEQ ID NO. 706 | | 0.594 | 0.626 | 1.054 | GR_CORT |
| 1172 | TPST2 | SEQ ID NO. 706 | | 0.594 | 0.428 | 0.721 | GR_DEX |
| 1173 | TPST2 | SEQ ID NO. 706 | | 0.594 | 0.57 | 0.959 | GR_PRED |
| 1174 | WNT5A | SEQ ID NO. 707 | | 0.537 | 0.656 | 1.22 | GR_CORT |
| 1175 | WNT5A | SEQ ID NO. 707 | | 0.537 | 0.445 | 0.829 | GR_DEX |
| 1176 | WNT5A | SEQ ID NO. 707 | | 0.537 | 0.505 | 0.941 | GR_PRED |
| 1177 | GNMT | SEQ ID NO. 708 | | 0.189 | 0.188 | 0.996 | GR_CORT |
| 1178 | GNMT | SEQ ID NO. 708 | | 0.189 | 0.221 | 1.167 | GR_DEX |
| 1179 | GNMT | SEQ ID NO. 708 | | 0.189 | 0.199 | 1.054 | GR_PRED |
| 1180 | IER3 | SEQ ID NO. 709 | | 2.129 | 2.082 | 0.978 | GR_CORT |
| 1181 | IER3 | SEQ ID NO. 709 | | 2.129 | 1.539 | 0.723 | GR_DEX |
| 1182 | IER3 | SEQ ID NO. 709 | | 2.129 | 1.998 | 0.938 | GR_PRED |
| 1183 | NULL | SEQ ID NO. 710 | | 0.444 | 0.473 | 1.067 | GR_CORT |
| 1184 | NULL | SEQ ID NO. 710 | | 0.444 | 0.394 | 0.889 | GR_DEX |
| 1185 | NULL | SEQ ID NO. 710 | | 0.444 | 0.351 | 0.791 | GR_PRED |
| 1186 | MTCH2 | SEQ ID NO. 711 | | 12.251 | 12.625 | 1.03 | GR_CORT |
| 1187 | MTCH2 | SEQ ID NO. 711 | | 12.251 | 8.857 | 0.723 | GR_DEX |
| 1188 | MTCH2 | SEQ ID NO. 711 | | 12.251 | 8.297 | 0.677 | GR_PRED |
| 1189 | SCD | SEQ ID NO. 712 | | 1.12 | 0.901 | 0.804 | GR_CORT |
| 1190 | SCD | SEQ ID NO. 712 | | 1.12 | 0.518 | 0.462 | GR_DEX |
| 1191 | SCD | SEQ ID NO. 712 | | 1.12 | 0.804 | 0.718 | GR_PRED |
| 1192 | HSP90AB1 | SEQ ID NO. 712 | | 0.042 | 0.047 | 1.12 | GR_CORT |
| 1193 | HSP90AB1 | SEQ ID NO. 712 | | 0.042 | 0.03 | 0.721 | GR_DEX |
| 1194 | HSP90AB1 | SEQ ID NO. 712 | | 0.042 | 0.037 | 0.889 | GR_PRED |
| 1195 | AS3MT | SEQ ID NO. 713 | | 0.577 | 0.584 | 1.012 | GR_CORT |
| 1196 | AS3MT | SEQ ID NO. 713 | | 0.577 | 0.409 | 0.708 | GR_DEX |
| 1197 | AS3MT | SEQ ID NO. 713 | | 0.577 | 0.537 | 0.931 | GR_PRED |
| 1198 | WNT5A | SEQ ID NO. 714 | | 1.604 | 1.349 | 0.841 | GR_CORT |
| 1199 | WNT5A | SEQ ID NO. 714 | | 1.604 | 1.028 | 0.641 | GR_DEX |
| 1200 | WNT5A | SEQ ID NO. 714 | | 1.604 | 1.109 | 0.691 | GR_PRED |
| 1201 | CPS1 | SEQ ID NO. 715 | | 0.074 | 0.081 | 1.103 | GR_CORT |
| 1202 | CPS1 | SEQ ID NO. 715 | | 0.074 | 0.066 | 0.902 | GR_DEX |
| 1203 | CPS1 | SEQ ID NO. 715 | | 0.074 | 0.08 | 1.086 | GR_PRED |

FIG. 1AL -- TABLE 1 TRANSCRIPTIONAL BIOMARKER FUNCTIONAL DATA
SECTION 8A

| LINE_ID | GENE_SYMBOL | SEQUENCE_ID_LISTING | PROM_ACTIVITY_M O_INDUCTION | PROM_ACTIVITY_WI TH_INDUCTION | INDUCTION_RATIO | INDUCTION_CONDITIONS |
|---|---|---|---|---|---|---|
| 1204 | MYO18A | SEQ ID NO. 716 | 9.392 | 9.32 | 0.992 | GR_CORT |
| 1205 | MYO18A | SEQ ID NO. 716 | 9.392 | 10.515 | 1.12 | GR_DEX |
| 1206 | MYO18A | SEQ ID NO. 716 | 9.392 | 10.712 | 1.141 | GR_PRED |
| 1207 | NULL | SEQ ID NO. 717 | 0.485 | 0.469 | 0.966 | GR_CORT |
| 1208 | NULL | SEQ ID NO. 717 | 0.485 | 0.415 | 0.855 | GR_DEX |
| 1209 | NULL | SEQ ID NO. 717 | 0.485 | 0.584 | 1.203 | GR_PRED |
| 1210 | RGL1 | SEQ ID NO. 718 | 4.551 | 3.846 | 0.845 | GR_CORT |
| 1211 | RGL1 | SEQ ID NO. 718 | 4.551 | 2.675 | 0.588 | GR_DEX |
| 1212 | RGL1 | SEQ ID NO. 718 | 4.551 | 4.021 | 0.884 | GR_PRED |
| 1213 | NULL | SEQ ID NO. 719 | 0.038 | 0.05 | 1.3 | GR_CORT |
| 1214 | NULL | SEQ ID NO. 719 | 0.038 | 0.046 | 1.211 | GR_DEX |
| 1215 | NULL | SEQ ID NO. 719 | 0.038 | 0.053 | 1.397 | GR_PRED |
| 1216 | NULL | SEQ ID NO. 720 | 0.185 | 0.244 | 1.323 | GR_CORT |
| 1217 | NULL | SEQ ID NO. 720 | 0.185 | 0.224 | 1.215 | GR_DEX |
| 1218 | NULL | SEQ ID NO. 720 | 0.185 | 0.269 | 1.459 | GR_PRED |
| 1219 | NULL | SEQ ID NO. 721 | 0.333 | 0.333 | 0.993 | GR_CORT |
| 1220 | NULL | SEQ ID NO. 721 | 0.333 | 0.264 | 0.792 | GR_DEX |
| 1221 | NULL | SEQ ID NO. 721 | 0.333 | 0.318 | 0.953 | GR_PRED |
| 1222 | NULL | SEQ ID NO. 722 | 0.056 | 0.07 | 1.256 | GR_CORT |
| 1223 | NULL | SEQ ID NO. 722 | 0.056 | 0.093 | 1.665 | GR_PRED |
| 1224 | NULL | SEQ ID NO. 722 | 0.056 | 0.069 | 1.23 | GR_PRED |
| 1225 | SMYD4 | SEQ ID NO. 723 | 0.093 | 0.1 | 1.068 | GR_CORT |
| 1226 | SMYD4 | SEQ ID NO. 723 | 0.093 | 0.154 | 1.653 | GR_DEX |
| 1227 | SMYD4 | SEQ ID NO. 723 | 0.093 | 0.116 | 1.238 | GR_PRED |
| 1228 | ATP2B3 | SEQ ID NO. 724 | 0.07 | 0.071 | 1.015 | GR_CORT |
| 1229 | ATP2B3 | SEQ ID NO. 724 | 0.07 | 0.153 | 2.186 | GR_DEX |
| 1230 | ATP2B3 | SEQ ID NO. 724 | 0.07 | 0.082 | 1.148 | GR_PRED |
| 1231 | RGL4 | SEQ ID NO. 725 | 0.209 | 0.287 | 1.373 | GR_CORT |
| 1232 | RGL4 | SEQ ID NO. 725 | 0.209 | 0.29 | 1.387 | GR_DEX |
| 1233 | RGL4 | SEQ ID NO. 725 | 0.209 | 0.25 | 1.199 | GR_PRED |
| 1234 | NULL | SEQ ID NO. 726 | 0.082 | 0.092 | 1.123 | GR_CORT |
| 1235 | NULL | SEQ ID NO. 726 | 0.082 | 0.069 | 0.843 | GR_DEX |
| 1236 | NULL | SEQ ID NO. 726 | 0.082 | 0.062 | 0.76 | GR_PRED |
| 1237 | OBSCN | SEQ ID NO. 727 | 1.47 | 1.491 | 1.015 | GR_CORT |
| 1238 | OBSCN | SEQ ID NO. 727 | 1.47 | 1.261 | 0.858 | GR_DEX |
| 1239 | OBSCN | SEQ ID NO. 727 | 1.47 | 1.62 | 1.102 | GR_PRED |
| 1240 | IFNE1 | SEQ ID NO. 728 | 0.131 | 0.154 | 1.176 | GR_CORT |
| 1241 | IFNE1 | SEQ ID NO. 728 | 0.131 | 0.175 | 1.341 | GR_DEX |
| 1242 | IFNE1 | SEQ ID NO. 728 | 0.131 | 0.175 | 1.343 | GR_PRED |
| 1243 | FLJ45803 | SEQ ID NO. 729 | 0.062 | 0.091 | 1.47 | GR_CORT |
| 1244 | FLJ45803 | SEQ ID NO. 729 | 0.062 | 0.427 | 5.89 | GR_DEX |
| 1245 | FLJ45803 | SEQ ID NO. 729 | 0.062 | 0.19 | 3.073 | GR_PRED |
| 1246 | NULL | SEQ ID NO. 730 | 0.11 | 0.111 | 1.007 | GR_CORT |
| 1247 | NULL | SEQ ID NO. 730 | 0.11 | 0.104 | 0.948 | GR_DEX |
| 1248 | NULL | SEQ ID NO. 730 | 0.11 | 0.136 | 1.235 | GR_PRED |
| 1249 | LAMA3 | SEQ ID NO. 731 | 0.044 | 0.043 | 0.965 | GR_CORT |
| 1250 | LAMA3 | SEQ ID NO. 731 | 0.044 | 0.053 | 1.201 | GR_DEX |
| 1251 | LAMA3 | SEQ ID NO. 731 | 0.044 | 0.053 | 1.204 | GR_PRED |

FIG. 1AM -- TABLE 1 TRANSCRIPTIONAL BIOMARKER FUNCTIONAL DATA
SECTION 8A

| LINE_ID | GENE_SYMBOL | SEQUENCE_ID_LISTING | PROM_ACTIVITY_IN_O_INDUCTION | PROM_ACTIVITY_WITH_INDUCTION | INDUCTION_RATIO | INDUCTION_CONDITIONS |
|---|---|---|---|---|---|---|
| 1252 | LCN6 | SEQ ID NO. 732 | 0.382 | 0.415 | 1.086 | GR_CORT |
| 1253 | LCN6 | SEQ ID NO. 732 | 0.382 | 0.45 | 1.179 | GR_DEX |
| 1254 | LCN6 | SEQ ID NO. 732 | 0.382 | 0.481 | 1.259 | GR_PRED |
| 1255 | HDAC7 | SEQ ID NO. 733 | 0.099 | 0.101 | 1.022 | GR_CORT |
| 1256 | HDAC7 | SEQ ID NO. 733 | 0.099 | 0.099 | 1.006 | GR_DEX |
| 1257 | HDAC7 | SEQ ID NO. 733 | 0.099 | 0.095 | 0.965 | GR_PRED |
| 1258 | ITSN1 | SEQ ID NO. 734 | 0.055 | 0.06 | 1.097 | GR_CORT |
| 1259 | ITSN1 | SEQ ID NO. 734 | 0.055 | 0.081 | 1.491 | GR_DEX |
| 1260 | ITSN1 | SEQ ID NO. 734 | 0.055 | 0.06 | 1.106 | GR_PRED |
| 1261 | PMGD | SEQ ID NO. 735 | 0.331 | 0.73 | 0.878 | GR_CORT |
| 1262 | PMGD | SEQ ID NO. 735 | 0.831 | 0.508 | 0.610 | GR_DEX |
| 1263 | PMGD | SEQ ID NO. 735 | 0.831 | 0.721 | 0.866 | GR_PRED |
| 1264 | DIXDC1 | SEQ ID NO. 736 | 0.08 | 0.124 | 1.54 | GR_CORT |
| 1265 | DIXDC1 | SEQ ID NO. 736 | 0.08 | 0.409 | 5.087 | GR_DEX |
| 1266 | DIXDC1 | SEQ ID NO. 736 | 0.08 | 0.17 | 2.111 | GR_PRED |
| 1267 | NBL1 | SEQ ID NO. 737 | 0.641 | 0.634 | 0.989 | GR_CORT |
| 1268 | NBL1 | SEQ ID NO. 737 | 0.641 | 0.702 | 1.095 | GR_DEX |
| 1269 | NBL1 | SEQ ID NO. 737 | 0.641 | 0.803 | 1.252 | GR_PRED |
| 1270 | NBL1 | SEQ ID NO. 738 | 0.602 | 0.659 | 1.093 | GR_CORT |
| 1271 | NBL1 | SEQ ID NO. 738 | 0.602 | 0.486 | 0.866 | GR_DEX |
| 1272 | NBL1 | SEQ ID NO. 738 | 0.602 | 0.623 | 1.034 | GR_PRED |
| 1273 | CYBASC3 | SEQ ID NO. 739 | 0.199 | 0.218 | 1.094 | GR_CORT |
| 1274 | CYBASC3 | SEQ ID NO. 739 | 0.199 | 0.174 | 0.873 | GR_DEX |
| 1275 | CYBASC3 | SEQ ID NO. 739 | 0.199 | 0.193 | 0.968 | GR_PRED |
| 1276 | NCOA1 | SEQ ID NO. 740 | 0.366 | 0.396 | 1.08 | GR_CORT |
| 1277 | NCOA1 | SEQ ID NO. 740 | 0.366 | 0.314 | 0.858 | GR_DEX |
| 1278 | NCOA1 | SEQ ID NO. 740 | 0.366 | 0.318 | 0.863 | GR_PRED |
| 1279 | ERCC | SEQ ID NO. 741 | 0.204 | 0.193 | 0.945 | GR_CORT |
| 1280 | ERCC | SEQ ID NO. 741 | 0.204 | 0.164 | 0.802 | GR_DEX |
| 1281 | ERCC | SEQ ID NO. 741 | 0.204 | 0.201 | 0.985 | GR_PRED |
| 1282 | PMM2 | SEQ ID NO. 742 | 0.304 | 0.246 | 0.994 | GR_CORT |
| 1283 | PMM2 | SEQ ID NO. 742 | 9.304 | 6.239 | 0.671 | GR_DEX |
| 1284 | PMM2 | SEQ ID NO. 742 | 9.304 | 8.994 | 0.967 | GR_PRED |
| 1285 | FAM55A | SEQ ID NO. 743 | 0.05 | 0.059 | 1.16 | GR_CORT |
| 1286 | FAM55A | SEQ ID NO. 743 | 0.05 | 0.047 | 0.936 | GR_DEX |
| 1287 | FAM55A | SEQ ID NO. 743 | 0.05 | 0.064 | 1.275 | GR_PRED |
| 1288 | EMC1 | SEQ ID NO. 744 | 0.121 | 0.165 | 1.36 | GR_CORT |
| 1289 | EMC1 | SEQ ID NO. 744 | 0.121 | 0.125 | 1.036 | GR_DEX |
| 1290 | EMC1 | SEQ ID NO. 744 | 0.121 | 0.105 | 0.869 | GR_PRED |
| 1291 | NBL1 | SEQ ID NO. 745 | 0.107 | 0.118 | 1.101 | GR_CORT |
| 1292 | NBL1 | SEQ ID NO. 745 | 0.107 | 0.352 | 3.104 | GR_DEX |
| 1293 | NBL1 | SEQ ID NO. 745 | 0.107 | 0.095 | 0.885 | GR_PRED |
| 1294 | NBL1 | SEQ ID NO. 746 | 0.314 | 0.392 | 1.248 | GR_CORT |
| 1295 | NBL1 | SEQ ID NO. 746 | 0.314 | 0.526 | 1.676 | GR_DEX |
| 1296 | NBL1 | SEQ ID NO. 746 | 0.314 | 0.443 | 1.411 | GR_PRED |
| 1297 | NBL1 | SEQ ID NO. 747 | 0.222 | 0.242 | 1.091 | GR_CORT |
| 1298 | NBL1 | SEQ ID NO. 747 | 0.222 | 0.175 | 0.791 | GR_DEX |
| 1299 | NBL1 | SEQ ID NO. 747 | 0.222 | 0.171 | 0.771 | GR_PRED |

FIG. 1AN -- TABLE 1 TRANSCRIPTIONAL BIOMARKER FUNCTIONAL DATA
SECTION 3A

| LINE_ID | GENE_SYMBOL | SEQUENCE_ID_LISTING | PROM_ACTIVITY_N O_INDUCTION | PROM_ACTIVITY_W ITH_INDUCTION | INDUCTION_RATIO | INDUCTION_CONDITIONS |
|---|---|---|---|---|---|---|
| 1300 | HPS4 | SEQ ID NO. 748 | 0.16 | 0.179 | 1.119 | GR_CORT |
| 1301 | HPS4 | SEQ ID NO. 748 | 0.16 | 0.138 | 0.862 | GR_DEX |
| 1302 | HPS4 | SEQ ID NO. 748 | 0.16 | 0.114 | 0.711 | GR_PRED |
| 1303 | NULL | SEQ ID NO. 749 | 0.025 | 0.045 | 1.774 | GR_CORT |
| 1304 | NULL | SEQ ID NO. 749 | 0.025 | 0.17 | 6.771 | GR_DEX |
| 1305 | NULL | SEQ ID NO. 749 | 0.025 | 0.057 | 2.271 | GR_PRED |
| 1306 | PPP2R2A | SEQ ID NO. 750 | 0.076 | 0.086 | 1.129 | GR_CORT |
| 1307 | PPP2R2A | SEQ ID NO. 750 | 0.076 | 0.09 | 1.176 | GR_DEX |
| 1308 | PPP2R2A | SEQ ID NO. 750 | 0.076 | 0.079 | 1.037 | GR_PRED |
| 1309 | NULL | SEQ ID NO. 751 | 0.055 | 0.075 | 1.347 | GR_CORT |
| 1310 | NULL | SEQ ID NO. 751 | 0.055 | 0.133 | 2.395 | GR_DEX |
| 1311 | NULL | SEQ ID NO. 751 | 0.055 | 0.077 | 1.386 | GR_PRED |
| 1312 | KRT6C | SEQ ID NO. 752 | 0.267 | 0.3 | 1.124 | GR_CORT |
| 1313 | KRT6C | SEQ ID NO. 752 | 0.267 | 0.166 | 0.622 | GR_DEX |
| 1314 | KRT6C | SEQ ID NO. 752 | 0.267 | 0.203 | 0.759 | GR_PRED |
| 1315 | C8orf46 | SEQ ID NO. 753 | 0.177 | 0.194 | 1.097 | GR_CORT |
| 1316 | C8orf46 | SEQ ID NO. 753 | 0.177 | 0.325 | 1.839 | GR_DEX |
| 1317 | C8orf46 | SEQ ID NO. 753 | 0.177 | 0.225 | 1.271 | GR_PRED |
| 1318 | SMYD4 | SEQ ID NO. 754 | 0.049 | 0.07 | 1.413 | GR_CORT |
| 1319 | SMYD4 | SEQ ID NO. 754 | 0.049 | 0.121 | 2.454 | GR_DEX |
| 1320 | SMYD4 | SEQ ID NO. 754 | 0.049 | 0.088 | 1.79 | GR_PRED |
| 1321 | MECP2 | SEQ ID NO. 755 | 0.196 | 0.211 | 1.075 | GR_CORT |
| 1322 | MECP2 | SEQ ID NO. 755 | 0.196 | 0.168 | 0.855 | GR_DEX |
| 1323 | MECP2 | SEQ ID NO. 755 | 0.196 | 0.186 | 0.945 | GR_PRED |
| 1324 | MICAL1 | SEQ ID NO. 756 | 0.045 | 0.066 | 1.475 | GR_CORT |
| 1325 | MICAL1 | SEQ ID NO. 756 | 0.045 | 0.085 | 1.898 | GR_DEX |
| 1326 | MICAL1 | SEQ ID NO. 756 | 0.045 | 0.083 | 1.855 | GR_PRED |
| 1327 | EXAM | SEQ ID NO. 757 | 0.04 | 0.047 | 1.171 | GR_CORT |
| 1328 | EXAM | SEQ ID NO. 757 | 0.04 | 0.049 | 1.236 | GR_DEX |
| 1329 | EXAM | SEQ ID NO. 757 | 0.04 | 0.052 | 1.304 | GR_PRED |
| 1330 | GH1 | SEQ ID NO. 758 | 0.101 | 0.12 | 1.185 | GR_CORT |
| 1331 | GH1 | SEQ ID NO. 758 | 0.101 | 0.115 | 1.141 | GR_DEX |
| 1332 | GH1 | SEQ ID NO. 758 | 0.101 | 0.086 | 0.852 | GR_PRED |
| 1333 | NULL | SEQ ID NO. 759 | 0.011 | 0.015 | 1.337 | GR_CORT |
| 1334 | NULL | SEQ ID NO. 759 | 0.011 | 0.012 | 1.056 | GR_DEX |
| 1335 | NULL | SEQ ID NO. 759 | 0.011 | 0.015 | 1.37 | GR_PRED |
| 1336 | GIMAP8 | SEQ ID NO. 760 | 0.903 | 0.955 | 1.058 | GR_CORT |
| 1337 | GIMAP8 | SEQ ID NO. 760 | 0.903 | 0.946 | 1.048 | GR_DEX |
| 1338 | GIMAP8 | SEQ ID NO. 760 | 0.903 | 0.997 | 1.105 | GR_PRED |
| 1339 | IL9R | SEQ ID NO. 761 | 0.046 | 0.049 | 1.062 | GR_CORT |
| 1340 | IL9R | SEQ ID NO. 761 | 0.046 | 0.038 | 0.818 | GR_DEX |
| 1341 | IL9R | SEQ ID NO. 761 | 0.046 | 0.047 | 1.012 | GR_PRED |
| 1342 | NULL | SEQ ID NO. 761 | 0.455 | 0.536 | 1.179 | GR_CORT |
| 1343 | NULL | SEQ ID NO. 761 | 0.455 | 0.34 | 0.747 | GR_DEX |
| 1344 | NULL | SEQ ID NO. 761 | 0.455 | 0.383 | 0.841 | GR_PRED |
| 1345 | SERINC3 | SEQ ID NO. 762 | 4 | 4.12 | 1.03 | GR_CORT |
| 1346 | SERINC3 | SEQ ID NO. 762 | 4 | 4.616 | 1.154 | GR_DEX |
| 1347 | SERINC3 | SEQ ID NO. 762 | 4 | 5.946 | 1.487 | GR_PRED |

FIG. 1AO -- TABLE 1 TRANSCRIPTIONAL BIOMARKER FUNCTIONAL DATA
SECTION 9A

| LINE_ID | GENE_SYMBOL | SEQUENCE_ID_LISTING | PROM_ACTIVITY_N O_INDUCTION | PROM_ACTIVITY_WI TH_INDUCTION | INDUCTION RATIO | INDUCTION_CONDITIONS |
|---|---|---|---|---|---|---|
| 1348 | FNTA | SEQ ID NO. 763 | 0.485 | 0.448 | 0.925 | GR_CORT |
| 1349 | FNTA | SEQ ID NO. 763 | 0.485 | 0.409 | 0.843 | GR_DEX |
| 1350 | FNTA | SEQ ID NO. 763 | 0.485 | 0.475 | 0.98 | GR_PRED |
| 1351 | PPP2R2C | SEQ ID NO. 764 | 0.768 | 0.805 | 1.048 | GR_CORT |
| 1352 | PPP2R2C | SEQ ID NO. 764 | 0.768 | 0.507 | 0.659 | GR_DEX |
| 1353 | PPP2R2C | SEQ ID NO. 764 | 0.768 | 0.618 | 0.805 | GR_PRED |
| 1354 | BIRC6 | SEQ ID NO. 765 | 6.583 | 6.583 | 1 | GR_CORT |
| 1355 | BIRC6 | SEQ ID NO. 765 | 6.583 | 4.5 | 0.684 | GR_DEX |
| 1356 | BIRC6 | SEQ ID NO. 765 | 6.583 | 5.44 | 0.826 | GR_PRED |
| 1357 | FLJ44861 | SEQ ID NO. 766 | 0.095 | 0.097 | 1.027 | GR_CORT |
| 1358 | FLJ44861 | SEQ ID NO. 766 | 0.095 | 0.068 | 0.717 | GR_DEX |
| 1359 | FLJ44861 | SEQ ID NO. 766 | 0.095 | 0.093 | 0.981 | GR_PRED |
| 1360 | NULL | SEQ ID NO. 767 | 0.184 | 0.233 | 1.26 | GR_CORT |
| 1361 | NULL | SEQ ID NO. 767 | 0.184 | 0.328 | 1.78 | GR_DEX |
| 1362 | NULL | SEQ ID NO. 767 | 0.184 | 0.337 | 1.826 | GR_PRED |
| 1363 | NULL | SEQ ID NO. 768 | 0.027 | 0.03 | 1.097 | GR_CORT |
| 1364 | NULL | SEQ ID NO. 768 | 0.027 | 0.023 | 0.842 | GR_DEX |
| 1365 | NULL | SEQ ID NO. 768 | 0.027 | 0.035 | 1.291 | GR_PRED |
| 1366 | NULL | SEQ ID NO. 768 | 0.104 | 0.124 | 1.201 | GR_CORT |
| 1367 | NULL | SEQ ID NO. 768 | 0.104 | 0.103 | 0.993 | GR_DEX |
| 1368 | NULL | SEQ ID NO. 768 | 0.104 | 0.097 | 0.94 | GR_PRED |
| 1369 | NULL | SEQ ID NO. 769 | 0.152 | 0.228 | 1.502 | GR_CORT |
| 1370 | NULL | SEQ ID NO. 769 | 0.152 | 0.706 | 4.649 | GR_DEX |
| 1371 | NULL | SEQ ID NO. 769 | 0.152 | 0.332 | 2.186 | GR_PRED |
| 1372 | PHGDH | SEQ ID NO. 770 | 0.056 | 0.07 | 1.265 | GR_CORT |
| 1373 | PHGDH | SEQ ID NO. 770 | 0.056 | 0.136 | 2.44 | GR_DEX |
| 1374 | PHGDH | SEQ ID NO. 770 | 0.056 | 0.075 | 1.341 | GR_PRED |
| 1375 | YIPF5 | SEQ ID NO. 770 | 121.949 | 132.433 | 1.086 | GR_CORT |
| 1376 | YIPF5 | SEQ ID NO. 770 | 121.949 | 95.564 | 0.787 | GR_DEX |
| 1377 | YIPF5 | SEQ ID NO. 770 | 121.949 | 113.332 | 0.929 | GR_PRED |
| 1378 | CD160 | SEQ ID NO. 771 | 0.094 | 0.122 | 1.295 | GR_CORT |
| 1379 | CD160 | SEQ ID NO. 771 | 0.094 | 0.286 | 3.023 | GR_DEX |
| 1380 | CD160 | SEQ ID NO. 771 | 0.094 | 0.157 | 1.666 | GR_PRED |
| 1381 | DPEP1 | SEQ ID NO. 772 | 0.183 | 0.256 | 1.396 | GR_CORT |
| 1382 | DPEP1 | SEQ ID NO. 772 | 0.183 | 0.291 | 1.589 | GR_DEX |
| 1383 | DPEP1 | SEQ ID NO. 772 | 0.183 | 0.215 | 1.175 | GR_PRED |
| 1384 | MEST | SEQ ID NO. 773 | 2.184 | 2.201 | 1.008 | GR_CORT |
| 1385 | MEST | SEQ ID NO. 773 | 2.184 | 1.898 | 0.869 | GR_DEX |
| 1386 | MEST | SEQ ID NO. 773 | 2.184 | 2.101 | 0.962 | GR_PRED |
| 1387 | COMT | SEQ ID NO. 774 | 17.44 | 21.933 | 1.258 | GR_CORT |
| 1388 | COMT | SEQ ID NO. 774 | 17.44 | 15.625 | 0.896 | GR_DEX |
| 1389 | COMT | SEQ ID NO. 774 | 17.44 | 17.614 | 1.01 | GR_PRED |
| 1390 | B2M | SEQ ID NO. 775 | 0.041 | 0.042 | 1.006 | GR_CORT |
| 1391 | B2M | SEQ ID NO. 775 | 0.041 | 0.05 | 1.196 | GR_DEX |
| 1392 | B2M | SEQ ID NO. 775 | 0.041 | 0.044 | 1.067 | GR_PRED |
| 1393 | SEPX1 | SEQ ID NO. 776 | 1.433 | 1.488 | 1.039 | GR_CORT |
| 1394 | SEPX1 | SEQ ID NO. 776 | 1.433 | 1.321 | 0.922 | GR_DEX |
| 1395 | SEPX1 | SEQ ID NO. 776 | 1.433 | 1.242 | 0.867 | GR_PRED |

*FIG. 1AP* -- TABLE 1 TRANSCRIPTIONAL BIOMARKER FUNCTIONAL DATA.
SECTION 8A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS* |
|---|---|---|---|---|---|---|
| 1396 | WNT5A | SEQ ID NO. 777 | 0.415 | 0.478 | 1.152 | GR_CORT |
| 1397 | WNT5A | SEQ ID NO. 777 | 0.415 | 0.328 | 0.789 | GR_DEX |
| 1398 | WNT5A | SEQ ID NO. 777 | 0.415 | 0.363 | 0.875 | GR_PRED |
| 1399 | B2M | SEQ ID NO. 778 | 89.956 | 88.069 | 0.979 | GR_CORT |
| 1400 | B2M | SEQ ID NO. 778 | 89.956 | 57.838 | 0.643 | GR_DEX |
| 1401 | B2M | SEQ ID NO. 778 | 89.956 | 69.351 | 0.771 | GR_PRED |
| 1402 | IDH1 | SEQ ID NO. 779 | 46.908 | 46.129 | 0.983 | GR_CORT |
| 1403 | IDH1 | SEQ ID NO. 779 | 46.908 | 43.028 | 0.918 | GR_DEX |
| 1404 | IDH1 | SEQ ID NO. 779 | 46.908 | 53.296 | 1.136 | GR_PRED |
| 1405 | HSP90AB1 | SEQ ID NO. 780 | 0.092 | 0.124 | 1.353 | GR_CORT |
| 1406 | HSP90AB1 | SEQ ID NO. 780 | 0.092 | 0.09 | 0.98 | GR_DEX |
| 1407 | HSP90AB1 | SEQ ID NO. 780 | 0.092 | 0.097 | 1.049 | GR_PRED |
| 1408 | C1R | SEQ ID NO. 781 | 0.439 | 0.439 | 1.115 | GR_CORT |
| 1409 | C1R | SEQ ID NO. 781 | 0.439 | 0.658 | 1.5 | GR_DEX |
| 1410 | C1R | SEQ ID NO. 781 | 0.439 | 0.582 | 1.325 | GR_PRED |
| 1411 | UGCG | SEQ ID NO. 782 | 4.116 | 4.945 | 1.201 | GR_CORT |
| 1412 | UGCG | SEQ ID NO. 782 | 4.116 | 3.367 | 0.818 | GR_DEX |
| 1413 | UGCG | SEQ ID NO. 782 | 4.116 | 4.488 | 1.09 | GR_PRED |
| 1414 | PFKL | SEQ ID NO. 783 | 5.06 | 5.031 | 0.994 | GR_CORT |
| 1415 | PFKL | SEQ ID NO. 783 | 5.06 | 4.941 | 0.976 | GR_DEX |
| 1416 | PFKL | SEQ ID NO. 783 | 5.06 | 5.394 | 1.066 | GR_PRED |
| 1417 | CPS1 | SEQ ID NO. 784 | 6.8 | 7.826 | 1.151 | GR_CORT |
| 1418 | CPS1 | SEQ ID NO. 784 | 6.8 | 5.931 | 0.872 | GR_DEX |
| 1419 | CPS1 | SEQ ID NO. 784 | 6.8 | 7.173 | 1.055 | GR_PRED |
| 1420 | B2M | SEQ ID NO. 785 | 0.082 | 0.095 | 1.15 | GR_CORT |
| 1421 | B2M | SEQ ID NO. 785 | 0.082 | 0.067 | 0.812 | GR_DEX |
| 1422 | B2M | SEQ ID NO. 785 | 0.082 | 0.08 | 0.968 | GR_PRED |
| 1423 | PSMA6 | SEQ ID NO. 786 | 31.273 | 37.772 | 1.208 | GR_CORT |
| 1424 | PSMA6 | SEQ ID NO. 786 | 31.273 | 25.214 | 0.806 | GR_DEX |
| 1425 | PSMA6 | SEQ ID NO. 786 | 31.273 | 26.71 | 0.854 | GR_PRED |
| 1426 | RNF11 | SEQ ID NO. 787 | 0.037 | 0.052 | 1.421 | GR_CORT |
| 1427 | RNF11 | SEQ ID NO. 787 | 0.037 | 0.038 | 1.029 | GR_DEX |
| 1428 | RNF11 | SEQ ID NO. 787 | 0.037 | 0.042 | 1.143 | GR_PRED |
| 1429 | SERPINA1 | SEQ ID NO. 788 | 1.01 | 1.074 | 1.064 | GR_CORT |
| 1430 | SERPINA1 | SEQ ID NO. 788 | 1.01 | 1.173 | 1.162 | GR_DEX |
| 1431 | SERPINA1 | SEQ ID NO. 788 | 1.01 | 1.152 | 1.141 | GR_PRED |
| 1432 | SMURF2 | SEQ ID NO. 789 | 0.053 | 0.069 | 1.31 | GR_CORT |
| 1433 | SMURF2 | SEQ ID NO. 789 | 0.053 | 0.049 | 0.941 | GR_DEX |
| 1434 | SMURF2 | SEQ ID NO. 789 | 0.053 | 0.053 | 1.002 | GR_PRED |
| 1435 | NRI1 | SEQ ID NO. 790 | 0.657 | 0.592 | 0.901 | GR_CORT |
| 1436 | NRI1 | SEQ ID NO. 790 | 0.657 | 0.485 | 0.738 | GR_DEX |
| 1437 | NRI1 | SEQ ID NO. 790 | 0.657 | 0.59 | 0.897 | GR_PRED |
| 1438 | GBF1 | SEQ ID NO. 791 | 0.076 | 0.091 | 1.204 | GR_CORT |
| 1439 | GBF1 | SEQ ID NO. 791 | 0.076 | 0.06 | 0.793 | GR_DEX |
| 1440 | GBF1 | SEQ ID NO. 791 | 0.076 | 0.085 | 1.121 | GR_PRED |
| 1441 | TTN | SEQ ID NO. 792 | 0.143 | 0.155 | 1.082 | GR_CORT |
| 1442 | TTN | SEQ ID NO. 792 | 0.143 | 0.137 | 0.956 | GR_DEX |
| 1443 | TTN | SEQ ID NO. 792 | 0.143 | 0.163 | 1.139 | GR_PRED |

FIG. 1AQ -- TABLE 1 TRANSCRIPTIONAL BIOMARKER FUNCTIONAL DATA
SECTION 8A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS |
|---|---|---|---|---|---|---|
| 1444 | SRPK2 | SEQ ID NO. 793 | 0.037 | 0.039 | 1.047 | GR_CORT |
| 1445 | SRPK2 | SEQ ID NO. 793 | 0.037 | 0.056 | 1.507 | GR_DEX |
| 1446 | SRPK2 | SEQ ID NO. 793 | 0.037 | 0.043 | 1.155 | GR_PRED |
| 1447 | MKNK2 | SEQ ID NO. 794 | 5.43 | 6.716 | 1.237 | GR_CORT |
| 1448 | MKNK2 | SEQ ID NO. 794 | 5.43 | 4.055 | 0.747 | GR_DEX |
| 1449 | MKNK2 | SEQ ID NO. 794 | 5.43 | 3.981 | 0.733 | GR_PRED |
| 1450 | ATP6AP1 | SEQ ID NO. 795 | 0.128 | 0.162 | 1.267 | GR_CORT |
| 1451 | ATP6AP1 | SEQ ID NO. 795 | 0.128 | 0.108 | 0.840 | GR_DEX |
| 1452 | ATP6AP1 | SEQ ID NO. 795 | 0.128 | 0.128 | 0.999 | GR_PRED |
| 1453 | GLUL | SEQ ID NO. 796 | 0.149 | 0.195 | 1.311 | GR_CORT |
| 1454 | GLUL | SEQ ID NO. 796 | 0.149 | 0.248 | 1.664 | GR_DEX |
| 1455 | GLUL | SEQ ID NO. 796 | 0.149 | 0.174 | 1.165 | GR_PRED |
| 1456 | IGFBP1 | SEQ ID NO. 797 | 0.078 | 0.094 | 1.202 | GR_CORT |
| 1457 | IGFBP1 | SEQ ID NO. 797 | 0.078 | 0.078 | 0.995 | GR_DEX |
| 1458 | IGFBP1 | SEQ ID NO. 797 | 0.078 | 0.078 | 0.997 | GR_PRED |
| 1459 | IGFBP1 | SEQ ID NO. 798 | 0.096 | 0.104 | 1.083 | GR_CORT |
| 1460 | IGFBP1 | SEQ ID NO. 798 | 0.096 | 0.074 | 0.775 | GR_DEX |
| 1461 | IGFBP1 | SEQ ID NO. 798 | 0.096 | 0.09 | 0.939 | GR_PRED |
| 1462 | TARP | SEQ ID NO. 799 | 8.139 | 6.322 | 0.777 | GR_CORT |
| 1463 | TARP | SEQ ID NO. 799 | 8.139 | 5.723 | 0.703 | GR_DEX |
| 1464 | TARP | SEQ ID NO. 799 | 8.139 | 6.028 | 0.741 | GR_PRED |
| 1465 | SLC37A3 | SEQ ID NO. 800 | 5.876 | 5.766 | 0.982 | GR_CORT |
| 1466 | SLC37A3 | SEQ ID NO. 800 | 5.876 | 5.746 | 0.978 | GR_DEX |
| 1467 | SLC37A3 | SEQ ID NO. 800 | 5.876 | 5.091 | 0.866 | GR_PRED |
| 1468 | MEST | SEQ ID NO. 801 | 0.266 | 0.287 | 1.078 | GR_CORT |
| 1469 | MEST | SEQ ID NO. 801 | 0.266 | 0.209 | 0.785 | GR_DEX |
| 1470 | MEST | SEQ ID NO. 801 | 0.266 | 0.274 | 1.032 | GR_PRED |
| 1471 | AKAP9 | SEQ ID NO. 801 | 0.51 | 0.614 | 1.203 | GR_CORT |
| 1472 | AKAP9 | SEQ ID NO. 801 | 0.51 | 0.479 | 0.939 | GR_DEX |
| 1473 | AKAP9 | SEQ ID NO. 801 | 0.51 | 0.564 | 1.105 | GR_PRED |
| 1474 | FAM3C | SEQ ID NO. 801 | 2.8 | 2.94 | 1.05 | GR_CORT |
| 1475 | FAM3C | SEQ ID NO. 801 | 2.8 | 2.913 | 1.04 | GR_DEX |
| 1476 | FAM3C | SEQ ID NO. 801 | 2.8 | 2.744 | 0.98 | GR_PRED |
| 1477 | PLXD3 | SEQ ID NO. 801 | 18.043 | 21.035 | 1.165 | GR_CORT |
| 1478 | PLXD3 | SEQ ID NO. 801 | 18.043 | 15.398 | 0.853 | GR_DEX |
| 1479 | PLXD3 | SEQ ID NO. 801 | 18.043 | 19.065 | 1.057 | GR_PRED |
| 1480 | MEST | SEQ ID NO. 801 | 37.011 | 38.569 | 1.042 | GR_CORT |
| 1481 | NUB1 | SEQ ID NO. 801 | 37.011 | 34.408 | 0.932 | GR_DEX |
| 1482 | NUB1 | SEQ ID NO. 801 | 37.011 | 33.451 | 0.904 | GR_PRED |
| 1483 | RAB11A | SEQ ID NO. 802 | 12.934 | 12.844 | 0.993 | GR_CORT |
| 1484 | RAB11A | SEQ ID NO. 802 | 12.934 | 8.246 | 0.638 | GR_DEX |
| 1485 | RAB11A | SEQ ID NO. 802 | 12.934 | 9.867 | 0.763 | GR_PRED |
| 1486 | MEST | SEQ ID NO. 803 | 1.822 | 2.051 | 1.126 | GR_CORT |
| 1487 | MEST | SEQ ID NO. 803 | 1.822 | 1.479 | 0.812 | GR_DEX |
| 1488 | MEST | SEQ ID NO. 803 | 1.822 | 1.718 | 0.943 | GR_PRED |
| 1489 | ADM | SEQ ID NO. 803 | 16.631 | 21.191 | 1.274 | GR_CORT |
| 1490 | ADM | SEQ ID NO. 803 | 16.631 | 22.412 | 1.348 | GR_DEX |
| 1491 | ADM | SEQ ID NO. 803 | 16.631 | 16.306 | 0.98 | GR_PRED |

FIG. 1AR -- TABLE 1 TRANSCRIPTIONAL BIOMARKER FUNCTIONAL DATA
SECTION 8A

| LINE_ID | GENE_SYMBOL | SEQUENCE_ID_LISTING | PROM_ACTIVITY_N O_INDUCTION | PROM_ACTIVITY_N TH_INDUCTION | PROM_ACTIVITY_WI TH_INDUCTION | INDUCTION_RATIO | INDUCTION_CONDITIONS* |
|---|---|---|---|---|---|---|---|
| 1492 | CAT | SEQ ID NO. 803 | 6.31 | | 5.971 | 0.946 | GR_CORT |
| 1493 | CAT | SEQ ID NO. 803 | 6.31 | | 5.411 | 0.857 | GR_DEX |
| 1494 | CAT | SEQ ID NO. 803 | 6.31 | | 4.716 | 0.747 | GR_PRED |
| 1495 | TXN | SEQ ID NO. 804 | 2.481 | | 2.461 | 0.992 | GR_CORT |
| 1496 | TXN | SEQ ID NO. 804 | 2.481 | | 1.839 | 0.741 | GR_DEX |
| 1497 | TXN | SEQ ID NO. 804 | 2.481 | | 2.479 | 0.999 | GR_PRED |
| 1498 | HSP90AB1 | SEQ ID NO. 804 | 217.828 | | 176.047 | 0.808 | GR_CORT |
| 1499 | HSP90AB1 | SEQ ID NO. 804 | 217.828 | | 159.386 | 0.732 | GR_DEX |
| 1500 | HSP90AB1 | SEQ ID NO. 804 | 217.828 | | 167.581 | 0.769 | GR_PRED |
| 1501 | SRGN | SEQ ID NO. 805 | 0.108 | | 0.22 | 2.041 | GR_CORT |
| 1502 | SRGN | SEQ ID NO. 805 | 0.108 | | 0.546 | 5.059 | GR_DEX |
| 1503 | SRGN | SEQ ID NO. 805 | 0.108 | | 0.284 | 2.634 | GR_PRED |
| 1504 | AMPD3 | SEQ ID NO. 806 | 0.497 | | 0.565 | 1.137 | GR_CORT |
| 1505 | AMPD3 | SEQ ID NO. 806 | 0.497 | | 0.388 | 0.782 | GR_DEX |
| 1506 | AMPD3 | SEQ ID NO. 806 | 0.497 | | 0.443 | 0.893 | GR_PRED |
| 1507 | AMPD3 | SEQ ID NO. 807 | 0.35 | | 0.382 | 1.090 | GR_CORT |
| 1508 | AMPD3 | SEQ ID NO. 807 | 0.35 | | 0.246 | 0.702 | GR_DEX |
| 1509 | AMPD3 | SEQ ID NO. 807 | 0.35 | | 0.299 | 0.854 | GR_PRED |
| 1510 | ZFP36L1 | SEQ ID NO. 808 | 1.904 | | 1.926 | 1.012 | GR_CORT |
| 1511 | ZFP36L1 | SEQ ID NO. 808 | 1.904 | | 1.588 | 0.834 | GR_DEX |
| 1512 | ZFP36L1 | SEQ ID NO. 808 | 1.904 | | 1.606 | 0.843 | GR_PRED |
| 1513 | CCL2 | SEQ ID NO. 809 | 0.131 | | 0.161 | 1.23 | GR_CORT |
| 1514 | CCL2 | SEQ ID NO. 809 | 0.131 | | 0.135 | 1.031 | GR_DEX |
| 1515 | CCL2 | SEQ ID NO. 809 | 0.131 | | 0.131 | 1.001 | GR_PRED |
| 1516 | IDH1 | SEQ ID NO. 810 | 11.204 | | 12.677 | 1.132 | GR_CORT |
| 1517 | IDH1 | SEQ ID NO. 810 | 11.204 | | 11.514 | 1.028 | GR_DEX |
| 1518 | IDH1 | SEQ ID NO. 810 | 11.204 | | 11.405 | 1.018 | GR_PRED |
| 1519 | EDN1 | SEQ ID NO. 811 | 12.879 | | 12.813 | 0.995 | GR_CORT |
| 1520 | EDN1 | SEQ ID NO. 811 | 12.879 | | 8.524 | 0.662 | GR_DEX |
| 1521 | EDN1 | SEQ ID NO. 811 | 12.879 | | 9.645 | 0.749 | GR_PRED |
| 1522 | ANP32E | SEQ ID NO. 812 | 3.584 | | 3.684 | 1.028 | GR_CORT |
| 1523 | ANP32E | SEQ ID NO. 812 | 3.584 | | 4.461 | 1.245 | GR_DEX |
| 1524 | ANP32E | SEQ ID NO. 812 | 3.584 | | 3.799 | 1.06 | GR_PRED |
| 1525 | PER1 | SEQ ID NO. 813 | 30.546 | | 45.625 | 1.494 | GR_CORT |
| 1526 | PER1 | SEQ ID NO. 813 | 30.546 | | 42.828 | 1.402 | GR_DEX |
| 1527 | PER1 | SEQ ID NO. 813 | 30.546 | | 43.416 | 1.421 | GR_PRED |
| 1528 | SNTA1 | SEQ ID NO. 814 | 1.6 | | 3.352 | 2.095 | GR_CORT |
| 1529 | SNTA1 | SEQ ID NO. 814 | 1.6 | | 12.478 | 7.799 | GR_DEX |
| 1530 | SNTA1 | SEQ ID NO. 814 | 1.6 | | 6.64 | 4.151 | GR_PRED |

*FIG. 1AS* -- TABLE 1 TRANSCRIPTIONAL BIOMARKER FUNCTIONAL DATA
SECTION 8A

| LINE_ID | GENE_SYMBOL | SEQUENCE_ID_LISTING | PROM_ACTIVITY_IN O_INDUCTION | PROM_ACTIVITY_WITH_INDUCTION | INDUCTION_RATIO | INDUCTION_CONDITIONS* |
|---|---|---|---|---|---|---|
| 1531 | HBS1L | SEQ ID NO. 815 | 3.722 | 4.37 | 1.174 | GR_CORT |
| 1532 | HBS1L | SEQ ID NO. 815 | 3.722 | 4.854 | 1.304 | GR_DEX |
| 1533 | HBS1L | SEQ ID NO. 815 | 3.722 | 3.334 | 0.896 | GR_PRED |
| 1534 | TSC22D3 | SEQ ID NO. 816 | 45.72 | 88.919 | 1.945 | GR_CORT |
| 1535 | TSC22D3 | SEQ ID NO. 816 | 45.72 | 176.275 | 3.856 | GR_DEX |
| 1536 | TSC22D3 | SEQ ID NO. 816 | 45.72 | 157.522 | 3.445 | GR_PRED |
| 1537 | LCN2 | SEQ ID NO. 817 | 4.607 | 5.141 | 1.116 | GR_CORT |
| 1538 | LCN2 | SEQ ID NO. 817 | 4.607 | 5.276 | 1.145 | GR_DEX |
| 1539 | LCN2 | SEQ ID NO. 817 | 4.607 | 4.683 | 1.017 | GR_PRED |
| 1540 | PHLDA1 | SEQ ID NO. 818 | 12.071 | 14.094 | 1.168 | GR_CORT |
| 1541 | PHLDA1 | SEQ ID NO. 818 | 12.071 | 12.428 | 1.03 | GR_DEX |
| 1542 | PHLDA1 | SEQ ID NO. 818 | 12.071 | 13.01 | 1.078 | GR_PRED |
| 1543 | GLUL | SEQ ID NO. 819 | 4.203 | 4.937 | 1.175 | GR_CORT |
| 1544 | GLUL | SEQ ID NO. 819 | 4.203 | 9.002 | 2.142 | GR_DEX |
| 1545 | GLUL | SEQ ID NO. 819 | 4.203 | 6.136 | 1.46 | GR_PRED |

FIG. 1AT -- TABLE 1 TRANSCRIPTIONAL BIOMARKER FUNCTIONAL DATA
SECTION 12A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS* |
|---|---|---|---|---|---|---|
| 1546 | CCT4 | SEQ ID NO. 820 | 171.564 | 170.67 | 0.995 | HSF |

FIG. 1AU – TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_WI TH_INDUCTION | INDUCTION RATIO | INDUCTION_CONDITIONS* |
|---|---|---|---|---|---|---|
| 1547 | MDM2 | SEQ ID NO. 821 | 19.241 | 41.842 | 2.175 | HYPOX_DFO_HCT116 |
| 1548 | MDM2 | SEQ ID NO. 821 | 1.73 | 6.593 | 3.81 | HYPOX_DFO_HT1080 |
| 1549 | MDM2 | SEQ ID NO. 821 | 19.241 | 37.48 | 1.948 | HYPOX_O2_HCT116 |
| 1550 | MDM2 | SEQ ID NO. 821 | 1.73 | 3.592 | 2.076 | HYPOX_O2_HT1080 |
| 1551 | SIRT1 | SEQ ID NO. 822 | 935.85 | 666.669 | 0.712 | HYPOX_DFO_HCT116 |
| 1552 | SIRT1 | SEQ ID NO. 822 | 45.456 | 31.794 | 0.699 | HYPOX_DFO_HT1080 |
| 1553 | SIRT1 | SEQ ID NO. 822 | 935.85 | 672.65 | 0.719 | HYPOX_O2_HCT116 |
| 1554 | SIRT1 | SEQ ID NO. 822 | 45.456 | 34.837 | 0.766 | HYPOX_O2_HT1080 |
| 1555 | PIK3R2 | SEQ ID NO. 823 | 280.698 | 296.522 | 1.056 | HYPOX_DFO_HCT116 |
| 1556 | PIK3R2 | SEQ ID NO. 823 | 78.619 | 37.773 | 0.48 | HYPOX_DFO_HT1080 |
| 1557 | PIK3R2 | SEQ ID NO. 823 | 280.698 | 266.444 | 0.949 | HYPOX_O2_HCT116 |
| 1558 | PIK3R2 | SEQ ID NO. 823 | 78.619 | 58.624 | 0.746 | HYPOX_O2_HT1080 |
| 1559 | PSPH | SEQ ID NO. 823 | 47.256 | 29.872 | 0.632 | HYPOX_DFO_HCT116 |
| 1560 | PSPH | SEQ ID NO. 823 | 3.349 | 3.274 | 0.978 | HYPOX_DFO_HT1080 |
| 1561 | PSPH | SEQ ID NO. 823 | 47.256 | 32.887 | 0.696 | HYPOX_O2_HCT116 |
| 1562 | PSPH | SEQ ID NO. 823 | 3.349 | 3.342 | 0.998 | HYPOX_O2_HT1080 |
| 1563 | AKAP9 | SEQ ID NO. 823 | 918.486 | 830.353 | 0.904 | HYPOX_DFO_HCT116 |
| 1564 | AKAP9 | SEQ ID NO. 823 | 58.754 | 58.321 | 0.993 | HYPOX_DFO_HT1080 |
| 1565 | AKAP9 | SEQ ID NO. 823 | 918.486 | 693.764 | 0.755 | HYPOX_O2_HCT116 |
| 1566 | AKAP9 | SEQ ID NO. 823 | 58.754 | 54.245 | 0.923 | HYPOX_O2_HT1080 |
| 1567 | FAM3C | SEQ ID NO. 823 | 236.58 | 316.511 | 1.338 | HYPOX_DFO_HCT116 |
| 1568 | FAM3C | SEQ ID NO. 823 | 53.976 | 34.704 | 0.643 | HYPOX_DFO_HT1080 |
| 1569 | FAM3C | SEQ ID NO. 823 | 236.58 | 184.946 | 0.782 | HYPOX_O2_HCT116 |
| 1570 | FAM3C | SEQ ID NO. 823 | 53.976 | 39.655 | 0.735 | HYPOX_O2_HT1080 |
| 1571 | EOGP | SEQ ID NO. 823 | 54.919 | 33.509 | 0.61 | HYPOX_DFO_HCT116 |
| 1572 | EOGP | SEQ ID NO. 823 | 1.411 | 1.225 | 0.869 | HYPOX_DFO_HT1080 |
| 1573 | EOGP | SEQ ID NO. 823 | 54.919 | 39.835 | 0.725 | HYPOX_O2_HCT116 |
| 1574 | EOGP | SEQ ID NO. 823 | 1.411 | 1.347 | 0.954 | HYPOX_O2_HT1080 |
| 1575 | NULL | SEQ ID NO. 823 | 813.098 | 1567.791 | 1.928 | HYPOX_DFO_HCT116 |
| 1576 | NULL | SEQ ID NO. 823 | 382.901 | 176.143 | 0.46 | HYPOX_DFO_HT1080 |
| 1577 | NULL | SEQ ID NO. 823 | 813.098 | 1927.397 | 2.37 | HYPOX_O2_HCT116 |
| 1578 | NULL | SEQ ID NO. 823 | 382.901 | 323.833 | 0.846 | HYPOX_O2_HT1080 |
| 1579 | NULL | SEQ ID NO. 823 | 42.408 | 24.454 | 0.577 | HYPOX_DFO_HCT116 |
| 1580 | NULL | SEQ ID NO. 823 | 8.003 | 7.059 | 0.882 | HYPOX_DFO_HT1080 |
| 1581 | NULL | SEQ ID NO. 823 | 42.408 | 36.017 | 0.849 | HYPOX_O2_HCT116 |
| 1582 | NULL | SEQ ID NO. 823 | 8.003 | 14.376 | 1.796 | HYPOX_O2_HT1080 |
| 1583 | PLOD3 | SEQ ID NO. 823 | 1450.669 | 2123.426 | 1.467 | HYPOX_DFO_HCT116 |
| 1584 | PLOD3 | SEQ ID NO. 823 | 385.429 | 457.356 | 1.187 | HYPOX_DFO_HT1080 |
| 1585 | PLOD3 | SEQ ID NO. 823 | 1450.669 | 1420.232 | 0.979 | HYPOX_O2_HCT116 |
| 1586 | PLOD3 | SEQ ID NO. 823 | 385.429 | 454.256 | 1.179 | HYPOX_O2_HT1080 |
| 1587 | NULL | SEQ ID NO. 823 | 1852.134 | 3090.784 | 1.669 | HYPOX_DFO_HCT116 |
| 1588 | NULL | SEQ ID NO. 823 | 380.058 | 689.303 | 1.814 | HYPOX_DFO_HT1080 |
| 1589 | NULL | SEQ ID NO. 823 | 1852.134 | 1989.401 | 1.074 | HYPOX_O2_HCT116 |
| 1590 | NULL | SEQ ID NO. 823 | 380.058 | 413.771 | 1.089 | HYPOX_O2_HT1080 |
| 1591 | NULL | SEQ ID NO. 823 | 289.399 | 492.718 | 1.703 | HYPOX_DFO_HCT116 |
| 1592 | NULL | SEQ ID NO. 823 | 123.585 | 123.957 | 1.003 | HYPOX_DFO_HT1080 |
| 1593 | NULL | SEQ ID NO. 823 | 289.399 | 373.559 | 1.291 | HYPOX_O2_HCT116 |
| 1594 | NULL | SEQ ID NO. 823 | 123.585 | 146.127 | 1.183 | HYPOX_O2_HT1080 |

FIG. 1AV -- TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_W1 TH_INDUCTION | INDUCTION_RATIO | INDUCTION_CONDITIONS* |
|---|---|---|---|---|---|---|
| 1595 | HERPUD2 | SEQ ID NO. 823 | 65.85 | 285.535 | 4.26 | HYPOX_DFO_HCT116 |
| 1596 | HERPUD2 | SEQ ID NO. 823 | 15.033 | 32.272 | 2.147 | HYPOX_DFO_HT1080 |
| 1597 | HERPUD2 | SEQ ID NO. 823 | 65.85 | 233.09 | 3.54 | HYPOX_O2_HCT116 |
| 1598 | HERPUD2 | SEQ ID NO. 823 | 15.033 | 17.894 | 1.19 | HYPOX_O2_HT1080 |
| 1599 | NULL | SEQ ID NO. 823 | 237.435 | 68.845 | 0.29 | HYPOX_DFO_HCT116 |
| 1600 | NULL | SEQ ID NO. 823 | 11.763 | 16.241 | 1.381 | HYPOX_DFO_HT1080 |
| 1601 | NULL | SEQ ID NO. 823 | 237.435 | 215.267 | 0.907 | HYPOX_O2_HCT116 |
| 1602 | NULL | SEQ ID NO. 823 | 11.763 | 13.286 | 1.129 | HYPOX_O2_HT1080 |
| 1603 | NCAPG2 | SEQ ID NO. 823 | 1565.254 | 1411.219 | 0.902 | HYPOX_DFO_HCT116 |
| 1604 | NCAPG2 | SEQ ID NO. 823 | 351.067 | 432.444 | 1.229 | HYPOX_DFO_HT1080 |
| 1605 | NCAPG2 | SEQ ID NO. 823 | 1565.254 | 1327.753 | 0.848 | HYPOX_O2_HCT116 |
| 1606 | NCAPG2 | SEQ ID NO. 823 | 351.067 | 361.878 | 1.028 | HYPOX_O2_HT1080 |
| 1607 | NUB1 | SEQ ID NO. 823 | 2208.425 | 2560.601 | 1.161 | HYPOX_DFO_HCT116 |
| 1608 | NUB1 | SEQ ID NO. 823 | 813.604 | 704.671 | 0.866 | HYPOX_DFO_HT1080 |
| 1609 | NUB1 | SEQ ID NO. 823 | 2208.425 | 2134.148 | 0.967 | HYPOX_O2_HCT116 |
| 1610 | NUB1 | SEQ ID NO. 823 | 813.604 | 689.727 | 0.848 | HYPOX_O2_HT1080 |
| 1611 | NULL | SEQ ID NO. 823 | 164.85 | 158.087 | 0.959 | HYPOX_DFO_HCT116 |
| 1612 | NULL | SEQ ID NO. 823 | 64.062 | 47.144 | 0.736 | HYPOX_DFO_HT1080 |
| 1613 | NULL | SEQ ID NO. 823 | 164.85 | 152.986 | 0.928 | HYPOX_O2_HCT116 |
| 1614 | NULL | SEQ ID NO. 823 | 64.062 | 47.241 | 0.737 | HYPOX_O2_HT1080 |
| 1615 | SLC4A2 | SEQ ID NO. 823 | 155.628 | 75.014 | 0.483 | HYPOX_DFO_HCT116 |
| 1616 | SLC4A2 | SEQ ID NO. 823 | 30.47 | 22.692 | 0.745 | HYPOX_DFO_HT1080 |
| 1617 | SLC4A2 | SEQ ID NO. 823 | 155.628 | 115.79 | 0.744 | HYPOX_O2_HCT116 |
| 1618 | SLC4A2 | SEQ ID NO. 823 | 30.47 | 27.63 | 0.907 | HYPOX_O2_HT1080 |
| 1619 | NULL | SEQ ID NO. 823 | 298.181 | 236.16 | 0.792 | HYPOX_DFO_HCT116 |
| 1620 | NULL | SEQ ID NO. 823 | 22.201 | 25.678 | 1.157 | HYPOX_DFO_HT1080 |
| 1621 | NULL | SEQ ID NO. 823 | 298.181 | 367.313 | 1.232 | HYPOX_O2_HCT116 |
| 1622 | NULL | SEQ ID NO. 823 | 22.201 | 23.451 | 1.056 | HYPOX_O2_HT1080 |
| 1623 | REPIN1 | SEQ ID NO. 823 | 832.105 | 442.097 | 0.531 | HYPOX_DFO_HCT116 |
| 1624 | REPIN1 | SEQ ID NO. 823 | 65.147 | 60.309 | 0.926 | HYPOX_DFO_HT1080 |
| 1625 | REPIN1 | SEQ ID NO. 823 | 832.105 | 708.993 | 0.852 | HYPOX_O2_HCT116 |
| 1626 | REPIN1 | SEQ ID NO. 823 | 65.147 | 73.901 | 1.134 | HYPOX_O2_HT1080 |
| 1627 | MICALL2 | SEQ ID NO. 823 | 613.145 | 208.21 | 0.34 | HYPOX_DFO_HCT116 |
| 1628 | MICALL2 | SEQ ID NO. 823 | 43.822 | 26.052 | 0.594 | HYPOX_DFO_HT1080 |
| 1629 | MICALL2 | SEQ ID NO. 823 | 613.145 | 371.042 | 0.605 | HYPOX_O2_HCT116 |
| 1630 | MICALL2 | SEQ ID NO. 823 | 43.822 | 34.974 | 0.798 | HYPOX_O2_HT1080 |
| 1631 | AIF1 | SEQ ID NO. 824 | 2.744 | 0.914 | 0.333 | HYPOX_DFO_HCT116 |
| 1632 | AIF1 | SEQ ID NO. 824 | 0.158 | 0.247 | 1.560 | HYPOX_DFO_HT1080 |
| 1633 | AIF1 | SEQ ID NO. 824 | 2.744 | 1.924 | 0.701 | HYPOX_O2_HCT116 |
| 1634 | AIF1 | SEQ ID NO. 824 | 0.158 | 0.21 | 1.333 | HYPOX_O2_HT1080 |
| 1635 | ERBB2 | SEQ ID NO. 825 | 480.915 | 642.718 | 1.336 | HYPOX_DFO_HCT116 |
| 1636 | ERBB2 | SEQ ID NO. 825 | 57.873 | 57.256 | 0.989 | HYPOX_DFO_HT1080 |
| 1637 | ERBB2 | SEQ ID NO. 825 | 480.915 | 440.493 | 0.916 | HYPOX_O2_HCT116 |
| 1638 | ERBB2 | SEQ ID NO. 825 | 57.873 | 52.491 | 0.907 | HYPOX_O2_HT1080 |
| 1639 | TNF | SEQ ID NO. 825 | 628.959 | 405.271 | 0.644 | HYPOX_DFO_HCT116 |
| 1640 | TNF | SEQ ID NO. 825 | 78.78 | 61.898 | 0.786 | HYPOX_DFO_HT1080 |
| 1641 | TNF | SEQ ID NO. 825 | 628.959 | 433.388 | 0.689 | HYPOX_O2_HCT116 |
| 1642 | TNF | SEQ ID NO. 825 | 78.78 | 60.204 | 0.764 | HYPOX_O2_HT1080 |

*FIG. 1AW* — TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_N TH_INDUCTION | PROM_ACTIVITY_W1 INDUCTION | INDUCTION RATIO | INDUCTION_CONDITIONS* |
|---|---|---|---|---|---|---|---|
| 1643 | ITGB2 | SEQ ID NO. 826 | 57.666 | | 13.629 | 0.236 | HYPOX_DFO_HCT116 |
| 1644 | ITGB2 | SEQ ID NO. 826 | 3.185 | | 2.581 | 0.81 | HYPOX_DFO_HCT116 |
| 1645 | ITGB2 | SEQ ID NO. 826 | 57.666 | | 34.014 | 0.59 | HYPOX_O2_HCT116 |
| 1646 | ITGB2 | SEQ ID NO. 826 | 3.185 | | 3.654 | 1.147 | HYPOX_O2_HT1080 |
| 1647 | APEX1 | SEQ ID NO. 827 | 90.341 | | 66.773 | 0.739 | HYPOX_DFO_HCT116 |
| 1648 | APEX1 | SEQ ID NO. 827 | 60.917 | | 39.42 | 0.647 | HYPOX_DFO_HT1080 |
| 1649 | APEX1 | SEQ ID NO. 827 | 90.341 | | 58.24 | 0.645 | HYPOX_O2_HCT116 |
| 1650 | APEX1 | SEQ ID NO. 827 | 60.917 | | 60.866 | 0.999 | HYPOX_O2_HT1080 |
| 1651 | CDC73 | SEQ ID NO. 828 | 356.236 | | 694.414 | 1.949 | HYPOX_DFO_HCT116 |
| 1652 | CDC73 | SEQ ID NO. 828 | 78.962 | | 88.442 | 1.12 | HYPOX_DFO_HT1080 |
| 1653 | CDC73 | SEQ ID NO. 828 | 356.236 | | 583.857 | 1.639 | HYPOX_O2_HCT116 |
| 1654 | CDC73 | SEQ ID NO. 828 | 78.962 | | 77.532 | 0.982 | HYPOX_O2_HT1080 |
| 1655 | TIA1 | SEQ ID NO. 829 | 302.97 | | 547.485 | 1.807 | HYPOX_DFO_HCT116 |
| 1656 | TIA1 | SEQ ID NO. 829 | 82.225 | | 113.05 | 1.375 | HYPOX_DFO_HT1080 |
| 1657 | TIA1 | SEQ ID NO. 829 | 302.97 | | 419.649 | 1.385 | HYPOX_O2_HCT116 |
| 1658 | TIA1 | SEQ ID NO. 829 | 82.226 | | 89.304 | 1.086 | HYPOX_O2_HT1080 |
| 1659 | UNC13B | SEQ ID NO. 830 | 0.149 | | 0.221 | 1.481 | HYPOX_DFO_HCT116 |
| 1660 | UNC13B | SEQ ID NO. 830 | 0.178 | | 0.169 | 0.95 | HYPOX_DFO_HT1080 |
| 1661 | UNC13B | SEQ ID NO. 830 | 0.149 | | 0.312 | 2.094 | HYPOX_O2_HCT116 |
| 1662 | UNC13B | SEQ ID NO. 830 | 0.178 | | 0.078 | 0.437 | HYPOX_O2_HT1080 |
| 1663 | MAL | SEQ ID NO. 831 | 144.366 | | 31.118 | 0.216 | HYPOX_DFO_HCT116 |
| 1664 | MAL | SEQ ID NO. 831 | 9.189 | | 2.883 | 0.314 | HYPOX_DFO_HT1080 |
| 1665 | MAL | SEQ ID NO. 831 | 144.366 | | 78.614 | 0.545 | HYPOX_O2_HCT116 |
| 1666 | MAL | SEQ ID NO. 831 | 9.189 | | 8.119 | 0.884 | HYPOX_O2_HT1080 |
| 1667 | PDCD5 | SEQ ID NO. 832 | 204.137 | | 165.355 | 0.81 | HYPOX_DFO_HCT116 |
| 1668 | PDCD5 | SEQ ID NO. 832 | 27.557 | | 29.042 | 1.054 | HYPOX_DFO_HT1080 |
| 1669 | PDCD5 | SEQ ID NO. 832 | 204.137 | | 196.64 | 0.963 | HYPOX_O2_HCT116 |
| 1670 | PDCD5 | SEQ ID NO. 832 | 27.557 | | 28.62 | 1.039 | HYPOX_O2_HT1080 |
| 1671 | TGFB1 | SEQ ID NO. 833 | 264.355 | | 100.138 | 0.379 | HYPOX_DFO_HCT116 |
| 1672 | TGFB1 | SEQ ID NO. 833 | 14.715 | | 9.42 | 0.64 | HYPOX_DFO_HT1080 |
| 1673 | TGFB1 | SEQ ID NO. 833 | 264.355 | | 179.109 | 0.678 | HYPOX_O2_HCT116 |
| 1674 | TGFB3 | SEQ ID NO. 834 | 14.715 | | 10.569 | 0.718 | HYPOX_O2_HT1080 |
| 1675 | TGFB3 | SEQ ID NO. 834 | 18.804 | | 11.518 | 0.613 | HYPOX_DFO_HCT116 |
| 1676 | TGFB3 | SEQ ID NO. 834 | 1.248 | | 1.873 | 1.501 | HYPOX_DFO_HT1080 |
| 1677 | TGFB3 | SEQ ID NO. 834 | 18.804 | | 17.832 | 0.948 | HYPOX_O2_HCT116 |
| 1678 | TGFB3 | SEQ ID NO. 834 | 1.248 | | 1.327 | 1.063 | HYPOX_O2_HT1080 |
| 1679 | AK3L1 | SEQ ID NO. 835 | 341.45 | | 161.704 | 0.474 | HYPOX_DFO_HCT116 |
| 1680 | AK3L1 | SEQ ID NO. 835 | 7.854 | | 7.284 | 0.927 | HYPOX_DFO_HT1080 |
| 1681 | AK3L1 | SEQ ID NO. 835 | 341.45 | | 366.508 | 1.073 | HYPOX_O2_HCT116 |
| 1682 | AK3L1 | SEQ ID NO. 835 | 7.854 | | 8.435 | 1.074 | HYPOX_O2_HT1080 |
| 1683 | IL6R | SEQ ID NO. 836 | 184.451 | | 120.445 | 0.653 | HYPOX_DFO_HCT116 |
| 1684 | IL6R | SEQ ID NO. 836 | 10.877 | | 15.267 | 1.404 | HYPOX_DFO_HT1080 |
| 1685 | IL6R | SEQ ID NO. 836 | 184.451 | | 136.139 | 0.738 | HYPOX_O2_HCT116 |
| 1686 | IL6R | SEQ ID NO. 836 | 10.877 | | 8.675 | 0.798 | HYPOX_O2_HT1080 |
| 1687 | FRAP1 | SEQ ID NO. 837 | 2039.937 | | 1766.092 | 0.866 | HYPOX_DFO_HCT116 |
| 1688 | FRAP1 | SEQ ID NO. 837 | 624.997 | | 494.315 | 0.791 | HYPOX_DFO_HT1080 |
| 1689 | FRAP1 | SEQ ID NO. 837 | 2039.937 | | 1397.246 | 0.685 | HYPOX_O2_HCT116 |
| 1690 | FRAP1 | SEQ ID NO. 837 | 624.997 | | 412.291 | 0.66 | HYPOX_O2_HT1080 |

FIG. 1AX — TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_WI TH_INDUCTION | INDUCTION RATIO | INDUCTION_CONDITIONS* |
|---|---|---|---|---|---|---|
| 1691 | CSF3R | SEQ ID NO. 838 | 13.778 | 3.076 | 0.223 | HYPOX_DFO_HCT116 |
| 1692 | CSF3R | SEQ ID NO. 838 | 0.861 | 0.584 | 0.679 | HYPOX_DFO_HT1080 |
| 1693 | CSF3R | SEQ ID NO. 838 | 13.778 | 7.582 | 0.549 | HYPOX_O2_HCT116 |
| 1694 | CSF3R | SEQ ID NO. 838 | 0.861 | 1.033 | 1.199 | HYPOX_O2_HT1080 |
| 1695 | MTF1 | SEQ ID NO. 839 | 613.654 | 1507.51 | 2.457 | HYPOX_DFO_HCT116 |
| 1696 | MTF1 | SEQ ID NO. 839 | 464.87 | 486.958 | 1.048 | HYPOX_DFO_HT1080 |
| 1697 | MTF1 | SEQ ID NO. 839 | 613.654 | 1648.029 | 2.686 | HYPOX_O2_HCT116 |
| 1698 | MTF1 | SEQ ID NO. 839 | 464.87 | 297.5 | 0.64 | HYPOX_O2_HT1080 |
| 1699 | SLC2A1 | SEQ ID NO. 840 | 1188.879 | 570.049 | 0.479 | HYPOX_DFO_HCT116 |
| 1700 | SLC2A1 | SEQ ID NO. 840 | 34.668 | 27.112 | 0.782 | HYPOX_DFO_HT1080 |
| 1701 | SLC2A1 | SEQ ID NO. 840 | 1188.879 | 714.146 | 0.601 | HYPOX_O2_HCT116 |
| 1702 | SLC2A1 | SEQ ID NO. 840 | 34.668 | 27.765 | 0.801 | HYPOX_O2_HT1080 |
| 1703 | JUN | SEQ ID NO. 840 | 3771.193 | 8604.946 | 2.282 | HYPOX_DFO_HCT116 |
| 1704 | JUN | SEQ ID NO. 840 | 339.624 | 379.78 | 1.118 | HYPOX_DFO_HT1080 |
| 1705 | JUN | SEQ ID NO. 840 | 3771.193 | 4231.05 | 1.122 | HYPOX_O2_HCT116 |
| 1706 | JUN | SEQ ID NO. 840 | 339.624 | 227.487 | 0.669 | HYPOX_O2_HT1080 |
| 1707 | F3 | SEQ ID NO. 841 | 392.08 | 120.513 | 0.307 | HYPOX_DFO_HCT116 |
| 1708 | F3 | SEQ ID NO. 841 | 7.698 | 5.646 | 0.733 | HYPOX_DFO_HT1080 |
| 1709 | F3 | SEQ ID NO. 841 | 392.08 | 243.673 | 0.621 | HYPOX_O2_HCT116 |
| 1710 | F3 | SEQ ID NO. 841 | 7.698 | 3.959 | 0.514 | HYPOX_O2_HT1080 |
| 1711 | ARNT | SEQ ID NO. 842 | 228.591 | 242.747 | 1.062 | HYPOX_DFO_HCT116 |
| 1712 | ARNT | SEQ ID NO. 842 | 41.997 | 29.643 | 0.706 | HYPOX_DFO_HT1080 |
| 1713 | ARNT | SEQ ID NO. 842 | 228.591 | 185.127 | 0.81 | HYPOX_O2_HCT116 |
| 1714 | ARNT | SEQ ID NO. 842 | 41.997 | 38.969 | 0.928 | HYPOX_O2_HT1080 |
| 1715 | PTGS2 | SEQ ID NO. 842 | 918.171 | 399.603 | 0.435 | HYPOX_DFO_HCT116 |
| 1716 | PTGS2 | SEQ ID NO. 842 | 49.388 | 66.054 | 1.337 | HYPOX_DFO_HT1080 |
| 1717 | PTGS2 | SEQ ID NO. 842 | 918.171 | 626.35 | 0.682 | HYPOX_O2_HCT116 |
| 1718 | PTGS2 | SEQ ID NO. 842 | 49.388 | 40.904 | 0.828 | HYPOX_O2_HT1080 |
| 1719 | AGT | SEQ ID NO. 842 | 45.81 | 22.013 | 0.481 | HYPOX_DFO_HCT116 |
| 1720 | AGT | SEQ ID NO. 842 | 4.575 | 4.883 | 1.067 | HYPOX_DFO_HT1080 |
| 1721 | AGT | SEQ ID NO. 842 | 45.81 | 26.979 | 0.589 | HYPOX_O2_HCT116 |
| 1722 | AGT | SEQ ID NO. 842 | 4.575 | 2.546 | 0.556 | HYPOX_O2_HT1080 |
| 1723 | HK1 | SEQ ID NO. 843 | 26.626 | 99.91 | 3.752 | HYPOX_DFO_HCT116 |
| 1724 | HK1 | SEQ ID NO. 843 | 7.293 | 14.512 | 1.99 | HYPOX_DFO_HT1080 |
| 1725 | HK1 | SEQ ID NO. 843 | 26.626 | 53.462 | 2.008 | HYPOX_O2_HCT116 |
| 1726 | HK1 | SEQ ID NO. 843 | 7.293 | 8.675 | 1.19 | HYPOX_O2_HT1080 |
| 1727 | PTEN | SEQ ID NO. 844 | 227.268 | 117.348 | 0.516 | HYPOX_DFO_HCT116 |
| 1728 | PTEN | SEQ ID NO. 844 | 56.62 | 46.917 | 0.829 | HYPOX_DFO_HT1080 |
| 1729 | PTEN | SEQ ID NO. 844 | 227.268 | 190.362 | 0.838 | HYPOX_O2_HCT116 |
| 1730 | PTEN | SEQ ID NO. 844 | 56.62 | 49.176 | 0.869 | HYPOX_O2_HT1080 |
| 1731 | HIF1AN | SEQ ID NO. 845 | 484.862 | 421.98 | 0.87 | HYPOX_DFO_HCT116 |
| 1732 | HIF1AN | SEQ ID NO. 845 | 114.018 | 115.961 | 1.017 | HYPOX_DFO_HT1080 |
| 1733 | HIF1AN | SEQ ID NO. 845 | 484.862 | 520.217 | 1.073 | HYPOX_O2_HCT116 |
| 1734 | HIF1AN | SEQ ID NO. 845 | 114.018 | 110.158 | 0.966 | HYPOX_O2_HT1080 |

FIG. 1AY -- TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS* |
|---|---|---|---|---|---|---|
| 1735 | ADRA2A | SEQ ID NO. 846 | 435.353 | 143.577 | 0.33 | HYPOX_DFO_HCT116 |
| 1736 | ADRA2A | SEQ ID NO. 846 | 25.003 | 17.451 | 0.698 | HYPOX_DFO_HT1080 |
| 1737 | ADRA2A | SEQ ID NO. 846 | 435.353 | 349.18 | 0.802 | HYPOX_O2_HCT116 |
| 1738 | ADRA2A | SEQ ID NO. 846 | 25.003 | 17.27 | 0.691 | HYPOX_O2_HT1080 |
| 1739 | ADRB1 | SEQ ID NO. 846 | 132.53 | 148.251 | 1.119 | HYPOX_DFO_HCT116 |
| 1740 | ADRB1 | SEQ ID NO. 846 | 4.9 | 5.241 | 1.07 | HYPOX_DFO_HT1080 |
| 1741 | ADRB1 | SEQ ID NO. 846 | 132.53 | 122.723 | 0.926 | HYPOX_O2_HCT116 |
| 1742 | ADRB1 | SEQ ID NO. 846 | 4.9 | 3.483 | 0.711 | HYPOX_O2_HT1080 |
| 1743 | ECD | SEQ ID NO. 847 | 2755.225 | 5387.427 | 1.955 | HYPOX_DFO_HCT116 |
| 1744 | ECD | SEQ ID NO. 847 | 953.617 | 930.919 | 0.976 | HYPOX_DFO_HT1080 |
| 1745 | ECD | SEQ ID NO. 847 | 2755.225 | 3490.9 | 1.267 | HYPOX_O2_HCT116 |
| 1746 | ECD | SEQ ID NO. 847 | 953.617 | 711.025 | 0.746 | HYPOX_O2_HT1080 |
| 1747 | ADM | SEQ ID NO. 847 | 1632.623 | 1178.436 | 0.722 | HYPOX_DFO_HCT116 |
| 1748 | ADM | SEQ ID NO. 847 | 63.178 | 52.122 | 0.825 | HYPOX_DFO_HT1080 |
| 1749 | ADM | SEQ ID NO. 847 | 1632.623 | 1397.003 | 0.858 | HYPOX_O2_HCT116 |
| 1750 | ADM | SEQ ID NO. 847 | 63.178 | 64.836 | 1.023 | HYPOX_O2_HT1080 |
| 1751 | LDHAL6A | SEQ ID NO. 848 | 81.23 | 83.849 | 1.032 | HYPOX_DFO_HCT116 |
| 1752 | LDHAL6A | SEQ ID NO. 848 | 1.563 | 1.965 | 1.257 | HYPOX_DFO_HT1080 |
| 1753 | LDHAL6A | SEQ ID NO. 848 | 81.23 | 122.568 | 1.509 | HYPOX_O2_HCT116 |
| 1754 | LDHAL6A | SEQ ID NO. 848 | 1.563 | 1.409 | 0.901 | HYPOX_O2_HT1080 |
| 1755 | LDHC | SEQ ID NO. 849 | 402.533 | 359.038 | 0.892 | HYPOX_DFO_HCT116 |
| 1756 | LDHC | SEQ ID NO. 849 | 7.613 | 13.416 | 1.762 | HYPOX_DFO_HT1080 |
| 1757 | LDHC | SEQ ID NO. 849 | 402.533 | 361.346 | 0.898 | HYPOX_O2_HCT116 |
| 1758 | LDHC | SEQ ID NO. 849 | 7.613 | 8.29 | 1.089 | HYPOX_O2_HT1080 |
| 1759 | CAT | SEQ ID NO. 849 | 666.498 | 147.715 | 0.222 | HYPOX_DFO_HCT116 |
| 1760 | CAT | SEQ ID NO. 849 | 47.693 | 21.731 | 0.456 | HYPOX_DFO_HT1080 |
| 1761 | CAT | SEQ ID NO. 849 | 666.498 | 213.466 | 0.32 | HYPOX_O2_HCT116 |
| 1762 | CAT | SEQ ID NO. 849 | 47.693 | 36.612 | 0.768 | HYPOX_O2_HT1080 |
| 1763 | IGF2 | SEQ ID NO. 850 | 1713.64 | 720.854 | 0.421 | HYPOX_DFO_HCT116 |
| 1764 | IGF2 | SEQ ID NO. 850 | 65.375 | 34.835 | 0.533 | HYPOX_DFO_HT1080 |
| 1765 | IGF2 | SEQ ID NO. 850 | 1713.64 | 1488.754 | 0.869 | HYPOX_O2_HCT116 |
| 1766 | IGF2 | SEQ ID NO. 850 | 65.375 | 53.836 | 0.823 | HYPOX_O2_HT1080 |
| 1767 | KCNA4 | SEQ ID NO. 851 | 260.917 | 53.218 | 0.204 | HYPOX_DFO_HCT116 |
| 1768 | KCNA4 | SEQ ID NO. 851 | 1.778 | 1.718 | 0.966 | HYPOX_DFO_HT1080 |
| 1769 | KCNA4 | SEQ ID NO. 851 | 260.917 | 135.262 | 0.518 | HYPOX_O2_HCT116 |
| 1770 | KCNA4 | SEQ ID NO. 851 | 1.778 | 1.487 | 0.836 | HYPOX_O2_HT1080 |
| 1771 | CASP1 | SEQ ID NO. 852 | 19.627 | 24.107 | 1.228 | HYPOX_DFO_HCT116 |
| 1772 | CASP1 | SEQ ID NO. 852 | 7.681 | 4.248 | 0.553 | HYPOX_DFO_HT1080 |
| 1773 | CASP1 | SEQ ID NO. 852 | 19.627 | 13.113 | 0.668 | HYPOX_O2_HCT116 |
| 1774 | CASP1 | SEQ ID NO. 852 | 7.681 | 3.32 | 0.432 | HYPOX_O2_HT1080 |
| 1775 | IL18 | SEQ ID NO. 853 | 502.713 | 255.634 | 0.509 | HYPOX_DFO_HCT116 |
| 1776 | IL18 | SEQ ID NO. 853 | 36.472 | 20.050 | 0.55 | HYPOX_DFO_HT1080 |
| 1777 | IL18 | SEQ ID NO. 853 | 502.713 | 247.723 | 0.493 | HYPOX_O2_HCT116 |
| 1778 | IL18 | SEQ ID NO. 853 | 36.472 | 24.163 | 0.662 | HYPOX_O2_HT1080 |
| 1779 | GAPDH | SEQ ID NO. 854 | 7.087 | 4.752 | 0.671 | HYPOX_DFO_HCT116 |
| 1780 | GAPDH | SEQ ID NO. 854 | 1.161 | 0.696 | 0.6 | HYPOX_DFO_HT1080 |
| 1781 | GAPDH | SEQ ID NO. 854 | 7.087 | 5.908 | 0.834 | HYPOX_O2_HCT116 |
| 1782 | GAPDH | SEQ ID NO. 854 | 1.161 | 0.988 | 0.851 | HYPOX_O2_HT1080 |

FIG. 1AZ -- TABLE 1 TRANSCRIPTIONAL BIOMARKER FUNCTIONAL DATA
SECTION 1A

| LINE_ID | GENE_SYMBOL | SEQUENCE_ID_LISTING | PRGM_ACTIVITY_N O_INDUCTION | PRGM_ACTIVITY_W I_INDUCTION | INDUCTION_RATIO | INDUCTION_CONDITIONS* |
|---|---|---|---|---|---|---|
| 1783 | PFKM | SEQ ID NO. 855 | 772.151 | 172.784 | 0.224 | HYPOX_DFO_HCT116 |
| 1784 | PFKM | SEQ ID NO. 855 | 28.707 | 15.655 | 0.545 | HYPOX_DFO_HT1080 |
| 1785 | PFKM | SEQ ID NO. 855 | 772.161 | 398.773 | 0.516 | HYPOX_O2_HCT116 |
| 1786 | PFKM | SEQ ID NO. 855 | 28.707 | 22.076 | 0.769 | HYPOX_O2_HT1080 |
| 1787 | PFKM | SEQ ID NO. 856 | 11.126 | 7.62 | 0.685 | HYPOX_DFO_HCT116 |
| 1788 | PFKM | SEQ ID NO. 856 | 0.603 | 0.512 | 0.849 | HYPOX_DFO_HT1080 |
| 1789 | PFKM | SEQ ID NO. 856 | 11.126 | 6.257 | 0.562 | HYPOX_O2_HCT116 |
| 1790 | PFKM | SEQ ID NO. 856 | 0.603 | 0.471 | 0.781 | HYPOX_O2_HT1080 |
| 1791 | MEM2 | SEQ ID NO. 857 | 2131.907 | 3407.374 | 1.598 | HYPOX_DFO_HCT116 |
| 1792 | MEM2 | SEQ ID NO. 857 | 592.113 | 688.121 | 1.162 | HYPOX_DFO_HT1080 |
| 1793 | MEM2 | SEQ ID NO. 857 | 2131.907 | 3600.856 | 1.689 | HYPOX_O2_HCT116 |
| 1794 | MEM2 | SEQ ID NO. 857 | 592.113 | 372.203 | 0.629 | HYPOX_O2_HT1080 |
| 1795 | APAF1 | SEQ ID NO. 858 | 879.918 | 784.022 | 0.891 | HYPOX_DFO_HCT116 |
| 1796 | APAF1 | SEQ ID NO. 858 | 47.699 | 88.002 | 1.845 | HYPOX_DFO_HT1080 |
| 1797 | APAF1 | SEQ ID NO. 858 | 879.918 | 817.92 | 0.93 | HYPOX_O2_HCT116 |
| 1798 | APAF1 | SEQ ID NO. 858 | 47.699 | 96.522 | 2.024 | HYPOX_O2_HT1080 |
| 1799 | TXNRD1 | SEQ ID NO. 859 | 1109.053 | 1167.674 | 1.053 | HYPOX_DFO_HCT116 |
| 1800 | TXNRD1 | SEQ ID NO. 859 | 558.644 | 658.863 | 1.179 | HYPOX_DFO_HT1080 |
| 1801 | TXNRD1 | SEQ ID NO. 859 | 1109.053 | 1020.445 | 0.92 | HYPOX_O2_HCT116 |
| 1802 | TXNRD1 | SEQ ID NO. 859 | 558.644 | 371.001 | 0.664 | HYPOX_O2_HT1080 |
| 1803 | TXNRD1 | SEQ ID NO. 860 | 75.051 | 35.023 | 0.467 | HYPOX_DFO_HCT116 |
| 1804 | TXNRD1 | SEQ ID NO. 860 | 5.445 | 3.441 | 0.632 | HYPOX_DFO_HT1080 |
| 1805 | TXNRD1 | SEQ ID NO. 860 | 75.051 | 59.927 | 0.788 | HYPOX_O2_HCT116 |
| 1806 | TXNRD1 | SEQ ID NO. 860 | 5.445 | 4.669 | 0.857 | HYPOX_O2_HT1080 |
| 1807 | LDHB | SEQ ID NO. 861 | 1720.178 | 480.211 | 0.279 | HYPOX_DFO_HCT116 |
| 1808 | LDHB | SEQ ID NO. 861 | 111.56 | 83.096 | 0.747 | HYPOX_DFO_HT1080 |
| 1809 | LDHB | SEQ ID NO. 861 | 1720.178 | 875.048 | 0.509 | HYPOX_O2_HCT116 |
| 1810 | LDHB | SEQ ID NO. 861 | 111.56 | 77.509 | 0.695 | HYPOX_O2_HT1080 |
| 1811 | IGF1 | SEQ ID NO. 862 | 2.208 | 3.899 | 1.766 | HYPOX_DFO_HCT116 |
| 1812 | IGF1 | SEQ ID NO. 862 | 0.373 | 1.058 | 2.838 | HYPOX_DFO_HT1080 |
| 1813 | IGF1 | SEQ ID NO. 862 | 2.208 | 2.499 | 1.132 | HYPOX_O2_HCT116 |
| 1814 | IGF1 | SEQ ID NO. 862 | 0.373 | 0.197 | 0.527 | HYPOX_O2_HT1080 |
| 1815 | NOS1 | SEQ ID NO. 863 | 15.193 | 12.093 | 0.797 | HYPOX_DFO_HCT116 |
| 1816 | NOS1 | SEQ ID NO. 863 | 1.224 | 1.569 | 1.282 | HYPOX_DFO_HT1080 |
| 1817 | NOS1 | SEQ ID NO. 863 | 15.193 | 9.493 | 0.625 | HYPOX_O2_HCT116 |
| 1818 | NOS1 | SEQ ID NO. 863 | 1.224 | 1.245 | 1.017 | HYPOX_O2_HT1080 |
| 1819 | FLT1 | SEQ ID NO. 864 | 919.31 | 551.334 | 0.6 | HYPOX_DFO_HCT116 |
| 1820 | FLT1 | SEQ ID NO. 864 | 32.821 | 18.859 | 0.575 | HYPOX_DFO_HT1080 |
| 1821 | FLT1 | SEQ ID NO. 864 | 919.31 | 1094.631 | 1.191 | HYPOX_O2_HCT116 |
| 1822 | FLT1 | SEQ ID NO. 864 | 32.821 | 19.479 | 0.593 | HYPOX_O2_HT1080 |
| 1823 | HIF1A | SEQ ID NO. 865 | 1305.846 | 485.707 | 0.371 | HYPOX_DFO_HCT116 |
| 1824 | HIF1A | SEQ ID NO. 865 | 34.823 | 20.006 | 0.58 | HYPOX_DFO_HT1080 |
| 1825 | HIF1A | SEQ ID NO. 865 | 1305.846 | 708.181 | 0.542 | HYPOX_O2_HCT116 |
| 1826 | HIF1A | SEQ ID NO. 865 | 34.823 | 21.603 | 0.62 | HYPOX_O2_HT1080 |
| 1827 | FOS | SEQ ID NO. 865 | 3592.943 | 14086.928 | 3.921 | HYPOX_DFO_HCT116 |
| 1828 | FOS | SEQ ID NO. 865 | 191.894 | 246.115 | 1.283 | HYPOX_DFO_HT1080 |
| 1829 | FOS | SEQ ID NO. 865 | 3592.943 | 4347.594 | 1.21 | HYPOX_O2_HCT116 |
| 1830 | FOS | SEQ ID NO. 865 | 191.894 | 118.594 | 0.618 | HYPOX_O2_HT1080 |

FIG. 1BA -- TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS |
|---|---|---|---|---|---|---|
| 1831 | EGLN3 | SEQ ID NO. 866 | 2371.351 | 1716.901 | 0.724 | HYPOX_DFO_HCT116 |
| 1833 | EGLN3 | SEQ ID NO. 866 | 141.384 | 79.107 | 0.56 | HYPOX_DFO_HT1080 |
| 1833 | EGLN3 | SEQ ID NO. 866 | 2371.351 | 1877.831 | 0.771 | HYPOX_O2_HCT116 |
| 1834 | EGLN3 | SEQ ID NO. 866 | 141.384 | 74.335 | 0.526 | HYPOX_O2_HT1080 |
| 1835 | HSP90AA1 | SEQ ID NO. 867 | 2236.906 | 5999.511 | 2.682 | HYPOX_DFO_HCT116 |
| 1836 | HSP90AA1 | SEQ ID NO. 867 | 771.162 | 628.314 | 0.814 | HYPOX_DFO_HT1080 |
| 1837 | HSP90AA1 | SEQ ID NO. 867 | 2236.906 | 4040.41 | 1.806 | HYPOX_O2_HCT116 |
| 1838 | HSP90AA1 | SEQ ID NO. 867 | 771.162 | 656.018 | 0.85 | HYPOX_O2_HT1080 |
| 1839 | LDHA.6B | SEQ ID NO. 868 | 92.568 | 49.901 | 0.539 | HYPOX_DFO_HCT116 |
| 1840 | LDHA.6B | SEQ ID NO. 868 | 2.713 | 3.409 | 1.256 | HYPOX_DFO_HT1080 |
| 1841 | LDHA.6B | SEQ ID NO. 868 | 92.568 | 183.843 | 1.986 | HYPOX_O2_HCT116 |
| 1842 | LDHA.6B | SEQ ID NO. 868 | 2.713 | 2.467 | 0.909 | HYPOX_O2_HT1080 |
| 1843 | MAP2K1 | SEQ ID NO. 869 | 837.066 | 725.493 | 0.867 | HYPOX_DFO_HCT116 |
| 1844 | MAP2K1 | SEQ ID NO. 869 | 127.602 | 128.883 | 1.008 | HYPOX_DFO_HT1080 |
| 1845 | MAP2K1 | SEQ ID NO. 869 | 837.066 | 1148.865 | 1.372 | HYPOX_O2_HCT116 |
| 1846 | MAP2K1 | SEQ ID NO. 869 | 127.602 | 104.191 | 0.817 | HYPOX_O2_HT1080 |
| 1847 | ARPP-19 | SEQ ID NO. 870 | 29.714 | 71.32 | 2.4 | HYPOX_DFO_HCT116 |
| 1848 | ARPP-19 | SEQ ID NO. 870 | 9.104 | 13.958 | 1.533 | HYPOX_DFO_HT1080 |
| 1849 | ARPP-19 | SEQ ID NO. 870 | 29.714 | 33.075 | 1.113 | HYPOX_O2_HCT116 |
| 1850 | ARPP-19 | SEQ ID NO. 870 | 9.104 | 8.192 | 0.9 | HYPOX_O2_HT1080 |
| 1851 | ARPP-19 | SEQ ID NO. 871 | 7.745 | 3.595 | 0.464 | HYPOX_DFO_HCT116 |
| 1852 | ARPP-19 | SEQ ID NO. 871 | 0.636 | 0.516 | 0.812 | HYPOX_DFO_HT1080 |
| 1853 | ARPP-19 | SEQ ID NO. 871 | 7.745 | 3.033 | 0.392 | HYPOX_O2_HCT116 |
| 1854 | ARPP-19 | SEQ ID NO. 871 | 0.636 | 0.638 | 1.002 | HYPOX_O2_HT1080 |
| 1855 | PKM2 | SEQ ID NO. 872 | 2042.598 | 673.687 | 0.33 | HYPOX_DFO_HCT116 |
| 1856 | PKM2 | SEQ ID NO. 872 | 58.284 | 29.727 | 0.51 | HYPOX_DFO_HT1080 |
| 1857 | PKM2 | SEQ ID NO. 872 | 2042.598 | 928.572 | 0.455 | HYPOX_O2_HCT116 |
| 1858 | PKM2 | SEQ ID NO. 872 | 58.284 | 36.208 | 0.621 | HYPOX_O2_HT1080 |
| 1859 | SELS | SEQ ID NO. 873 | 370.915 | 407.612 | 1.099 | HYPOX_DFO_HCT116 |
| 1860 | SELS | SEQ ID NO. 873 | 57.614 | 39.27 | 0.682 | HYPOX_DFO_HT1080 |
| 1861 | SELS | SEQ ID NO. 873 | 370.915 | 565.222 | 1.524 | HYPOX_O2_HCT116 |
| 1862 | SELS | SEQ ID NO. 873 | 57.614 | 38.37 | 0.666 | HYPOX_O2_HT1080 |
| 1863 | ALDOA | SEQ ID NO. 874 | 153.604 | 79.53 | 0.518 | HYPOX_DFO_HCT116 |
| 1864 | ALDOA | SEQ ID NO. 874 | 12.131 | 9.209 | 0.759 | HYPOX_DFO_HT1080 |
| 1865 | ALDOA | SEQ ID NO. 874 | 153.604 | 126.043 | 0.821 | HYPOX_O2_HCT116 |
| 1866 | ALDOA | SEQ ID NO. 874 | 12.131 | 12.024 | 0.991 | HYPOX_O2_HT1080 |
| 1867 | CREB3P | SEQ ID NO. 875 | 1924.826 | 4591.522 | 2.385 | HYPOX_DFO_HCT116 |
| 1868 | CREB3P | SEQ ID NO. 875 | 473.698 | 495.058 | 1.045 | HYPOX_DFO_HT1080 |
| 1869 | CREB3P | SEQ ID NO. 875 | 1924.826 | 1964.278 | 1.02 | HYPOX_O2_HCT116 |
| 1870 | CREB3P | SEQ ID NO. 875 | 473.698 | 517.468 | 1.092 | HYPOX_O2_HT1080 |
| 1871 | CHMP1A | SEQ ID NO. 876 | 2056.979 | 2751.415 | 1.338 | HYPOX_DFO_HCT116 |
| 1872 | CHMP1A | SEQ ID NO. 876 | 670.388 | 614.016 | 0.916 | HYPOX_DFO_HT1080 |
| 1873 | CHMP1A | SEQ ID NO. 876 | 2056.979 | 2228.184 | 1.083 | HYPOX_O2_HCT116 |
| 1874 | CHMP1A | SEQ ID NO. 876 | 670.388 | 567.429 | 0.846 | HYPOX_O2_HT1080 |
| 1875 | CCL2 | SEQ ID NO. 877 | 12.524 | 9.749 | 0.778 | HYPOX_DFO_HCT116 |
| 1876 | CCL2 | SEQ ID NO. 877 | 2.016 | 2.581 | 1.28 | HYPOX_DFO_HT1080 |
| 1877 | CCL2 | SEQ ID NO. 877 | 12.524 | 9.657 | 0.771 | HYPOX_O2_HCT116 |
| 1878 | CCL2 | SEQ ID NO. 877 | 2.016 | 1.496 | 0.742 | HYPOX_O2_HT1080 |

FIG. 1BB -- TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_WI TH_INDUCTION | INDUCTION RATIO | INDUCTION_CONDITIONS* |
|---|---|---|---|---|---|---|
| 1879 | CCL4 | SEQ ID NO. 878 | 9.427 | 4.509 | 0.478 | HYPOX_DFO_HCT116 |
| 1880 | CCL4 | SEQ ID NO. 878 | 2.145 | 2.165 | 1.009 | HYPOX_DFO_HT1080 |
| 1881 | CCL4 | SEQ ID NO. 878 | 9.427 | 9.158 | 0.971 | HYPOX_O2_HCT116 |
| 1882 | CCL4 | SEQ ID NO. 878 | 2.145 | 2.158 | 1.006 | HYPOX_O2_HT1080 |
| 1883 | EPX | SEQ ID NO. 879 | 106.884 | 19.771 | 0.185 | HYPOX_DFO_HCT116 |
| 1884 | EPX | SEQ ID NO. 879 | 7.178 | 5.478 | 0.763 | HYPOX_DFO_HT1080 |
| 1885 | EPX | SEQ ID NO. 879 | 106.884 | 70.219 | 0.657 | HYPOX_O2_HCT116 |
| 1886 | EPX | SEQ ID NO. 879 | 7.178 | 5.515 | 0.768 | HYPOX_O2_HT1080 |
| 1887 | ACE | SEQ ID NO. 880 | 601.343 | 173.421 | 0.288 | HYPOX_DFO_HCT116 |
| 1888 | ACE | SEQ ID NO. 880 | 77.903 | 31.193 | 0.4 | HYPOX_DFO_HT1080 |
| 1889 | ACE | SEQ ID NO. 880 | 601.343 | 344.845 | 0.573 | HYPOX_O2_HCT116 |
| 1890 | ACE | SEQ ID NO. 880 | 77.903 | 72.479 | 0.93 | HYPOX_O2_HT1080 |
| 1891 | ACE | SEQ ID NO. 881 | 70.286 | 60.57 | 0.862 | HYPOX_DFO_HCT116 |
| 1892 | ACE | SEQ ID NO. 881 | 4.17 | 2.25 | 0.54 | HYPOX_DFO_HT1080 |
| 1893 | ACE | SEQ ID NO. 881 | 70.286 | 46.711 | 0.665 | HYPOX_O2_HCT116 |
| 1894 | ACE | SEQ ID NO. 881 | 4.17 | 3.239 | 0.777 | HYPOX_O2_HT1080 |
| 1895 | TP53 | SEQ ID NO. 881 | 506.523 | 336.607 | 0.665 | HYPOX_DFO_HCT116 |
| 1896 | TP53 | SEQ ID NO. 881 | 67.6 | 82.848 | 1.226 | HYPOX_DFO_HT1080 |
| 1897 | TP53 | SEQ ID NO. 881 | 506.523 | 341.333 | 0.674 | HYPOX_O2_HCT116 |
| 1898 | TP53 | SEQ ID NO. 881 | 67.6 | 56.559 | 0.837 | HYPOX_O2_HT1080 |
| 1899 | NOS2A | SEQ ID NO. 881 | 53.847 | 18.337 | 0.341 | HYPOX_DFO_HCT116 |
| 1900 | NOS2A | SEQ ID NO. 881 | 3.555 | 3.248 | 0.914 | HYPOX_DFO_HT1080 |
| 1901 | NOS2A | SEQ ID NO. 881 | 53.847 | 26.666 | 0.495 | HYPOX_O2_HCT116 |
| 1902 | NOS2A | SEQ ID NO. 881 | 3.555 | 2.185 | 0.615 | HYPOX_O2_HT1080 |
| 1903 | CCL3 | SEQ ID NO. 882 | 3.001 | 0.611 | 0.203 | HYPOX_DFO_HCT116 |
| 1904 | CCL3 | SEQ ID NO. 882 | 0.131 | 0.157 | 1.198 | HYPOX_DFO_HT1080 |
| 1905 | CCL3 | SEQ ID NO. 882 | 3.001 | 2.896 | 0.965 | HYPOX_O2_HCT116 |
| 1906 | CCL3 | SEQ ID NO. 882 | 0.131 | 0.133 | 1.012 | HYPOX_O2_HT1080 |
| 1907 | EGLN2 | SEQ ID NO. 883 | 493.198 | 81.116 | 0.164 | HYPOX_DFO_HCT116 |
| 1908 | EGLN2 | SEQ ID NO. 883 | 65.403 | 41.764 | 0.639 | HYPOX_DFO_HT1080 |
| 1909 | EGLN2 | SEQ ID NO. 883 | 493.198 | 168.733 | 0.342 | HYPOX_O2_HCT116 |
| 1910 | EGLN2 | SEQ ID NO. 883 | 65.403 | 42.998 | 0.657 | HYPOX_O2_HT1080 |
| 1911 | HIF3A | SEQ ID NO. 884 | 64.557 | 8.893 | 0.138 | HYPOX_DFO_HCT116 |
| 1912 | HIF3A | SEQ ID NO. 884 | 1.151 | 0.422 | 0.367 | HYPOX_DFO_HT1080 |
| 1913 | HIF3A | SEQ ID NO. 884 | 64.557 | 40.964 | 0.635 | HYPOX_O2_HCT116 |
| 1914 | HIF3A | SEQ ID NO. 884 | 1.151 | 0.89 | 0.773 | HYPOX_O2_HT1080 |
| 1915 | KEAP1 | SEQ ID NO. 885 | 201.071 | 103.907 | 0.517 | HYPOX_DFO_HCT116 |
| 1916 | KEAP1 | SEQ ID NO. 885 | 31.796 | 22.444 | 0.706 | HYPOX_DFO_HT1080 |
| 1917 | KEAP1 | SEQ ID NO. 885 | 201.071 | 216.675 | 1.078 | HYPOX_O2_HCT116 |
| 1918 | KEAP1 | SEQ ID NO. 885 | 31.796 | 20.904 | 0.657 | HYPOX_O2_HT1080 |
| 1919 | IL11 | SEQ ID NO. 886 | 54.54 | 29.727 | 0.545 | HYPOX_DFO_HCT116 |
| 1920 | IL11 | SEQ ID NO. 886 | 7.589 | 6.071 | 0.8 | HYPOX_DFO_HT1080 |
| 1921 | IL11 | SEQ ID NO. 886 | 54.54 | 54.664 | 1.002 | HYPOX_O2_HCT116 |
| 1922 | IL11 | SEQ ID NO. 886 | 7.589 | 7.129 | 0.939 | HYPOX_O2_HT1080 |

FIG. 1BC -- TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N_O_INDUCTION | PROM_ACTIVITY_WI_TH_INDUCTION | PROM_ACTIVITY_WI_INDUCTION_RATIO | INDUCTION_CONDITIONS* |
|---|---|---|---|---|---|---|
| 1923 | EPAS1 | SEQ ID NO. 887 | 1211.889 | 324.132 | 0.268 | HYPOX_DFO_HCT116 |
| 1924 | EPAS1 | SEQ ID NO. 887 | 25.426 | 12.114 | 0.476 | HYPOX_DFO_HT1080 |
| 1925 | EPAS1 | SEQ ID NO. 887 | 1211.889 | 1252.773 | 1.034 | HYPOX_O2_HCT116 |
| 1926 | EPAS1 | SEQ ID NO. 887 | 25.426 | 23.849 | 0.938 | HYPOX_O2_HT1080 |
| 1927 | EPAS1 | SEQ ID NO. 888 | 2.533 | 1.159 | 0.458 | HYPOX_DFO_HCT116 |
| 1928 | EPAS1 | SEQ ID NO. 888 | 0.323 | 0.243 | 0.754 | HYPOX_DFO_HT1080 |
| 1929 | EPAS1 | SEQ ID NO. 888 | 2.533 | 1.811 | 0.715 | HYPOX_O2_HCT116 |
| 1930 | EPAS1 | SEQ ID NO. 888 | 0.323 | 0.257 | 0.795 | HYPOX_O2_HT1080 |
| 1931 | IL1R2 | SEQ ID NO. 889 | 84.014 | 22.929 | 0.273 | HYPOX_DFO_HCT116 |
| 1932 | IL1R2 | SEQ ID NO. 889 | 1.392 | 1.02 | 0.733 | HYPOX_DFO_HT1080 |
| 1933 | IL1R2 | SEQ ID NO. 889 | 84.014 | 65.739 | 0.782 | HYPOX_O2_HCT116 |
| 1934 | IL1R2 | SEQ ID NO. 889 | 1.392 | 1.076 | 0.773 | HYPOX_O2_HT1080 |
| 1935 | IL1RN | SEQ ID NO. 890 | 54.93 | 16.355 | 0.298 | HYPOX_DFO_HCT116 |
| 1936 | IL1RN | SEQ ID NO. 890 | 1.54 | 1.24 | 0.805 | HYPOX_DFO_HT1080 |
| 1937 | IL1RN | SEQ ID NO. 890 | 54.93 | 38.569 | 0.702 | HYPOX_O2_HCT116 |
| 1938 | IL1RN | SEQ ID NO. 890 | 1.54 | 1.332 | 0.865 | HYPOX_O2_HT1080 |
| 1939 | AGXT | SEQ ID NO. 891 | 246.948 | 222.317 | 0.9 | HYPOX_DFO_HCT116 |
| 1940 | AGXT | SEQ ID NO. 891 | 82.904 | 73.911 | 0.892 | HYPOX_DFO_HT1080 |
| 1941 | AGXT | SEQ ID NO. 891 | 246.948 | 207.785 | 0.841 | HYPOX_O2_HCT116 |
| 1942 | AGXT | SEQ ID NO. 891 | 82.904 | 69.639 | 0.84 | HYPOX_O2_HT1080 |
| 1943 | SOS1 | SEQ ID NO. 892 | 488.679 | 503.954 | 1.031 | HYPOX_DFO_HCT116 |
| 1944 | SOS1 | SEQ ID NO. 892 | 46.734 | 43.03 | 0.921 | HYPOX_DFO_HT1080 |
| 1945 | SOS1 | SEQ ID NO. 892 | 488.679 | 490.106 | 1.003 | HYPOX_O2_HCT116 |
| 1946 | SOS1 | SEQ ID NO. 892 | 46.734 | 29.6 | 0.633 | HYPOX_O2_HT1080 |
| 1947 | ADRA2B | SEQ ID NO. 893 | 32.047 | 15.35 | 0.479 | HYPOX_DFO_HCT116 |
| 1948 | ADRA2B | SEQ ID NO. 893 | 1.087 | 0.867 | 0.798 | HYPOX_DFO_HT1080 |
| 1949 | ADRA2B | SEQ ID NO. 893 | 32.047 | 27.966 | 0.873 | HYPOX_O2_HCT116 |
| 1950 | ADRA2B | SEQ ID NO. 893 | 1.087 | 1.072 | 0.987 | HYPOX_O2_HT1080 |
| 1951 | IL1A | SEQ ID NO. 894 | 5.975 | 2.803 | 0.469 | HYPOX_DFO_HCT116 |
| 1952 | IL1A | SEQ ID NO. 894 | 1.236 | 0.903 | 0.731 | HYPOX_DFO_HT1080 |
| 1953 | IL1A | SEQ ID NO. 894 | 5.975 | 4.939 | 0.827 | HYPOX_O2_HCT116 |
| 1954 | IL1A | SEQ ID NO. 894 | 1.236 | 0.876 | 0.709 | HYPOX_O2_HT1080 |
| 1955 | IL1B | SEQ ID NO. 895 | 56.914 | 44.189 | 0.776 | HYPOX_DFO_HCT116 |
| 1956 | IL1B | SEQ ID NO. 895 | 27.317 | 25.109 | 0.919 | HYPOX_DFO_HT1080 |
| 1957 | IL1B | SEQ ID NO. 895 | 56.914 | 43.952 | 0.772 | HYPOX_O2_HCT116 |
| 1958 | IL1B | SEQ ID NO. 895 | 27.317 | 19.532 | 0.715 | HYPOX_O2_HT1080 |
| 1959 | NFE2L2 | SEQ ID NO. 896 | 390.778 | 365.751 | 0.936 | HYPOX_DFO_HCT116 |
| 1960 | NFE2L2 | SEQ ID NO. 896 | 21.622 | 22.128 | 1.023 | HYPOX_DFO_HT1080 |
| 1961 | NFE2L2 | SEQ ID NO. 896 | 390.778 | 272.834 | 0.698 | HYPOX_O2_HCT116 |
| 1962 | NFE2L2 | SEQ ID NO. 896 | 21.622 | 17.008 | 0.79 | HYPOX_O2_HT1080 |
| 1963 | NFE2L2 | SEQ ID NO. 897 | 151.111 | 136.315 | 0.902 | HYPOX_DFO_HCT116 |
| 1964 | NFE2L2 | SEQ ID NO. 897 | 23.857 | 7.173 | 0.303 | HYPOX_DFO_HT1080 |
| 1965 | NFE2L2 | SEQ ID NO. 897 | 151.111 | 110.955 | 0.734 | HYPOX_O2_HCT116 |
| 1966 | NFE2L2 | SEQ ID NO. 897 | 23.857 | 10.752 | 0.455 | HYPOX_O2_HT1080 |
| 1967 | TOP1 | SEQ ID NO. 898 | 3150.131 | 3977.765 | 1.26 | HYPOX_DFO_HCT116 |
| 1968 | TOP1 | SEQ ID NO. 898 | 372.007 | 295.658 | 0.795 | HYPOX_DFO_HT1080 |
| 1969 | TOP1 | SEQ ID NO. 898 | 3150.131 | 4756.561 | 1.506 | HYPOX_O2_HCT116 |
| 1970 | TOP1 | SEQ ID NO. 898 | 372.007 | 252.12 | 0.678 | HYPOX_O2_HT1080 |

FIG. 1BD — TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS* |
|---|---|---|---|---|---|---|
| 1971 | MYT1 | SEQ ID NO. 899 | 144.343 | 55.154 | 0.382 | HYPOX_DFO_HCT116 |
| 1972 | MYT1 | SEQ ID NO. 899 | 20.297 | 13.031 | 0.642 | HYPOX_DFO_HT1080 |
| 1973 | MYT1 | SEQ ID NO. 899 | 144.343 | 87.224 | 0.604 | HYPOX_O2_HCT116 |
| 1974 | MYT1 | SEQ ID NO. 899 | 20.297 | 16.865 | 0.831 | HYPOX_O2_HT1080 |
| 1975 | SOD1 | SEQ ID NO. 900 | 67.701 | 41.525 | 0.613 | HYPOX_DFO_HCT116 |
| 1976 | SOD1 | SEQ ID NO. 900 | 4.692 | 3.217 | 0.686 | HYPOX_DFO_HT1080 |
| 1977 | SOD1 | SEQ ID NO. 900 | 67.701 | 49.223 | 0.727 | HYPOX_O2_HCT116 |
| 1978 | SOD1 | SEQ ID NO. 900 | 4.692 | 3.113 | 0.663 | HYPOX_O2_HT1080 |
| 1979 | HMOX1 | SEQ ID NO. 901 | 137.697 | 100.174 | 0.727 | HYPOX_DFO_HCT116 |
| 1980 | HMOX1 | SEQ ID NO. 901 | 10.081 | 5.451 | 0.541 | HYPOX_DFO_HT1080 |
| 1981 | HMOX1 | SEQ ID NO. 901 | 137.697 | 87.37 | 0.635 | HYPOX_O2_HCT116 |
| 1982 | HMOX1 | SEQ ID NO. 901 | 10.081 | 6.528 | 0.648 | HYPOX_O2_HT1080 |
| 1983 | EP300 | SEQ ID NO. 902 | 118.714 | 152.324 | 1.283 | HYPOX_DFO_HCT116 |
| 1984 | EP300 | SEQ ID NO. 902 | 9.659 | 8.007 | 0.829 | HYPOX_DFO_HT1080 |
| 1985 | EP300 | SEQ ID NO. 902 | 118.714 | 132.373 | 1.115 | HYPOX_O2_HCT116 |
| 1986 | EP300 | SEQ ID NO. 902 | 9.659 | 7.567 | 0.783 | HYPOX_O2_HT1080 |
| 1987 | EP300 | SEQ ID NO. 903 | 3699.176 | 11084.092 | 2.996 | HYPOX_DFO_HCT116 |
| 1988 | EP300 | SEQ ID NO. 903 | 860.168 | 1232.09 | 1.432 | HYPOX_DFO_HT1080 |
| 1989 | EP300 | SEQ ID NO. 903 | 3699.176 | 4326.228 | 1.17 | HYPOX_O2_HCT116 |
| 1990 | EP300 | SEQ ID NO. 903 | 860.168 | 691.373 | 0.804 | HYPOX_O2_HT1080 |
| 1991 | MAPK1 | SEQ ID NO. 904 | 83.669 | 57.398 | 0.686 | HYPOX_DFO_HCT116 |
| 1992 | MAPK1 | SEQ ID NO. 904 | 16.274 | 9.133 | 0.561 | HYPOX_DFO_HT1080 |
| 1993 | MAPK1 | SEQ ID NO. 904 | 83.669 | 42.677 | 0.51 | HYPOX_O2_HCT116 |
| 1994 | MAPK1 | SEQ ID NO. 904 | 16.274 | 15.258 | 0.938 | HYPOX_O2_HT1080 |
| 1995 | PDGFB | SEQ ID NO. 905 | 572.435 | 209.441 | 0.366 | HYPOX_DFO_HCT116 |
| 1996 | PDGFB | SEQ ID NO. 905 | 18.372 | 11.861 | 0.646 | HYPOX_DFO_HT1080 |
| 1997 | PDGFB | SEQ ID NO. 905 | 572.435 | 286.46 | 0.5 | HYPOX_O2_HCT116 |
| 1998 | PDGFB | SEQ ID NO. 905 | 18.372 | 15.748 | 0.857 | HYPOX_O2_HT1080 |
| 1999 | A4GALT | SEQ ID NO. 906 | 90.102 | 85.284 | 0.947 | HYPOX_DFO_HCT116 |
| 2000 | A4GALT | SEQ ID NO. 906 | 4.318 | 3.159 | 0.732 | HYPOX_DFO_HT1080 |
| 2001 | A4GALT | SEQ ID NO. 906 | 90.102 | 69.862 | 0.775 | HYPOX_O2_HCT116 |
| 2002 | A4GALT | SEQ ID NO. 906 | 4.318 | 4.11 | 0.952 | HYPOX_O2_HT1080 |
| 2003 | VHL | SEQ ID NO. 907 | 45.246 | 64.762 | 1.431 | HYPOX_DFO_HCT116 |
| 2004 | VHL | SEQ ID NO. 907 | 10.894 | 11.26 | 1.034 | HYPOX_DFO_HT1080 |
| 2005 | VHL | SEQ ID NO. 907 | 45.246 | 35.502 | 0.785 | HYPOX_O2_HCT116 |
| 2006 | VHL | SEQ ID NO. 907 | 10.894 | 7.78 | 0.714 | HYPOX_O2_HT1080 |
| 2007 | DAG1 | SEQ ID NO. 908 | 1103.687 | 1071.05 | 0.97 | HYPOX_DFO_HCT116 |
| 2008 | DAG1 | SEQ ID NO. 908 | 105.516 | 146.075 | 1.384 | HYPOX_DFO_HT1080 |
| 2009 | DAG1 | SEQ ID NO. 908 | 1103.687 | 1619.879 | 1.467 | HYPOX_O2_HCT116 |
| 2010 | DAG1 | SEQ ID NO. 908 | 105.516 | 176.494 | 1.673 | HYPOX_O2_HT1080 |
| 2011 | TF | SEQ ID NO. 909 | 12.857 | 4.896 | 0.381 | HYPOX_DFO_HCT116 |
| 2012 | TF | SEQ ID NO. 909 | 0.565 | 1.039 | 1.841 | HYPOX_DFO_HT1080 |
| 2013 | TF | SEQ ID NO. 909 | 12.857 | 9.696 | 0.754 | HYPOX_O2_HCT116 |
| 2014 | TF | SEQ ID NO. 909 | 0.565 | 0.479 | 0.848 | HYPOX_O2_HT1080 |
| 2015 | CP | SEQ ID NO. 910 | 12.644 | 3.652 | 0.289 | HYPOX_DFO_HCT116 |
| 2016 | CP | SEQ ID NO. 910 | 0.435 | 0.447 | 1.026 | HYPOX_DFO_HT1080 |
| 2017 | CP | SEQ ID NO. 910 | 12.644 | 5.398 | 0.427 | HYPOX_O2_HCT116 |
| 2018 | CP | SEQ ID NO. 910 | 0.435 | 0.404 | 0.929 | HYPOX_O2_HT1080 |

*FIG. 1BE* -- TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS |
|---|---|---|---|---|---|---|
| 2019 | MF12 | SEQ ID NO. 911 | 187.799 | 60.341 | 0.321 | HYPOX_DFO_HCT116 |
| 2020 | MF12 | SEQ ID NO. 911 | 15.268 | 6.108 | 0.4 | HYPOX_DFO_HT1080 |
| 2021 | MF12 | SEQ ID NO. 911 | 187.799 | 103.654 | 0.552 | HYPOX_O2_HCT116 |
| 2022 | MF12 | SEQ ID NO. 911 | 15.268 | 13.543 | 0.887 | HYPOX_O2_HT1080 |
| 2023 | NULL | SEQ ID NO. 912 | 3.519 | 1.034 | 0.294 | HYPOX_DFO_HCT116 |
| 2024 | NULL | SEQ ID NO. 912 | 0.161 | 0.091 | 0.562 | HYPOX_DFO_HT1080 |
| 2025 | NULL | SEQ ID NO. 912 | 3.519 | 1.486 | 0.422 | HYPOX_O2_HCT116 |
| 2026 | NULL | SEQ ID NO. 912 | 0.161 | 0.144 | 0.894 | HYPOX_O2_HT1080 |
| 2027 | SOD3 | SEQ ID NO. 913 | 6.125 | 3.069 | 0.501 | HYPOX_DFO_HCT116 |
| 2028 | SOD3 | SEQ ID NO. 913 | 22.335 | 16.266 | 0.723 | HYPOX_DFO_HT1080 |
| 2029 | SOD3 | SEQ ID NO. 913 | 6.125 | 3.36 | 0.549 | HYPOX_O2_HCT116 |
| 2030 | SOD3 | SEQ ID NO. 913 | 22.335 | 16.352 | 0.732 | HYPOX_O2_HT1080 |
| 2031 | IL8 | SEQ ID NO. 913 | 110.548 | 142.189 | 1.286 | HYPOX_DFO_HCT116 |
| 2032 | IL8 | SEQ ID NO. 913 | 8.642 | 15.151 | 1.753 | HYPOX_DFO_HT1080 |
| 2033 | IL8 | SEQ ID NO. 913 | 110.548 | 109.946 | 0.995 | HYPOX_O2_HCT116 |
| 2034 | IL8 | SEQ ID NO. 913 | 8.642 | 8.381 | 0.97 | HYPOX_O2_HT1080 |
| 2035 | CXCL1 | SEQ ID NO. 914 | 440.033 | 207.228 | 0.471 | HYPOX_DFO_HCT116 |
| 2036 | CXCL1 | SEQ ID NO. 914 | 59.513 | 32.253 | 0.542 | HYPOX_DFO_HT1080 |
| 2037 | CXCL1 | SEQ ID NO. 914 | 440.033 | 449.403 | 1.021 | HYPOX_O2_HCT116 |
| 2038 | CXCL1 | SEQ ID NO. 914 | 59.513 | 43.276 | 0.811 | HYPOX_O2_HT1080 |
| 2039 | EGF | SEQ ID NO. 914 | 1159.131 | 656.494 | 0.566 | HYPOX_DFO_HCT116 |
| 2040 | EGF | SEQ ID NO. 914 | 151.775 | 99.097 | 0.653 | HYPOX_DFO_HT1080 |
| 2041 | EGF | SEQ ID NO. 914 | 1159.131 | 395.994 | 0.342 | HYPOX_O2_HCT116 |
| 2042 | EGF | SEQ ID NO. 914 | 151.775 | 103.962 | 0.685 | HYPOX_O2_HT1080 |
| 2043 | CXCL2 | SEQ ID NO. 914 | 79.761 | 39.072 | 0.49 | HYPOX_DFO_HCT116 |
| 2044 | CXCL2 | SEQ ID NO. 915 | 4.732 | 2.902 | 0.613 | HYPOX_DFO_HT1080 |
| 2045 | CXCL2 | SEQ ID NO. 915 | 79.761 | 56.271 | 0.705 | HYPOX_O2_HCT116 |
| 2046 | CXCL2 | SEQ ID NO. 915 | 4.732 | 4.912 | 1.038 | HYPOX_O2_HT1080 |
| 2047 | CASP3 | SEQ ID NO. 916 | 445.691 | 680.251 | 1.526 | HYPOX_DFO_HCT116 |
| 2048 | CASP3 | SEQ ID NO. 916 | 85.469 | 116.368 | 1.362 | HYPOX_DFO_HT1080 |
| 2049 | CASP3 | SEQ ID NO. 916 | 445.691 | 310.811 | 0.697 | HYPOX_O2_HCT116 |
| 2050 | CASP3 | SEQ ID NO. 916 | 85.469 | 61.132 | 0.715 | HYPOX_O2_HT1080 |
| 2051 | KIF2A | SEQ ID NO. 917 | 972.25 | 622.5 | 0.64 | HYPOX_DFO_HCT116 |
| 2052 | KIF2A | SEQ ID NO. 917 | 165.986 | 147.116 | 0.886 | HYPOX_DFO_HT1080 |
| 2053 | KIF2A | SEQ ID NO. 917 | 972.25 | 741.795 | 0.763 | HYPOX_O2_HCT116 |
| 2054 | KIF2A | SEQ ID NO. 917 | 165.986 | 134.728 | 0.812 | HYPOX_O2_HT1080 |
| 2055 | PIK3R1 | SEQ ID NO. 918 | 2.84 | 1.347 | 0.474 | HYPOX_DFO_HCT116 |
| 2056 | PIK3R1 | SEQ ID NO. 918 | 0.262 | 0.064 | 0.244 | HYPOX_DFO_HT1080 |
| 2057 | PIK3R1 | SEQ ID NO. 918 | 2.84 | 1.382 | 0.487 | HYPOX_O2_HCT116 |
| 2058 | PIK3R1 | SEQ ID NO. 918 | 0.262 | 0.102 | 0.391 | HYPOX_O2_HT1080 |
| 2059 | CSF2 | SEQ ID NO. 919 | 73.639 | 33.193 | 0.451 | HYPOX_DFO_HCT116 |
| 2060 | CSF2 | SEQ ID NO. 919 | 6.005 | 8.041 | 1.339 | HYPOX_DFO_HT1080 |
| 2061 | CSF2 | SEQ ID NO. 919 | 73.639 | 79.048 | 1.073 | HYPOX_O2_HCT116 |
| 2062 | CSF2 | SEQ ID NO. 919 | 6.005 | 4.209 | 0.701 | HYPOX_O2_HT1080 |
| 2063 | EGR1 | SEQ ID NO. 920 | 4033.967 | 25775.884 | 6.39 | HYPOX_DFO_HCT116 |
| 2064 | EGR1 | SEQ ID NO. 920 | 300.382 | 589.113 | 1.961 | HYPOX_DFO_HT1080 |
| 2065 | EGR1 | SEQ ID NO. 920 | 4033.967 | 11565.462 | 2.867 | HYPOX_O2_HCT116 |
| 2066 | EGR1 | SEQ ID NO. 920 | 300.382 | 232.933 | 0.775 | HYPOX_O2_HT1080 |

FIG. 1BF -- TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_WI TH_INDUCTION | INDUCTION RATIO | INDUCTION_CONDITIONS* |
|---|---|---|---|---|---|---|
| 2067 | LTA | SEQ ID NO. 921 | 14.645 | 7.850 | 0.537 | HYPOX_DFO_HCT116 |
| 2068 | LTA | SEQ ID NO. 921 | 2.049 | 1.208 | 0.589 | HYPOX_DFO_HT1080 |
| 2069 | LTA | SEQ ID NO. 921 | 14.645 | 9.559 | 0.653 | HYPOX_O2_HCT116 |
| 2070 | LTA | SEQ ID NO. 921 | 2.049 | 1.54 | 0.752 | HYPOX_O2_HT1080 |
| 2071 | HSPA1A | SEQ ID NO. 921 | 1484.991 | 766.189 | 0.516 | HYPOX_DFO_HCT116 |
| 2072 | HSPA1A | SEQ ID NO. 921 | 45.433 | 31.821 | 0.7 | HYPOX_DFO_HT1080 |
| 2073 | HSPA1A | SEQ ID NO. 921 | 1484.991 | 1036.842 | 0.698 | HYPOX_O2_HCT116 |
| 2074 | HSPA1A | SEQ ID NO. 921 | 45.433 | 48.535 | 1.062 | HYPOX_O2_HT1080 |
| 2075 | HSPA1B | SEQ ID NO. 922 | 2627.228 | 2635.127 | 1.003 | HYPOX_DFO_HCT116 |
| 2076 | HSPA1B | SEQ ID NO. 922 | 268.427 | 123.009 | 0.458 | HYPOX_DFO_HT1080 |
| 2077 | HSPA1B | SEQ ID NO. 922 | 2627.228 | 2308.871 | 0.879 | HYPOX_O2_HCT116 |
| 2078 | HSPA1B | SEQ ID NO. 922 | 268.427 | 196.846 | 0.733 | HYPOX_O2_HT1080 |
| 2079 | CDKN1A | SEQ ID NO. 923 | 1677.304 | 1124.466 | 0.67 | HYPOX_DFO_HCT116 |
| 2080 | CDKN1A | SEQ ID NO. 923 | 107.836 | 67.99 | 0.63 | HYPOX_DFO_HT1080 |
| 2081 | CDKN1A | SEQ ID NO. 923 | 1677.304 | 962.737 | 0.574 | HYPOX_O2_HCT116 |
| 2082 | CDKN1A | SEQ ID NO. 923 | 107.836 | 58.331 | 0.541 | HYPOX_O2_HT1080 |
| 2083 | LPAL2 | SEQ ID NO. 924 | 0.385 | 0.312 | 0.809 | HYPOX_DFO_HCT116 |
| 2084 | LPAL2 | SEQ ID NO. 924 | 0.142 | 0.063 | 0.444 | HYPOX_DFO_HT1080 |
| 2085 | LPAL2 | SEQ ID NO. 924 | 0.385 | 0.304 | 0.789 | HYPOX_O2_HCT116 |
| 2086 | LPAL2 | SEQ ID NO. 924 | 0.142 | 0.071 | 0.498 | HYPOX_O2_HT1080 |
| 2087 | IL6 | SEQ ID NO. 924 | 10.951 | 10.77 | 0.983 | HYPOX_DFO_HCT116 |
| 2088 | IL6 | SEQ ID NO. 924 | 8.365 | 5.603 | 0.67 | HYPOX_DFO_HT1080 |
| 2089 | IL6 | SEQ ID NO. 924 | 10.951 | 13.653 | 1.247 | HYPOX_O2_HCT116 |
| 2090 | IL6 | SEQ ID NO. 924 | 8.365 | 6.642 | 0.794 | HYPOX_O2_HT1080 |
| 2091 | SERPINE1 | SEQ ID NO. 924 | 972.805 | 694.912 | 0.714 | HYPOX_DFO_HCT116 |
| 2092 | SERPINE1 | SEQ ID NO. 924 | 117.951 | 310.818 | 2.633 | HYPOX_DFO_HT1080 |
| 2093 | SERPINE1 | SEQ ID NO. 924 | 972.805 | 1980.978 | 2.036 | HYPOX_O2_HCT116 |
| 2094 | SERPINE1 | SEQ ID NO. 924 | 117.951 | 169.078 | 1.433 | HYPOX_O2_HT1080 |
| 2095 | NOS3 | SEQ ID NO. 925 | 123.03 | 150.834 | 1.226 | HYPOX_DFO_HCT116 |
| 2096 | NOS3 | SEQ ID NO. 925 | 9.482 | 8.334 | 0.879 | HYPOX_DFO_HT1080 |
| 2097 | NOS3 | SEQ ID NO. 925 | 123.03 | 114.22 | 0.928 | HYPOX_O2_HCT116 |
| 2098 | NOS3 | SEQ ID NO. 925 | 9.482 | 8.756 | 0.923 | HYPOX_O2_HT1080 |
| 2099 | NOS3 | SEQ ID NO. 926 | 47.324 | 41.439 | 0.876 | HYPOX_DFO_HCT116 |
| 2100 | NOS3 | SEQ ID NO. 926 | 4.771 | 4.467 | 0.936 | HYPOX_DFO_HT1080 |
| 2101 | NOS3 | SEQ ID NO. 926 | 47.324 | 61.286 | 1.295 | HYPOX_O2_HCT116 |
| 2102 | NOS3 | SEQ ID NO. 926 | 4.771 | 3.794 | 0.795 | HYPOX_O2_HT1080 |
| 2103 | SHFM1 | SEQ ID NO. 927 | 777.395 | 1106.711 | 1.424 | HYPOX_DFO_HCT116 |
| 2104 | SHFM1 | SEQ ID NO. 927 | 259.741 | 263.363 | 1.014 | HYPOX_DFO_HT1080 |
| 2105 | SHFM1 | SEQ ID NO. 927 | 777.395 | 1030.25 | 1.325 | HYPOX_O2_HCT116 |
| 2106 | SHFM1 | SEQ ID NO. 927 | 259.741 | 208.286 | 0.802 | HYPOX_O2_HT1080 |
| 2107 | BNIP3L | SEQ ID NO. 928 | 123.031 | 22.696 | 0.184 | HYPOX_DFO_HCT116 |
| 2108 | BNIP3L | SEQ ID NO. 928 | 2.306 | 1.289 | 0.558 | HYPOX_DFO_HT1080 |
| 2109 | BNIP3L | SEQ ID NO. 928 | 123.031 | 49.437 | 0.402 | HYPOX_O2_HCT116 |
| 2110 | BNIP3L | SEQ ID NO. 928 | 2.306 | 1.613 | 0.699 | HYPOX_O2_HT1080 |
| 2111 | LOC440258 | SEQ ID NO. 929 | 375.175 | 355.124 | 0.947 | HYPOX_DFO_HCT116 |
| 2112 | LOC440258 | SEQ ID NO. 929 | 59.313 | 73.6 | 1.241 | HYPOX_DFO_HT1080 |
| 2113 | LOC440258 | SEQ ID NO. 929 | 375.175 | 418.479 | 1.115 | HYPOX_O2_HCT116 |
| 2114 | LOC440258 | SEQ ID NO. 929 | 59.313 | 55.316 | 0.933 | HYPOX_O2_HT1080 |

FIG. 1BG -- TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N_O_INDUCTION | PROM_ACTIVITY_N_TH_INDUCTION | PROM_ACTIVITY_WI_INDUCTION_RATIO | INDUCTION_CONDITIONS |
|---|---|---|---|---|---|---|
| 2115 | NRG1 | SEQ ID NO. 930 | 245.498 | 53.655 | 0.219 | HYPOX_DFO_HCT116 |
| 2116 | NRG1 | SEQ ID NO. 930 | 2.866 | 1.997 | 0.697 | HYPOX_DFO_HT1080 |
| 2117 | NRG1 | SEQ ID NO. 930 | 245.498 | 112.327 | 0.458 | HYPOX_O2_HCT116 |
| 2118 | NRG1 | SEQ ID NO. 930 | 2.866 | 2.465 | 0.86 | HYPOX_O2_HT1080 |
| 2119 | NRG1 | SEQ ID NO. 931 | 15.622 | 8.357 | 0.535 | HYPOX_DFO_HCT116 |
| 2120 | NRG1 | SEQ ID NO. 931 | 1.251 | 0.92 | 0.735 | HYPOX_DFO_HT1080 |
| 2121 | NRG1 | SEQ ID NO. 931 | 15.622 | 9.983 | 0.639 | HYPOX_O2_HCT116 |
| 2122 | NRG1 | SEQ ID NO. 931 | 1.251 | 0.694 | 0.555 | HYPOX_O2_HT1080 |
| 2123 | IL11RA | SEQ ID NO. 932 | 62.69 | 30.907 | 0.493 | HYPOX_DFO_HCT116 |
| 2124 | IL11RA | SEQ ID NO. 932 | 3.789 | 1.657 | 0.437 | HYPOX_DFO_HT1080 |
| 2125 | IL11RA | SEQ ID NO. 932 | 62.69 | 40.078 | 0.639 | HYPOX_O2_HCT116 |
| 2126 | IL11RA | SEQ ID NO. 932 | 3.789 | 3.789 | 1 | HYPOX_O2_HT1080 |
| 2127 | TKN | SEQ ID NO. 932 | 33.501 | 45.98 | 1.373 | HYPOX_DFO_HCT116 |
| 2128 | TKN | SEQ ID NO. 932 | 5.73 | 5.049 | 0.881 | HYPOX_DFO_HT1080 |
| 2129 | TKN | SEQ ID NO. 932 | 33.501 | 39.463 | 1.178 | HYPOX_O2_HCT116 |
| 2130 | TKN | SEQ ID NO. 932 | 5.73 | 3.979 | 0.694 | HYPOX_O2_HT1080 |
| 2131 | AK1 | SEQ ID NO. 933 | 1269.183 | 279.636 | 0.22 | HYPOX_DFO_HCT116 |
| 2132 | AK1 | SEQ ID NO. 933 | 93.525 | 41.974 | 0.449 | HYPOX_DFO_HT1080 |
| 2133 | AK1 | SEQ ID NO. 933 | 1269.183 | 557.056 | 0.439 | HYPOX_O2_HCT116 |
| 2134 | AK1 | SEQ ID NO. 933 | 93.525 | 74.293 | 0.794 | HYPOX_O2_HT1080 |
| 2135 | TIMP1 | SEQ ID NO. 934 | 2609.472 | 3902.797 | 1.496 | HYPOX_DFO_HCT116 |
| 2136 | TIMP1 | SEQ ID NO. 934 | 531.826 | 571.479 | 1.075 | HYPOX_DFO_HT1080 |
| 2137 | TIMP1 | SEQ ID NO. 934 | 2609.472 | 3440.742 | 1.319 | HYPOX_O2_HCT116 |
| 2138 | TIMP1 | SEQ ID NO. 934 | 531.826 | 433.771 | 0.816 | HYPOX_O2_HT1080 |
| 2139 | PAK3 | SEQ ID NO. 935 | 120.752 | 49.15 | 0.407 | HYPOX_DFO_HCT116 |
| 2140 | PAK3 | SEQ ID NO. 935 | 10.892 | 6.818 | 0.626 | HYPOX_DFO_HT1080 |
| 2141 | PAK3 | SEQ ID NO. 935 | 120.752 | 70.42 | 0.583 | HYPOX_O2_HCT116 |
| 2142 | PAK3 | SEQ ID NO. 935 | 10.892 | 9.946 | 0.913 | HYPOX_O2_HT1080 |
| 2143 | IL13RA1 | SEQ ID NO. 936 | 256.049 | 182.744 | 0.714 | HYPOX_DFO_HCT116 |
| 2144 | IL13RA1 | SEQ ID NO. 936 | 13.473 | 7.1 | 0.527 | HYPOX_DFO_HT1080 |
| 2145 | IL13RA1 | SEQ ID NO. 936 | 256.049 | 159.439 | 0.623 | HYPOX_O2_HCT116 |
| 2146 | IL13RA1 | SEQ ID NO. 936 | 13.473 | 9.825 | 0.729 | HYPOX_O2_HT1080 |
| 2147 | IL13RA2 | SEQ ID NO. 937 | 48.576 | 15.781 | 0.325 | HYPOX_DFO_HCT116 |
| 2148 | IL13RA2 | SEQ ID NO. 937 | 46.621 | 29.935 | 0.642 | HYPOX_DFO_HT1080 |
| 2149 | IL13RA2 | SEQ ID NO. 937 | 48.576 | 23.83 | 0.491 | HYPOX_O2_HCT116 |
| 2150 | IL13RA2 | SEQ ID NO. 937 | 46.621 | 36.596 | 0.785 | HYPOX_O2_HT1080 |
| 2151 | AIFM1 | SEQ ID NO. 938 | 337.867 | 265.829 | 0.787 | HYPOX_DFO_HCT116 |
| 2152 | AIFM1 | SEQ ID NO. 938 | 76.435 | 77.608 | 1.015 | HYPOX_DFO_HT1080 |
| 2153 | AIFM1 | SEQ ID NO. 938 | 337.867 | 315.275 | 0.933 | HYPOX_O2_HCT116 |
| 2154 | AIFM1 | SEQ ID NO. 938 | 76.435 | 64.207 | 0.84 | HYPOX_O2_HT1080 |
| 2155 | IL9R | SEQ ID NO. 939 | 3.435 | 1.316 | 0.383 | HYPOX_DFO_HCT116 |
| 2156 | IL9R | SEQ ID NO. 939 | 0.253 | 0.23 | 0.907 | HYPOX_DFO_HT1080 |
| 2157 | IL9R | SEQ ID NO. 939 | 3.435 | 1.842 | 0.536 | HYPOX_O2_HCT116 |
| 2158 | IL9R | SEQ ID NO. 939 | 0.253 | 0.24 | 0.948 | HYPOX_O2_HT1080 |
| 2159 | PDK3 | SEQ ID NO. 940 | 190.752 | 183.024 | 0.959 | HYPOX_DFO_HCT116 |
| 2160 | PDK3 | SEQ ID NO. 940 | 4.569 | 17.824 | 3.901 | HYPOX_DFO_HT1080 |
| 2161 | PDK3 | SEQ ID NO. 940 | 190.752 | 400.535 | 2.1 | HYPOX_O2_HCT116 |
| 2162 | PDK3 | SEQ ID NO. 940 | 4.569 | 12.012 | 2.629 | HYPOX_O2_HT1080 |

FIG. 1BH -- TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N_O_INDUCTION | PROM_ACTIVITY_WI_TH_INDUCTION | INDUCTION_RATIO | INDUCTION_CONDITIONS |
|---|---|---|---|---|---|---|
| 2163 | PLAGL1 | SEQ ID NO. 941 | 740.752 | 616.643 | 0.832 | HYPOX_DFO_HCT116 |
| 2164 | PLAGL1 | SEQ ID NO. 941 | 126.479 | 82.911 | 0.656 | HYPOX_DFO_HT1080 |
| 2165 | PLAGL1 | SEQ ID NO. 941 | 740.752 | 1055.186 | 1.384 | HYPOX_O2_HCT116 |
| 2166 | PLAGL1 | SEQ ID NO. 941 | 126.479 | 80.895 | 0.64 | HYPOX_O2_HT1080 |
| 2167 | PFKP | SEQ ID NO. 942 | 260.069 | 174.825 | 0.672 | HYPOX_DFO_HCT116 |
| 2168 | PFKP | SEQ ID NO. 942 | 3.565 | 3.274 | 0.918 | HYPOX_DFO_HT1080 |
| 2169 | PFKP | SEQ ID NO. 942 | 260.069 | 242.583 | 0.933 | HYPOX_O2_HCT116 |
| 2170 | PFKP | SEQ ID NO. 942 | 3.565 | 5.098 | 1.43 | HYPOX_O2_HT1080 |
| 2171 | TXNDC4 | SEQ ID NO. 943 | 756.87 | 2014.032 | 2.662 | HYPOX_DFO_HCT116 |
| 2172 | TXNDC4 | SEQ ID NO. 943 | 473.512 | 484.332 | 1.023 | HYPOX_DFO_HT1080 |
| 2173 | TXNDC4 | SEQ ID NO. 943 | 756.87 | 999.715 | 1.321 | HYPOX_O2_HCT116 |
| 2174 | TXNDC4 | SEQ ID NO. 943 | 473.512 | 281.615 | 0.595 | HYPOX_O2_HT1080 |
| 2175 | C3 | SEQ ID NO. 944 | 14.033 | 13.116 | 0.935 | HYPOX_DFO_HCT116 |
| 2176 | C3 | SEQ ID NO. 944 | 2.056 | 2.165 | 1.053 | HYPOX_DFO_HT1080 |
| 2177 | C3 | SEQ ID NO. 944 | 14.033 | 15.573 | 1.11 | HYPOX_O2_HCT116 |
| 2178 | C3 | SEQ ID NO. 944 | 2.056 | 3.304 | 1.607 | HYPOX_O2_HT1080 |
| 2179 | NOTCH4 | SEQ ID NO. 945 | 23.892 | 16.251 | 0.68 | HYPOX_DFO_HCT116 |
| 2180 | NOTCH4 | SEQ ID NO. 945 | 8.312 | 9.076 | 1.092 | HYPOX_DFO_HT1080 |
| 2181 | NOTCH4 | SEQ ID NO. 945 | 23.892 | 11.841 | 0.495 | HYPOX_O2_HCT116 |
| 2182 | NOTCH4 | SEQ ID NO. 945 | 8.312 | 5.996 | 0.721 | HYPOX_O2_HT1080 |
| 2183 | HTATIP2 | SEQ ID NO. 946 | 40.952 | 15.022 | 0.367 | HYPOX_DFO_HCT116 |
| 2184 | HTATIP2 | SEQ ID NO. 946 | 1.928 | 0.935 | 0.485 | HYPOX_DFO_HT1080 |
| 2185 | HTATIP2 | SEQ ID NO. 946 | 40.952 | 27.073 | 0.661 | HYPOX_O2_HCT116 |
| 2186 | HTATIP2 | SEQ ID NO. 946 | 1.928 | 1.903 | 0.987 | HYPOX_O2_HT1080 |
| 2187 | TUBB2C | SEQ ID NO. 947 | 2669.959 | 2947.7 | 1.098 | HYPOX_DFO_HCT116 |
| 2188 | TUBB2C | SEQ ID NO. 947 | 573.281 | 456.258 | 0.796 | HYPOX_DFO_HT1080 |
| 2189 | TUBB2C | SEQ ID NO. 947 | 2669.959 | 4111.043 | 1.526 | HYPOX_O2_HCT116 |
| 2190 | TUBB2C | SEQ ID NO. 947 | 573.281 | 475.904 | 0.83 | HYPOX_O2_HT1080 |
| 2191 | ATRN | SEQ ID NO. 948 | 493.728 | 344.848 | 0.698 | HYPOX_DFO_HCT116 |
| 2192 | ATRN | SEQ ID NO. 948 | 94.384 | 81.682 | 0.865 | HYPOX_DFO_HT1080 |
| 2193 | ATRN | SEQ ID NO. 948 | 493.728 | 430.861 | 0.873 | HYPOX_O2_HCT116 |
| 2194 | ATRN | SEQ ID NO. 948 | 94.384 | 70.759 | 0.75 | HYPOX_O2_HT1080 |
| 2195 | TLR2 | SEQ ID NO. 949 | 195.243 | 69.127 | 0.354 | HYPOX_DFO_HCT116 |
| 2196 | TLR2 | SEQ ID NO. 949 | 12.0 | 5.825 | 0.477 | HYPOX_DFO_HT1080 |
| 2197 | TLR2 | SEQ ID NO. 949 | 195.243 | 154.272 | 0.79 | HYPOX_O2_HCT116 |
| 2198 | TLR2 | SEQ ID NO. 949 | 12.0 | 11.174 | 0.918 | HYPOX_O2_HT1080 |
| 2199 | PML | SEQ ID NO. 950 | 4.120 | 4.893 | 1.187 | HYPOX_DFO_HCT116 |
| 2200 | PML | SEQ ID NO. 950 | 0.374 | 0.436 | 1.139 | HYPOX_DFO_HT1080 |
| 2201 | PML | SEQ ID NO. 950 | 4.120 | 5.111 | 1.24 | HYPOX_O2_HCT116 |
| 2202 | PML | SEQ ID NO. 950 | 0.374 | 0.293 | 0.785 | HYPOX_O2_HT1080 |
| 2203 | CYCS | SEQ ID NO. 950 | 3115.944 | 9545.911 | 3.064 | HYPOX_DFO_HCT116 |
| 2204 | CYCS | SEQ ID NO. 950 | 1380.548 | 1803.352 | 1.306 | HYPOX_DFO_HT1080 |
| 2205 | CYCS | SEQ ID NO. 950 | 3115.944 | 4526.794 | 1.453 | HYPOX_O2_HCT116 |
| 2206 | CYCS | SEQ ID NO. 950 | 1380.548 | 1012.001 | 0.733 | HYPOX_O2_HT1080 |
| 2207 | TOLLIP | SEQ ID NO. 951 | 101.439 | 357.715 | 3.526 | HYPOX_DFO_HCT116 |
| 2208 | TOLLIP | SEQ ID NO. 951 | 72.687 | 82.365 | 1.133 | HYPOX_DFO_HT1080 |
| 2209 | TOLLIP | SEQ ID NO. 951 | 101.439 | 190.334 | 1.876 | HYPOX_O2_HCT116 |
| 2210 | TOLLIP | SEQ ID NO. 951 | 72.687 | 62.95 | 0.866 | HYPOX_O2_HT1080 |

FIG. 1BI - TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N Q_INDUCTION | PROM_ACTIVITY_N TH_INDUCTION | PROM_ACTIVITY_WT INDUCTION | INDUCTION RATIO | INDUCTION_CONDITIONS |
|---|---|---|---|---|---|---|---|
| 2211 | CCL24 | SEQ ID NO. 952 | 1.939 | | 0.9 | 0.457 | HYPOX_DFO_HCT116 |
| 2212 | CCL24 | SEQ ID NO. 952 | 0.153 | | 0.123 | 0.759 | HYPOX_DFO_HT1080 |
| 2213 | CCL24 | SEQ ID NO. 952 | 1.939 | | 1.337 | 0.679 | HYPOX_O2_HCT116 |
| 2214 | CCL24 | SEQ ID NO. 952 | 0.153 | | 0.127 | 0.784 | HYPOX_O2_HT1080 |
| 2215 | NPPB | SEQ ID NO. 953 | 9.49 | | 23.47 | 2.473 | HYPOX_DFO_HCT116 |
| 2216 | NPPB | SEQ ID NO. 953 | 1.412 | | 1.724 | 1.221 | HYPOX_DFO_HT1080 |
| 2217 | NPPB | SEQ ID NO. 953 | 9.49 | | 46.099 | 4.858 | HYPOX_O2_HCT116 |
| 2218 | NPPB | SEQ ID NO. 953 | 1.412 | | 1.823 | 1.291 | HYPOX_O2_HT1080 |
| 2219 | CD74 | SEQ ID NO. 954 | 207.908 | | 170.874 | 0.822 | HYPOX_DFO_HCT116 |
| 2220 | CD74 | SEQ ID NO. 954 | 40.72 | | 34.92 | 0.858 | HYPOX_DFO_HT1080 |
| 2221 | CD74 | SEQ ID NO. 954 | 207.908 | | 136.928 | 0.659 | HYPOX_O2_HCT116 |
| 2222 | CD74 | SEQ ID NO. 954 | 40.72 | | 27.207 | 0.668 | HYPOX_O2_HT1080 |
| 2223 | MX1 | SEQ ID NO. 955 | 158.163 | | 99.208 | 0.627 | HYPOX_DFO_HCT116 |
| 2224 | MX1 | SEQ ID NO. 955 | 483.93 | | 115.584 | 0.236 | HYPOX_DFO_HT1080 |
| 2225 | MX1 | SEQ ID NO. 955 | 158.163 | | 112.157 | 0.709 | HYPOX_O2_HCT116 |
| 2226 | MX1 | SEQ ID NO. 955 | 483.93 | | 286.398 | 0.586 | HYPOX_O2_HT1080 |
| 2227 | IRF7 | SEQ ID NO. 956 | 1978.552 | | 1206.342 | 0.61 | HYPOX_DFO_HCT116 |
| 2228 | IRF7 | SEQ ID NO. 956 | 281.833 | | 164.402 | 0.583 | HYPOX_DFO_HT1080 |
| 2229 | IRF7 | SEQ ID NO. 956 | 1978.552 | | 1908.424 | 0.965 | HYPOX_O2_HCT116 |
| 2230 | IRF7 | SEQ ID NO. 956 | 281.833 | | 256.585 | 0.91 | HYPOX_O2_HT1080 |
| 2231 | GAB1 | SEQ ID NO. 957 | 177.986 | | 74.141 | 0.417 | HYPOX_DFO_HCT116 |
| 2232 | GAB1 | SEQ ID NO. 957 | 20.751 | | 23.777 | 1.146 | HYPOX_DFO_HT1080 |
| 2233 | GAB1 | SEQ ID NO. 957 | 177.986 | | 268.133 | 1.506 | HYPOX_O2_HCT116 |
| 2234 | GAB1 | SEQ ID NO. 957 | 20.751 | | 36.211 | 1.745 | HYPOX_O2_HT1080 |
| 2235 | IL17C | SEQ ID NO. 958 | 0.593 | | 0.56 | 0.943 | HYPOX_DFO_HCT116 |
| 2236 | IL17C | SEQ ID NO. 958 | 0.148 | | 0.452 | 3.058 | HYPOX_DFO_HT1080 |
| 2237 | IL17C | SEQ ID NO. 958 | 0.593 | | 0.753 | 1.27 | HYPOX_O2_HCT116 |
| 2238 | IL17C | SEQ ID NO. 958 | 0.148 | | 0.125 | 0.843 | HYPOX_O2_HT1080 |
| 2239 | ITGAL | SEQ ID NO. 959 | 5.768 | | 3.926 | 0.681 | HYPOX_DFO_HCT116 |
| 2240 | ITGAL | SEQ ID NO. 959 | 1.27 | | 0.54 | 0.425 | HYPOX_DFO_HT1080 |
| 2241 | ITGAL | SEQ ID NO. 959 | 5.768 | | 3.027 | 0.525 | HYPOX_O2_HCT116 |
| 2242 | ITGAL | SEQ ID NO. 959 | 1.27 | | 0.983 | 0.774 | HYPOX_O2_HT1080 |
| 2243 | DAPK3 | SEQ ID NO. 960 | 21.295 | | 5.001 | 0.235 | HYPOX_DFO_HCT116 |
| 2244 | DAPK3 | SEQ ID NO. 960 | 0.801 | | 0.46 | 0.574 | HYPOX_DFO_HT1080 |
| 2245 | DAPK3 | SEQ ID NO. 960 | 21.295 | | 12.553 | 0.591 | HYPOX_O2_HCT116 |
| 2246 | DAPK3 | SEQ ID NO. 960 | 0.801 | | 0.715 | 0.892 | HYPOX_O2_HT1080 |
| 2247 | PLAT | SEQ ID NO. 961 | 128.455 | | 95.164 | 0.741 | HYPOX_DFO_HCT116 |
| 2248 | PLAT | SEQ ID NO. 961 | 27.74 | | 11.469 | 0.413 | HYPOX_DFO_HT1080 |
| 2249 | PLAT | SEQ ID NO. 961 | 128.455 | | 51.846 | 0.404 | HYPOX_O2_HCT116 |
| 2250 | PLAT | SEQ ID NO. 961 | 27.74 | | 24.64 | 0.888 | HYPOX_O2_HT1080 |
| 2251 | C19orf10 | SEQ ID NO. 962 | 481.086 | | 599.193 | 1.245 | HYPOX_DFO_HCT116 |
| 2252 | C19orf10 | SEQ ID NO. 962 | 46.235 | | 44.589 | 0.964 | HYPOX_DFO_HT1080 |
| 2253 | C19orf10 | SEQ ID NO. 962 | 481.088 | | 380.489 | 0.791 | HYPOX_O2_HCT116 |
| 2254 | C19orf10 | SEQ ID NO. 962 | 46.235 | | 42.386 | 0.915 | HYPOX_O2_HT1080 |
| 2255 | PLAT | SEQ ID NO. 962 | 62.276 | | 37.375 | 0.6 | HYPOX_DFO_HCT116 |
| 2256 | PROK2 | SEQ ID NO. 963 | 7.603 | | 5.616 | 0.739 | HYPOX_DFO_HT1080 |
| 2257 | PROK2 | SEQ ID NO. 963 | 62.276 | | 71.83 | 1.153 | HYPOX_O2_HCT116 |
| 2258 | PROK2 | SEQ ID NO. 963 | 7.603 | | 7.868 | 1.035 | HYPOX_O2_HT1080 |

*FIG. 1BJ* — TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS* |
|---|---|---|---|---|---|---|
| 2259 | PPP2R1A | SEQ ID NO. 964 | 11.459 | 7.519 | 0.656 | HYPOX_DFO_HCT116 |
| 2260 | PPP2R1A | SEQ ID NO. 964 | 1.803 | 2.115 | 1.173 | HYPOX_DFO_HT1080 |
| 2261 | PPP2R1A | SEQ ID NO. 964 | 11.459 | 7.24 | 0.632 | HYPOX_O2_HCT116 |
| 2262 | PPP2R1A | SEQ ID NO. 964 | 1.803 | 1.785 | 0.99 | HYPOX_O2_HT1080 |
| 2263 | SIVA1 | SEQ ID NO. 965 | 690.043 | 323.396 | 0.467 | HYPOX_DFO_HCT116 |
| 2264 | SIVA1 | SEQ ID NO. 965 | 152.73 | 125.693 | 0.823 | HYPOX_DFO_HT1080 |
| 2265 | SIVA1 | SEQ ID NO. 965 | 690.043 | 565.214 | 0.819 | HYPOX_O2_HCT116 |
| 2266 | SIVA1 | SEQ ID NO. 965 | 152.73 | 143.954 | 0.943 | HYPOX_O2_HT1080 |
| 2267 | PGM1 | SEQ ID NO. 966 | 41.752 | 20.068 | 0.481 | HYPOX_DFO_HCT116 |
| 2268 | PGM1 | SEQ ID NO. 966 | 1.992 | 1.12 | 0.562 | HYPOX_DFO_HT1080 |
| 2269 | PGM1 | SEQ ID NO. 966 | 41.752 | 36.01 | 0.862 | HYPOX_O2_HCT116 |
| 2270 | PGM1 | SEQ ID NO. 966 | 1.992 | 1.545 | 0.775 | HYPOX_O2_HT1080 |
| 2271 | CCR4 | SEQ ID NO. 967 | 3.702 | 1.035 | 0.28 | HYPOX_DFO_HCT116 |
| 2272 | CCR4 | SEQ ID NO. 967 | 0.216 | 0.514 | 2.38 | HYPOX_DFO_HT1080 |
| 2273 | CCR4 | SEQ ID NO. 967 | 3.702 | 2.104 | 0.568 | HYPOX_O2_HCT116 |
| 2274 | CCR4 | SEQ ID NO. 967 | 0.216 | 0.137 | 0.634 | HYPOX_O2_HT1080 |
| 2275 | PPP2R1B | SEQ ID NO. 968 | 11.229 | 2.89 | 0.257 | HYPOX_DFO_HCT116 |
| 2276 | PPP2R1B | SEQ ID NO. 968 | 1.206 | 0.336 | 0.279 | HYPOX_DFO_HT1080 |
| 2277 | PPP2R1B | SEQ ID NO. 968 | 11.229 | 6.268 | 0.558 | HYPOX_O2_HCT116 |
| 2278 | PPP2R1B | SEQ ID NO. 968 | 1.206 | 1.169 | 0.969 | HYPOX_O2_HT1080 |
| 2279 | TKTL1 | SEQ ID NO. 969 | 1973.708 | 2957.633 | 1.499 | HYPOX_DFO_HCT116 |
| 2280 | TKTL1 | SEQ ID NO. 969 | 340.369 | 316.704 | 0.93 | HYPOX_DFO_HT1080 |
| 2281 | TKTL1 | SEQ ID NO. 969 | 1973.708 | 3812.302 | 1.932 | HYPOX_O2_HCT116 |
| 2282 | TKTL1 | SEQ ID NO. 969 | 340.369 | 408.179 | 1.199 | HYPOX_O2_HT1080 |
| 2283 | HPSE | SEQ ID NO. 970 | 42.717 | 19.894 | 0.466 | HYPOX_DFO_HCT116 |
| 2284 | HPSE | SEQ ID NO. 970 | 2.297 | 2.486 | 1.082 | HYPOX_DFO_HT1080 |
| 2285 | HPSE | SEQ ID NO. 970 | 42.717 | 25.838 | 0.605 | HYPOX_O2_HCT116 |
| 2286 | HPSE | SEQ ID NO. 970 | 2.297 | 1.819 | 0.792 | HYPOX_O2_HT1080 |
| 2287 | HDAC9 | SEQ ID NO. 971 | 4.959 | 2.494 | 0.503 | HYPOX_DFO_HCT116 |
| 2288 | HDAC9 | SEQ ID NO. 971 | 2.635 | 2.415 | 0.917 | HYPOX_DFO_HT1080 |
| 2289 | HDAC9 | SEQ ID NO. 971 | 4.959 | 2.878 | 0.58 | HYPOX_O2_HCT116 |
| 2290 | HDAC9 | SEQ ID NO. 971 | 2.635 | 1.642 | 0.623 | HYPOX_O2_HT1080 |
| 2291 | IFI16 | SEQ ID NO. 972 | 100.751 | 26.176 | 0.26 | HYPOX_DFO_HCT116 |
| 2292 | IFI16 | SEQ ID NO. 972 | 5.778 | 4.126 | 0.714 | HYPOX_DFO_HT1080 |
| 2293 | IFI16 | SEQ ID NO. 972 | 100.751 | 36.868 | 0.366 | HYPOX_O2_HCT116 |
| 2294 | IFI16 | SEQ ID NO. 972 | 5.778 | 3.625 | 0.627 | HYPOX_O2_HT1080 |
| 2295 | HSP90AB1 | SEQ ID NO. 972 | 2284.063 | 2192.217 | 0.96 | HYPOX_DFO_HCT116 |
| 2296 | HSP90AB1 | SEQ ID NO. 972 | 396.017 | 169.618 | 0.428 | HYPOX_DFO_HT1080 |
| 2297 | HSP90AB1 | SEQ ID NO. 972 | 2284.063 | 3129.546 | 1.37 | HYPOX_O2_HCT116 |
| 2298 | HSP90AB1 | SEQ ID NO. 972 | 396.017 | 415.678 | 1.05 | HYPOX_O2_HT1080 |
| 2299 | DIABLO | SEQ ID NO. 973 | 497.938 | 1043.388 | 1.095 | HYPOX_DFO_HCT116 |
| 2300 | DIABLO | SEQ ID NO. 973 | 96.065 | 104.711 | 1.09 | HYPOX_DFO_HT1080 |
| 2301 | DIABLO | SEQ ID NO. 973 | 497.938 | 1161.976 | 2.334 | HYPOX_O2_HCT116 |
| 2302 | DIABLO | SEQ ID NO. 973 | 96.065 | 51.336 | 0.534 | HYPOX_O2_HT1080 |
| 2303 | SGK2 | SEQ ID NO. 974 | 18.705 | 10.647 | 0.569 | HYPOX_DFO_HCT116 |
| 2304 | SGK2 | SEQ ID NO. 974 | 0.829 | 0.94 | 1.134 | HYPOX_DFO_HT1080 |
| 2305 | SGK2 | SEQ ID NO. 974 | 18.705 | 12.669 | 0.677 | HYPOX_O2_HCT116 |
| 2306 | SGK2 | SEQ ID NO. 974 | 0.829 | 0.59 | 0.712 | HYPOX_O2_HT1080 |

FIG. 1BK -- TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_W I_INDUCTION | INDUCTION_RATIO | INDUCTION_CONDITIONS |
|---|---|---|---|---|---|---|
| 2307 | F11R | SEQ ID NO. 975 | 230.603 | 63.638 | 0.276 | HYPOX_DFO_HCT116 |
| 2308 | F11R | SEQ ID NO. 975 | 4.271 | 3.436 | 0.804 | HYPOX_DFO_HT1080 |
| 2309 | F11R | SEQ ID NO. 975 | 230.603 | 116.725 | 0.506 | HYPOX_O2_HCT116 |
| 2310 | F11R | SEQ ID NO. 975 | 4.271 | 3.584 | 0.839 | HYPOX_O2_HT1080 |
| 2311 | STK17A | SEQ ID NO. 976 | 410.493 | 274.48 | 0.669 | HYPOX_DFO_HCT116 |
| 2312 | STK17A | SEQ ID NO. 976 | 34.699 | 34.983 | 1.008 | HYPOX_DFO_HT1080 |
| 2313 | STK17A | SEQ ID NO. 976 | 410.493 | 311.227 | 0.758 | HYPOX_O2_HCT116 |
| 2314 | STK17A | SEQ ID NO. 976 | 34.699 | 30.298 | 0.873 | HYPOX_O2_HT1080 |
| 2315 | AGGF1 | SEQ ID NO. 977 | 2011.599 | 3752.741 | 1.866 | HYPOX_DFO_HCT116 |
| 2316 | AGGF1 | SEQ ID NO. 977 | 402.966 | 607.93 | 1.509 | HYPOX_DFO_HT1080 |
| 2317 | AGGF1 | SEQ ID NO. 977 | 2011.599 | 2349.643 | 1.168 | HYPOX_O2_HCT116 |
| 2318 | AGGF1 | SEQ ID NO. 977 | 402.966 | 384.227 | 0.954 | HYPOX_O2_HT1080 |
| 2319 | LY75 | SEQ ID NO. 978 | 112.236 | 33.721 | 0.3 | HYPOX_DFO_HCT116 |
| 2320 | LY75 | SEQ ID NO. 978 | 3.794 | 2.56 | 0.675 | HYPOX_DFO_HT1080 |
| 2321 | LY75 | SEQ ID NO. 978 | 112.236 | 77.743 | 0.693 | HYPOX_O2_HCT116 |
| 2322 | LY75 | SEQ ID NO. 978 | 3.794 | 2.607 | 0.687 | HYPOX_O2_HT1080 |
| 2323 | IQCD | SEQ ID NO. 979 | 314.744 | 295.965 | 0.94 | HYPOX_DFO_HCT116 |
| 2324 | IQCD | SEQ ID NO. 979 | 17.53 | 19.643 | 1.121 | HYPOX_DFO_HT1080 |
| 2325 | IQCD | SEQ ID NO. 979 | 314.744 | 242.363 | 0.77 | HYPOX_O2_HCT116 |
| 2326 | IQCD | SEQ ID NO. 979 | 17.53 | 11.35 | 0.647 | HYPOX_O2_HT1080 |
| 2327 | BCL2L11 | SEQ ID NO. 980 | 51.477 | 33.142 | 0.644 | HYPOX_DFO_HCT116 |
| 2328 | BCL2L11 | SEQ ID NO. 980 | 1.1 | 0.921 | 0.837 | HYPOX_DFO_HT1080 |
| 2329 | BCL2L11 | SEQ ID NO. 980 | 51.477 | 41.703 | 0.81 | HYPOX_O2_HCT116 |
| 2330 | BCL2L11 | SEQ ID NO. 980 | 1.1 | 0.878 | 0.797 | HYPOX_O2_HT1080 |
| 2331 | ADORA1 | SEQ ID NO. 981 | 312.191 | 132.43 | 0.424 | HYPOX_DFO_HCT116 |
| 2332 | ADORA1 | SEQ ID NO. 981 | 24.322 | 15.183 | 0.624 | HYPOX_DFO_HT1080 |
| 2333 | ADORA1 | SEQ ID NO. 981 | 312.191 | 233.021 | 0.746 | HYPOX_O2_HCT116 |
| 2334 | ADORA1 | SEQ ID NO. 981 | 24.322 | 18.369 | 0.755 | HYPOX_O2_HT1080 |
| 2335 | MDH2 | SEQ ID NO. 982 | 280.437 | 216.379 | 0.773 | HYPOX_DFO_HCT116 |
| 2336 | MDH2 | SEQ ID NO. 982 | 153.778 | 135.08 | 0.38 | HYPOX_DFO_HT1080 |
| 2337 | MDH2 | SEQ ID NO. 982 | 280.437 | 212.517 | 0.758 | HYPOX_O2_HCT116 |
| 2338 | MDH2 | SEQ ID NO. 982 | 153.778 | 119.114 | 0.775 | HYPOX_O2_HT1080 |
| 2339 | GPI | SEQ ID NO. 983 | 1.092 | 0.877 | 0.803 | HYPOX_DFO_HCT116 |
| 2340 | GPI | SEQ ID NO. 983 | 0.36 | 0.464 | 1.289 | HYPOX_DFO_HT1080 |
| 2341 | GPI | SEQ ID NO. 983 | 1.092 | 1.256 | 1.15 | HYPOX_O2_HCT116 |
| 2342 | GPI | SEQ ID NO. 983 | 0.36 | 0.327 | 0.908 | HYPOX_O2_HT1080 |
| 2343 | OXA1L | SEQ ID NO. 984 | 53.18 | 72.692 | 1.367 | HYPOX_DFO_HCT116 |
| 2344 | OXA1L | SEQ ID NO. 984 | 21.393 | 35.533 | 1.661 | HYPOX_DFO_HT1080 |
| 2345 | OXA1L | SEQ ID NO. 984 | 53.18 | 47.376 | 0.891 | HYPOX_O2_HCT116 |
| 2346 | OXA1L | SEQ ID NO. 984 | 21.393 | 16.782 | 0.784 | HYPOX_O2_HT1080 |
| 2347 | NR3C1 | SEQ ID NO. 984 | 108.431 | 37.711 | 0.348 | HYPOX_DFO_HCT116 |
| 2348 | NR3C1 | SEQ ID NO. 984 | 15.596 | 11.263 | 0.722 | HYPOX_DFO_HT1080 |
| 2349 | NR3C1 | SEQ ID NO. 984 | 108.431 | 127.095 | 1.172 | HYPOX_O2_HCT116 |
| 2350 | NR3C1 | SEQ ID NO. 984 | 15.596 | 16.126 | 1.038 | HYPOX_O2_HT1080 |
| 2351 | VPS45 | SEQ ID NO. 985 | 120.074 | 165.847 | 1.381 | HYPOX_DFO_HCT116 |
| 2352 | VPS45 | SEQ ID NO. 985 | 39.406 | 21.411 | 0.543 | HYPOX_DFO_HT1080 |
| 2353 | VPS45 | SEQ ID NO. 985 | 120.074 | 127.813 | 1.064 | HYPOX_O2_HCT116 |
| 2354 | VPS45 | SEQ ID NO. 985 | 39.406 | 27.978 | 0.71 | HYPOX_O2_HT1080 |

FIG. 1BL — TABLE 1 TRANSCRIPTIONAL BIOMARKER FUNCTIONAL DATA
SECTION 1A

| LINE_ID | GENE_SYMBOL | SEQUENCE ID LISTING | PROM_ACTIVITY_N O_INDUCTION | PROM_ACTIVITY_WI TH_INDUCTION | INDUCTION RATIO | INDUCTION_CONDITIONS |
|---|---|---|---|---|---|---|
| 2355 | TNFRSF10A | SEQ ID NO. 986 | 30.534 | 16.12 | 0.408 | HYPOX_DFO_HCT116 |
| 2356 | TNFRSF10A | SEQ ID NO. 986 | 1.547 | 1.254 | 0.811 | HYPOX_DFO_HT1080 |
| 2357 | TNFRSF10A | SEQ ID NO. 986 | 39.534 | 30.823 | 0.78 | HYPOX_O2_HCT116 |
| 2358 | TNFRSF10A | SEQ ID NO. 986 | 1.547 | 1.683 | 1.088 | HYPOX_O2_HT1080 |
| 2359 | PLG | SEQ ID NO. 987 | 4.511 | 1.579 | 0.35 | HYPOX_DFO_HCT116 |
| 2360 | PLG | SEQ ID NO. 987 | 0.164 | 0.216 | 1.317 | HYPOX_DFO_HT1080 |
| 2361 | PLG | SEQ ID NO. 987 | 4.511 | 3.324 | 0.737 | HYPOX_O2_HCT116 |
| 2362 | PLG | SEQ ID NO. 987 | 0.164 | 0.13 | 0.792 | HYPOX_O2_HT1080 |
| 2363 | SLC2A10 | SEQ ID NO. 988 | 18.59 | 8.131 | 0.437 | HYPOX_DFO_HCT116 |
| 2364 | SLC2A10 | SEQ ID NO. 988 | 1.281 | 0.245 | 0.191 | HYPOX_DFO_HT1080 |
| 2365 | SLC2A10 | SEQ ID NO. 988 | 18.59 | 16.837 | 0.906 | HYPOX_O2_HCT116 |
| 2366 | SLC2A10 | SEQ ID NO. 988 | 1.281 | 0.313 | 0.245 | HYPOX_O2_HT1080 |
| 2367 | CIDEC | SEQ ID NO. 989 | 1756.651 | 3151.249 | 1.794 | HYPOX_DFO_HCT116 |
| 2368 | CIDEC | SEQ ID NO. 989 | 500.154 | 598.284 | 1.196 | HYPOX_DFO_HT1080 |
| 2369 | CIDEC | SEQ ID NO. 989 | 1756.651 | 1546.694 | 0.88 | HYPOX_O2_HCT116 |
| 2370 | CIDEC | SEQ ID NO. 989 | 500.154 | 390.721 | 0.781 | HYPOX_O2_HT1080 |
| 2371 | TP73 | SEQ ID NO. 990 | 497.671 | 405.932 | 0.816 | HYPOX_DFO_HCT116 |
| 2372 | TP73 | SEQ ID NO. 990 | 9.613 | 5.858 | 0.609 | HYPOX_DFO_HT1080 |
| 2373 | TP73 | SEQ ID NO. 990 | 497.671 | 308.639 | 0.62 | HYPOX_O2_HCT116 |
| 2374 | TP73 | SEQ ID NO. 990 | 9.613 | 5.977 | 0.622 | HYPOX_O2_HT1080 |
| 2375 | RHOB | SEQ ID NO. 991 | 112.582 | 236.471 | 2.1 | HYPOX_DFO_HCT116 |
| 2376 | RHOB | SEQ ID NO. 991 | 30.352 | 15.955 | 0.526 | HYPOX_DFO_HT1080 |
| 2377 | RHOB | SEQ ID NO. 991 | 112.582 | 160.714 | 1.428 | HYPOX_O2_HCT116 |
| 2378 | RHOB | SEQ ID NO. 991 | 30.352 | 24.845 | 0.819 | HYPOX_O2_HT1080 |
| 2379 | NDUFA13 | SEQ ID NO. 992 | 194.725 | 290.239 | 1.491 | HYPOX_DFO_HCT116 |
| 2380 | NDUFA13 | SEQ ID NO. 992 | 39.014 | 46.48 | 1.395 | HYPOX_DFO_HT1080 |
| 2381 | NDUFA13 | SEQ ID NO. 992 | 194.725 | 198.455 | 1.019 | HYPOX_O2_HCT116 |
| 2382 | NDUFA13 | SEQ ID NO. 992 | 39.014 | 27.314 | 0.941 | HYPOX_O2_HT1080 |
| 2383 | DDAH1 | SEQ ID NO. 993 | 5.759 | 5.419 | 0.941 | HYPOX_DFO_HCT116 |
| 2384 | DDAH1 | SEQ ID NO. 993 | 0.61 | 1.826 | 2.992 | HYPOX_DFO_HT1080 |
| 2385 | DDAH1 | SEQ ID NO. 993 | 5.759 | 11.959 | 2.077 | HYPOX_O2_HCT116 |
| 2386 | DDAH1 | SEQ ID NO. 993 | 0.61 | 0.554 | 0.908 | HYPOX_O2_HT1080 |
| 2387 | CCL26 | SEQ ID NO. 994 | 74.445 | 42.711 | 0.574 | HYPOX_DFO_HCT116 |
| 2388 | CCL26 | SEQ ID NO. 994 | 8.597 | 3.956 | 0.46 | HYPOX_DFO_HT1080 |
| 2389 | CCL26 | SEQ ID NO. 994 | 74.445 | 54.145 | 0.727 | HYPOX_O2_HCT116 |
| 2390 | CCL26 | SEQ ID NO. 994 | 8.597 | 5.888 | 0.685 | HYPOX_O2_HT1080 |
| 2391 | PLG | SEQ ID NO. 995 | 0.437 | 0.527 | 1.207 | HYPOX_DFO_HCT116 |
| 2392 | PLG | SEQ ID NO. 995 | 0.097 | 0.126 | 1.298 | HYPOX_DFO_HT1080 |
| 2393 | PLG | SEQ ID NO. 995 | 0.437 | 0.648 | 1.483 | HYPOX_O2_HCT116 |
| 2394 | PLG | SEQ ID NO. 995 | 0.097 | 0.068 | 0.7 | HYPOX_O2_HT1080 |
| 2395 | CUL4A | SEQ ID NO. 996 | 6.257 | 2.264 | 0.362 | HYPOX_DFO_HCT116 |
| 2396 | CUL4A | SEQ ID NO. 996 | 0.679 | 0.416 | 0.612 | HYPOX_DFO_HT1080 |
| 2397 | CUL4A | SEQ ID NO. 996 | 6.257 | 6.148 | 0.982 | HYPOX_O2_HCT116 |
| 2398 | CUL4A | SEQ ID NO. 996 | 0.679 | 0.806 | 1.187 | HYPOX_O2_HT1080 |
| 2399 | DAPK1 | SEQ ID NO. 997 | 39.168 | 31.776 | 0.811 | HYPOX_DFO_HCT116 |
| 2400 | DAPK1 | SEQ ID NO. 997 | 3.671 | 2.815 | 0.767 | HYPOX_DFO_HT1080 |
| 2401 | DAPK1 | SEQ ID NO. 997 | 39.168 | 46.028 | 1.175 | HYPOX_O2_HCT116 |
| 2402 | DAPK1 | SEQ ID NO. 997 | 3.671 | 3.195 | 0.87 | HYPOX_O2_HT1080 |

FIG. 1BM -- TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_NO_INDUCTION | PROM_ACTIVITY_WITH_INDUCTION | INDUCTION_RATIO | INDUCTION_CONDITIONS |
|---|---|---|---|---|---|---|
| 2403 | FOXO3 | SEQ ID NO: 998 | 139.28 | 67.597 | 0.485 | HYPOX_DFO_HCT116 |
| 2404 | FOXO3 | SEQ ID NO: 998 | 5.192 | 6.834 | 1.316 | HYPOX_DFO_HT1080 |
| 2405 | FOXO3 | SEQ ID NO: 998 | 139.28 | 258.327 | 1.855 | HYPOX_O2_HCT116 |
| 2406 | FOXO3 | SEQ ID NO: 998 | 5.192 | 7.234 | 1.393 | HYPOX_O2_HT1080 |
| 2407 | FPR2 | SEQ ID NO: 999 | 16.895 | 10.511 | 0.622 | HYPOX_DFO_HCT116 |
| 2408 | FPR2 | SEQ ID NO: 999 | 0.748 | 0.589 | 0.787 | HYPOX_DFO_HT1080 |
| 2409 | FPR2 | SEQ ID NO: 999 | 16.895 | 9.434 | 0.558 | HYPOX_O2_HCT116 |
| 2410 | FPR2 | SEQ ID NO: 999 | 0.748 | 0.608 | 0.812 | HYPOX_O2_HT1080 |
| 2411 | PPP2R1A | SEQ ID NO: 1000 | 35.067 | 87.396 | 2.492 | HYPOX_DFO_HCT116 |
| 2412 | PPP2R1A | SEQ ID NO: 1000 | 8.148 | 10.139 | 1.244 | HYPOX_DFO_HT1080 |
| 2413 | PPP2R1A | SEQ ID NO: 1000 | 35.067 | 47.852 | 1.365 | HYPOX_O2_HCT116 |
| 2414 | PPP2R1A | SEQ ID NO: 1000 | 8.148 | 7.849 | 0.963 | HYPOX_O2_HT1080 |
| 2415 | ALOX15B | SEQ ID NO: 1001 | 167.08 | 100.843 | 0.604 | HYPOX_DFO_HCT116 |
| 2416 | ALOX15B | SEQ ID NO: 1001 | 2.093 | 2.056 | 0.982 | HYPOX_DFO_HT1080 |
| 2417 | ALOX15B | SEQ ID NO: 1001 | 167.08 | 119.903 | 0.718 | HYPOX_O2_HCT116 |
| 2418 | ALOX15B | SEQ ID NO: 1001 | 2.093 | 3.571 | 1.706 | HYPOX_O2_HT1080 |
| 2419 | STK25 | SEQ ID NO: 1002 | 210.179 | 113.483 | 0.54 | HYPOX_DFO_HCT116 |
| 2420 | STK25 | SEQ ID NO: 1002 | 55.128 | 51.48 | 0.934 | HYPOX_DFO_HT1080 |
| 2421 | STK25 | SEQ ID NO: 1002 | 210.179 | 221.996 | 1.053 | HYPOX_O2_HCT116 |
| 2422 | STK25 | SEQ ID NO: 1002 | 55.128 | 49.625 | 0.9 | HYPOX_O2_HT1080 |
| 2423 | PLA2G2E | SEQ ID NO: 1003 | 35.822 | 16.997 | 0.475 | HYPOX_DFO_HCT116 |
| 2424 | PLA2G2E | SEQ ID NO: 1003 | 2.769 | 1.386 | 0.501 | HYPOX_DFO_HT1080 |
| 2425 | PLA2G2E | SEQ ID NO: 1003 | 35.822 | 16.966 | 0.474 | HYPOX_O2_HCT116 |
| 2426 | PLA2G2E | SEQ ID NO: 1003 | 2.769 | 2.224 | 0.803 | HYPOX_O2_HT1080 |
| 2427 | DHX8 | SEQ ID NO: 1004 | 651.463 | 726.317 | 1.115 | HYPOX_DFO_HCT116 |
| 2428 | DHX8 | SEQ ID NO: 1004 | 274.142 | 203.463 | 0.742 | HYPOX_DFO_HT1080 |
| 2429 | DHX8 | SEQ ID NO: 1004 | 651.463 | 919.922 | 1.412 | HYPOX_O2_HCT116 |
| 2430 | DHX8 | SEQ ID NO: 1004 | 274.142 | 202.58 | 0.739 | HYPOX_O2_HT1080 |
| 2431 | PDLIM1 | SEQ ID NO: 1005 | 223.939 | 281.103 | 1.255 | HYPOX_DFO_HCT116 |
| 2432 | PDLIM1 | SEQ ID NO: 1005 | 8.83 | 4.796 | 0.543 | HYPOX_DFO_HT1080 |
| 2433 | PDLIM1 | SEQ ID NO: 1005 | 223.939 | 187.446 | 0.837 | HYPOX_O2_HCT116 |
| 2434 | PDLIM1 | SEQ ID NO: 1005 | 8.83 | 7.796 | 0.883 | HYPOX_O2_HT1080 |
| 2435 | FASN | SEQ ID NO: 1006 | 93.235 | 32.029 | 0.344 | HYPOX_DFO_HCT116 |
| 2436 | FASN | SEQ ID NO: 1006 | 2.999 | 2.513 | 0.838 | HYPOX_DFO_HT1080 |
| 2437 | FASN | SEQ ID NO: 1006 | 93.235 | 104.791 | 1.124 | HYPOX_O2_HCT116 |
| 2438 | FASN | SEQ ID NO: 1006 | 2.999 | 4.099 | 1.366 | HYPOX_O2_HT1080 |
| 2439 | PKLR | SEQ ID NO: 1007 | 0.608 | 0.583 | 0.958 | HYPOX_DFO_HCT116 |
| 2440 | PKLR | SEQ ID NO: 1007 | 0.152 | 0.175 | 1.155 | HYPOX_DFO_HT1080 |
| 2441 | PKLR | SEQ ID NO: 1007 | 0.608 | 0.661 | 1.087 | HYPOX_O2_HCT116 |
| 2442 | PKLR | SEQ ID NO: 1007 | 0.152 | 0.108 | 0.714 | HYPOX_O2_HT1080 |
| 2443 | TGFB2 | SEQ ID NO: 1008 | 39.559 | 26.232 | 0.663 | HYPOX_DFO_HCT116 |
| 2444 | TGFB2 | SEQ ID NO: 1008 | 2.232 | 1.715 | 0.768 | HYPOX_DFO_HT1080 |
| 2445 | TGFB2 | SEQ ID NO: 1008 | 39.559 | 39.818 | 1.007 | HYPOX_O2_HCT116 |
| 2446 | TGFB2 | SEQ ID NO: 1008 | 2.232 | 1.858 | 0.833 | HYPOX_O2_HT1080 |
| 2447 | NPR1 | SEQ ID NO: 1009 | 46.271 | 16.599 | 0.359 | HYPOX_DFO_HCT116 |
| 2448 | NPR1 | SEQ ID NO: 1009 | 2.265 | 1.257 | 0.555 | HYPOX_DFO_HT1080 |
| 2449 | NPR1 | SEQ ID NO: 1009 | 46.271 | 39.042 | 0.844 | HYPOX_O2_HCT116 |
| 2450 | NPR1 | SEQ ID NO: 1009 | 2.265 | 1.665 | 0.735 | HYPOX_O2_HT1080 |

FIG. 1BN -- TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_W TH_INDUCTION | INDUCTION_RATIO | INDUCTION_CONDITIONS |
|---|---|---|---|---|---|---|
| 2451 | NLRP12 | SEQ ID NO. 1010 | 24.315 | 18.489 | 0.76 | HYPOX_DFO_HCT116 |
| 2452 | NLRP12 | SEQ ID NO. 1010 | 6.577 | 5.157 | 0.78 | HYPOX_DFO_HT1080 |
| 2453 | NLRP12 | SEQ ID NO. 1010 | 24.315 | 18.204 | 0.749 | HYPOX_O2_HCT116 |
| 2454 | NLRP12 | SEQ ID NO. 1010 | 6.577 | 5.727 | 0.871 | HYPOX_O2_HT1080 |
| 2455 | IGF1R | SEQ ID NO. 1011 | 2.378 | 1.389 | 0.584 | HYPOX_DFO_HCT116 |
| 2456 | IGF1R | SEQ ID NO. 1011 | 0.346 | 0.246 | 0.71 | HYPOX_DFO_HT1080 |
| 2457 | IGF1R | SEQ ID NO. 1011 | 2.378 | 2.244 | 0.943 | HYPOX_O2_HCT116 |
| 2458 | IGF1R | SEQ ID NO. 1011 | 0.346 | 0.303 | 0.876 | HYPOX_O2_HT1080 |
| 2459 | BCL6 | SEQ ID NO. 1011 | 1621.383 | 2201.977 | 1.358 | HYPOX_DFO_HCT116 |
| 2460 | BCL6 | SEQ ID NO. 1011 | 176.256 | 150.542 | 0.854 | HYPOX_DFO_HT1080 |
| 2461 | BCL6 | SEQ ID NO. 1011 | 1621.383 | 1052.873 | 0.649 | HYPOX_O2_HCT116 |
| 2462 | BCL6 | SEQ ID NO. 1011 | 176.256 | 110.391 | 0.626 | HYPOX_O2_HT1080 |
| 2463 | MDH1 | SEQ ID NO. 1012 | 32.534 | 46.447 | 1.428 | HYPOX_DFO_HCT116 |
| 2464 | MDH1 | SEQ ID NO. 1012 | 6.372 | 2.554 | 0.401 | HYPOX_DFO_HT1080 |
| 2465 | MDH1 | SEQ ID NO. 1012 | 32.534 | 25.442 | 0.782 | HYPOX_O2_HCT116 |
| 2466 | MDH1 | SEQ ID NO. 1012 | 6.372 | 5.286 | 0.83 | HYPOX_O2_HT1080 |
| 2467 | SERPINF1 | SEQ ID NO. 1013 | 46.451 | 8.163 | 0.176 | HYPOX_DFO_HCT116 |
| 2468 | SERPINF1 | SEQ ID NO. 1013 | 1.015 | 0.783 | 0.771 | HYPOX_DFO_HT1080 |
| 2469 | SERPINF1 | SEQ ID NO. 1013 | 46.451 | 22.969 | 0.494 | HYPOX_O2_HCT116 |
| 2470 | SERPINF1 | SEQ ID NO. 1013 | 1.015 | 0.884 | 0.871 | HYPOX_O2_HT1080 |
| 2471 | CEBPG | SEQ ID NO. 1014 | 1093.287 | 644.593 | 0.59 | HYPOX_DFO_HCT116 |
| 2472 | CEBPG | SEQ ID NO. 1014 | 162.988 | 107.872 | 0.662 | HYPOX_DFO_HT1080 |
| 2473 | CEBPG | SEQ ID NO. 1014 | 1093.287 | 768.738 | 0.703 | HYPOX_O2_HCT116 |
| 2474 | CEBPG | SEQ ID NO. 1014 | 162.988 | 128.91 | 0.791 | HYPOX_O2_HT1080 |
| 2475 | BAX | SEQ ID NO. 1015 | 64.445 | 55.469 | 0.861 | HYPOX_DFO_HCT116 |
| 2476 | BAX | SEQ ID NO. 1015 | 9.265 | 5.575 | 0.602 | HYPOX_DFO_HT1080 |
| 2477 | BAX | SEQ ID NO. 1015 | 64.445 | 37.126 | 0.576 | HYPOX_O2_HCT116 |
| 2478 | BAX | SEQ ID NO. 1015 | 9.265 | 8.852 | 0.955 | HYPOX_O2_HT1080 |
| 2479 | CFLAR | SEQ ID NO. 1016 | 1.744 | 1.446 | 0.83 | HYPOX_DFO_HCT116 |
| 2480 | CFLAR | SEQ ID NO. 1016 | 0.418 | 0.626 | 1.498 | HYPOX_DFO_HT1080 |
| 2481 | CFLAR | SEQ ID NO. 1016 | 1.744 | 0.963 | 0.552 | HYPOX_O2_HCT116 |
| 2482 | CFLAR | SEQ ID NO. 1016 | 0.418 | 0.339 | 0.812 | HYPOX_O2_HT1080 |
| 2483 | GPR68 | SEQ ID NO. 1017 | 54.797 | 44.399 | 0.81 | HYPOX_DFO_HCT116 |
| 2484 | GPR68 | SEQ ID NO. 1017 | 20.421 | 14.963 | 0.733 | HYPOX_DFO_HT1080 |
| 2485 | GPR68 | SEQ ID NO. 1017 | 54.797 | 48.495 | 0.885 | HYPOX_O2_HCT116 |
| 2486 | GPR68 | SEQ ID NO. 1017 | 20.421 | 16.894 | 0.827 | HYPOX_O2_HT1080 |
| 2487 | DDAH1 | SEQ ID NO. 1018 | 52.822 | 52.897 | 1.001 | HYPOX_DFO_HCT116 |
| 2488 | DDAH1 | SEQ ID NO. 1018 | 9.653 | 3.783 | 0.392 | HYPOX_DFO_HT1080 |
| 2489 | DDAH1 | SEQ ID NO. 1018 | 52.822 | 39.614 | 0.75 | HYPOX_O2_HCT116 |
| 2490 | DDAH1 | SEQ ID NO. 1018 | 9.653 | 7.613 | 0.789 | HYPOX_O2_HT1080 |
| 2491 | FASN | SEQ ID NO. 1018 | 1153.199 | 3135.6 | 2.719 | HYPOX_DFO_HCT116 |
| 2492 | FASN | SEQ ID NO. 1018 | 176.167 | 156.259 | 0.887 | HYPOX_DFO_HT1080 |
| 2493 | FASN | SEQ ID NO. 1018 | 1153.199 | 1528.71 | 1.325 | HYPOX_O2_HCT116 |
| 2494 | FASN | SEQ ID NO. 1018 | 176.167 | 126.996 | 0.721 | HYPOX_O2_HT1080 |
| 2495 | MAP3K10 | SEQ ID NO. 1019 | 41.376 | 19.045 | 0.46 | HYPOX_DFO_HCT116 |
| 2496 | MAP3K10 | SEQ ID NO. 1019 | 9.731 | 8.833 | 0.908 | HYPOX_DFO_HT1080 |
| 2497 | MAP3K10 | SEQ ID NO. 1019 | 41.376 | 48.228 | 1.166 | HYPOX_O2_HCT116 |
| 2498 | MAP3K10 | SEQ ID NO. 1019 | 9.731 | 9.023 | 0.927 | HYPOX_O2_HT1080 |

FIG. 1BO -- TABLE 1 TRANSCRIPTIONAL BIOMARKER FUNCTIONAL DATA
SECTION 1A

| LINE_ID | GENE_SYMBOL | SEQUENCE ID LISTING | PROM_ACTIVITY_NO_INDUCTION | PROM_ACTIVITY_W_INDUCTION | INDUCTION_RATIO | INDUCTION_CONDITIONS* |
|---|---|---|---|---|---|---|
| 2499 | NOTCH4 | SEQ ID NO. 1019 | 76.692 | 66.393 | 0.864 | HYPOX_DFO_HCT116 |
| 2500 | NOTCH4 | SEQ ID NO. 1020 | 8.833 | 12.79 | 1.448 | HYPOX_DFO_HT1080 |
| 2501 | NOTCH4 | SEQ ID NO. 1020 | 76.802 | 53.187 | 0.693 | HYPOX_O2_HCT116 |
| 2502 | NOTCH4 | SEQ ID NO. 1020 | 8.833 | 7.474 | 0.846 | HYPOX_O2_HT1080 |
| 2503 | PFKP | SEQ ID NO. 1021 | 8.794 | 10.795 | 1.223 | HYPOX_DFO_HCT116 |
| 2504 | PFKP | SEQ ID NO. 1021 | 0.506 | 0.475 | 0.94 | HYPOX_DFO_HT1080 |
| 2505 | PFKP | SEQ ID NO. 1021 | 8.794 | 5.947 | 0.676 | HYPOX_O2_HCT116 |
| 2506 | PFKP | SEQ ID NO. 1021 | 0.506 | 0.406 | 0.303 | HYPOX_O2_HT1080 |
| 2507 | CXCL5 | SEQ ID NO. 1022 | 5.448 | 2.959 | 0.543 | HYPOX_DFO_HCT116 |
| 2508 | CXCL5 | SEQ ID NO. 1022 | 0.963 | 0.868 | 0.902 | HYPOX_DFO_HT1080 |
| 2509 | CXCL5 | SEQ ID NO. 1022 | 5.448 | 4.5 | 0.831 | HYPOX_O2_HCT116 |
| 2510 | CXCL5 | SEQ ID NO. 1022 | 0.963 | 0.352 | 0.385 | HYPOX_O2_HT1080 |
| 2511 | COL4A3 | SEQ ID NO. 1023 | 255.429 | 134.053 | 0.525 | HYPOX_DFO_HCT116 |
| 2512 | COL4A3 | SEQ ID NO. 1023 | 4.222 | 3.272 | 0.775 | HYPOX_DFO_HT1080 |
| 2513 | COL4A3 | SEQ ID NO. 1023 | 255.429 | 212.595 | 0.832 | HYPOX_O2_HCT116 |
| 2514 | COL4A3 | SEQ ID NO. 1023 | 4.222 | 4.103 | 0.972 | HYPOX_O2_HT1080 |
| 2515 | PRKCA | SEQ ID NO. 1024 | 22.657 | 10.644 | 0.47 | HYPOX_DFO_HCT116 |
| 2516 | PRKCA | SEQ ID NO. 1024 | 1.954 | 2.226 | 1.139 | HYPOX_DFO_HT1080 |
| 2517 | PRKCA | SEQ ID NO. 1024 | 22.657 | 17.417 | 0.766 | HYPOX_O2_HCT116 |
| 2518 | PRKCA | SEQ ID NO. 1024 | 1.954 | 1.841 | 0.937 | HYPOX_O2_HT1080 |
| 2519 | AOX1 | SEQ ID NO. 1025 | 121.067 | 18.487 | 0.153 | HYPOX_DFO_HCT116 |
| 2520 | AOX1 | SEQ ID NO. 1025 | 5.948 | 5.159 | 0.867 | HYPOX_DFO_HT1080 |
| 2521 | AOX1 | SEQ ID NO. 1025 | 121.067 | 76.856 | 0.635 | HYPOX_O2_HCT116 |
| 2522 | AOX1 | SEQ ID NO. 1025 | 5.948 | 6.098 | 1.025 | HYPOX_O2_HT1080 |
| 2523 | ADORA2A | SEQ ID NO. 1026 | 270.891 | 67.387 | 0.249 | HYPOX_DFO_HCT116 |
| 2524 | ADORA2A | SEQ ID NO. 1026 | 8.382 | 4.056 | 0.484 | HYPOX_DFO_HT1080 |
| 2525 | ADORA2A | SEQ ID NO. 1026 | 270.891 | 133.812 | 0.494 | HYPOX_O2_HCT116 |
| 2526 | ADORA2A | SEQ ID NO. 1026 | 8.382 | 6.551 | 0.782 | HYPOX_O2_HT1080 |
| 2527 | ERCC3 | SEQ ID NO. 1027 | 32.062 | 5.486 | 0.171 | HYPOX_DFO_HCT116 |
| 2528 | ERCC3 | SEQ ID NO. 1027 | 4.252 | 1.256 | 0.295 | HYPOX_DFO_HT1080 |
| 2529 | ERCC3 | SEQ ID NO. 1027 | 32.062 | 25.222 | 0.787 | HYPOX_O2_HCT116 |
| 2530 | ERCC3 | SEQ ID NO. 1027 | 4.252 | 2.68 | 0.63 | HYPOX_O2_HT1080 |
| 2531 | ACO2 | SEQ ID NO. 1028 | 877.213 | 1441.342 | 1.644 | HYPOX_DFO_HCT116 |
| 2532 | ACO2 | SEQ ID NO. 1028 | 179.326 | 239.539 | 1.336 | HYPOX_DFO_HT1080 |
| 2533 | ACO2 | SEQ ID NO. 1028 | 877.213 | 1356.933 | 1.547 | HYPOX_O2_HCT116 |
| 2534 | ACO2 | SEQ ID NO. 1028 | 179.326 | 159.142 | 0.887 | HYPOX_O2_HT1080 |
| 2535 | NFX1 | SEQ ID NO. 1029 | 7.968 | 39.893 | 5.007 | HYPOX_DFO_HCT116 |
| 2536 | NFX1 | SEQ ID NO. 1029 | 2.868 | 1.438 | 0.501 | HYPOX_DFO_HT1080 |
| 2537 | NFX1 | SEQ ID NO. 1029 | 7.968 | 10.375 | 1.302 | HYPOX_O2_HCT116 |
| 2538 | NFX1 | SEQ ID NO. 1029 | 2.868 | 1.757 | 0.613 | HYPOX_O2_HT1080 |
| 2539 | MMP25 | SEQ ID NO. 1030 | 20.573 | 8.032 | 0.39 | HYPOX_DFO_HCT116 |
| 2540 | MMP25 | SEQ ID NO. 1030 | 0.537 | 0.433 | 0.818 | HYPOX_DFO_HT1080 |
| 2541 | MMP25 | SEQ ID NO. 1030 | 20.573 | 20.368 | 0.987 | HYPOX_O2_HCT116 |
| 2542 | MMP25 | SEQ ID NO. 1030 | 0.537 | 0.591 | 1.101 | HYPOX_O2_HT1080 |
| 2543 | PFKP | SEQ ID NO. 1031 | 42.451 | 25.815 | 0.603 | HYPOX_DFO_HCT116 |
| 2544 | PFKP | SEQ ID NO. 1031 | 1.596 | 1.419 | 0.365 | HYPOX_DFO_HT1080 |
| 2545 | PFKP | SEQ ID NO. 1031 | 42.451 | 40.756 | 0.96 | HYPOX_O2_HCT116 |
| 2546 | PFKP | SEQ ID NO. 1031 | 1.598 | 1.36 | 0.351 | HYPOX_O2_HT1080 |

*FIG. 1BP* -- TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS |
|---|---|---|---|---|---|---|
| 2547 | CCL1 | SEQ ID NO. 1032 | 4.268 | 3.084 | 0.722 | HYPOX_DFO_HCT116 |
| 2548 | CCL1 | SEQ ID NO. 1032 | 1.107 | 1.132 | 1.023 | HYPOX_DFO_HT1080 |
| 2549 | CCL1 | SEQ ID NO. 1032 | 4.268 | 2.78 | 0.651 | HYPOX_O2_HCT116 |
| 2550 | CCL1 | SEQ ID NO. 1032 | 1.107 | 0.946 | 0.854 | HYPOX_O2_HT1080 |
| 2551 | RHOB | SEQ ID NO. 1033 | 2.183 | 1.802 | 0.826 | HYPOX_DFO_HCT116 |
| 2552 | RHOB | SEQ ID NO. 1033 | 0.371 | 0.357 | 0.961 | HYPOX_DFO_HT1080 |
| 2553 | RHOB | SEQ ID NO. 1033 | 2.183 | 2.682 | 1.228 | HYPOX_O2_HCT116 |
| 2554 | RHOB | SEQ ID NO. 1033 | 0.371 | 0.343 | 0.924 | HYPOX_O2_HT1080 |
| 2555 | MKL1 | SEQ ID NO. 1034 | 2718.578 | 4257.232 | 1.566 | HYPOX_DFO_HCT116 |
| 2556 | MKL1 | SEQ ID NO. 1034 | 452.664 | 487.595 | 1.077 | HYPOX_DFO_HT1080 |
| 2557 | MKL1 | SEQ ID NO. 1034 | 2718.578 | 4578.464 | 1.684 | HYPOX_O2_HCT116 |
| 2558 | MKL1 | SEQ ID NO. 1034 | 452.664 | 308.096 | 0.681 | HYPOX_O2_HT1080 |
| 2559 | BCLAF1 | SEQ ID NO. 1035 | 1244.099 | 2912.732 | 2.341 | HYPOX_DFO_HCT116 |
| 2560 | BCLAF1 | SEQ ID NO. 1035 | 385.203 | 511.648 | 1.328 | HYPOX_DFO_HT1080 |
| 2561 | BCLAF1 | SEQ ID NO. 1035 | 1244.099 | 2803.369 | 2.253 | HYPOX_O2_HCT116 |
| 2562 | BCLAF1 | SEQ ID NO. 1035 | 385.203 | 267.484 | 0.694 | HYPOX_O2_HT1080 |
| 2563 | IRS1 | SEQ ID NO. 1036 | 96.078 | 24.202 | 0.252 | HYPOX_DFO_HCT116 |
| 2564 | IRS1 | SEQ ID NO. 1036 | 8.168 | 2.286 | 0.28 | HYPOX_DFO_HT1080 |
| 2565 | IRS1 | SEQ ID NO. 1036 | 96.078 | 73.861 | 0.769 | HYPOX_O2_HCT116 |
| 2566 | IRS1 | SEQ ID NO. 1036 | 8.168 | 4.567 | 0.559 | HYPOX_O2_HT1080 |
| 2567 | H6PD | SEQ ID NO. 1037 | 2.977 | 1.752 | 0.589 | HYPOX_DFO_HCT116 |
| 2568 | H6PD | SEQ ID NO. 1037 | 0.582 | 0.947 | 1.626 | HYPOX_DFO_HT1080 |
| 2569 | H6PD | SEQ ID NO. 1037 | 2.977 | 3.355 | 1.127 | HYPOX_O2_HCT116 |
| 2570 | H6PD | SEQ ID NO. 1037 | 0.582 | 0.652 | 1.12 | HYPOX_O2_HT1080 |
| 2571 | GPX3 | SEQ ID NO. 1038 | 401.538 | 97.588 | 0.243 | HYPOX_DFO_HCT116 |
| 2572 | GPX3 | SEQ ID NO. 1038 | 8.662 | 4.277 | 0.494 | HYPOX_DFO_HT1080 |
| 2573 | GPX3 | SEQ ID NO. 1038 | 401.538 | 251.526 | 0.626 | HYPOX_O2_HCT116 |
| 2574 | GPX3 | SEQ ID NO. 1038 | 8.662 | 6.361 | 0.734 | HYPOX_O2_HT1080 |
| 2575 | PTX3 | SEQ ID NO. 1039 | 35.233 | 13.421 | 0.381 | HYPOX_DFO_HCT116 |
| 2576 | PTX3 | SEQ ID NO. 1039 | 2.866 | 1.621 | 0.566 | HYPOX_DFO_HT1080 |
| 2577 | PTX3 | SEQ ID NO. 1039 | 35.233 | 17.209 | 0.488 | HYPOX_O2_HCT116 |
| 2578 | PTX3 | SEQ ID NO. 1039 | 2.866 | 1.66 | 0.579 | HYPOX_O2_HT1080 |
| 2579 | TGDS | SEQ ID NO. 1040 | 264.296 | 234.316 | 0.867 | HYPOX_DFO_HCT116 |
| 2580 | TGDS | SEQ ID NO. 1040 | 49.534 | 25.649 | 0.518 | HYPOX_DFO_HT1080 |
| 2581 | TGDS | SEQ ID NO. 1040 | 264.296 | 205.797 | 0.779 | HYPOX_O2_HCT116 |
| 2582 | TGDS | SEQ ID NO. 1040 | 49.534 | 36.055 | 0.728 | HYPOX_O2_HT1080 |
| 2583 | ARG2 | SEQ ID NO. 1040 | 293.479 | 565.43 | 1.927 | HYPOX_DFO_HCT116 |
| 2584 | ARG2 | SEQ ID NO. 1040 | 9.546 | 14.614 | 1.531 | HYPOX_DFO_HT1080 |
| 2585 | ARG2 | SEQ ID NO. 1040 | 293.479 | 420.218 | 1.432 | HYPOX_O2_HCT116 |
| 2586 | ARG2 | SEQ ID NO. 1040 | 9.546 | 7.205 | 0.755 | HYPOX_O2_HT1080 |
| 2587 | TPST1 | SEQ ID NO. 1041 | 50.245 | 38.713 | 0.77 | HYPOX_DFO_HCT116 |
| 2588 | TPST1 | SEQ ID NO. 1041 | 6.454 | 3.139 | 0.486 | HYPOX_DFO_HT1080 |
| 2589 | TPST1 | SEQ ID NO. 1041 | 50.245 | 28.196 | 0.561 | HYPOX_O2_HCT116 |
| 2590 | TPST1 | SEQ ID NO. 1041 | 6.454 | 3.264 | 0.506 | HYPOX_O2_HT1080 |
| 2591 | AHSG | SEQ ID NO. 1042 | 0.691 | 0.693 | 1.003 | HYPOX_DFO_HCT116 |
| 2592 | AHSG | SEQ ID NO. 1042 | 0.733 | 0.612 | 0.834 | HYPOX_DFO_HT1080 |
| 2593 | AHSG | SEQ ID NO. 1042 | 0.691 | 1.129 | 1.633 | HYPOX_O2_HCT116 |
| 2594 | AHSG | SEQ ID NO. 1042 | 0.733 | 0.614 | 0.837 | HYPOX_O2_HT1080 |

FIG. 1BQ -- TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N_Q_INDUCTION | PROM_ACTIVITY_WI_TH_INDUCTION | INDUCTION_RATIO | INDUCTION_CONDITIONS* |
|---|---|---|---|---|---|---|
| 2595 | TP63 | SEQ ID NO. 1043 | 23.381 | 3.883 | 0.166 | HYPOX_DFO_HCT116 |
| 2596 | TP63 | SEQ ID NO. 1043 | 0.313 | 0.151 | 0.484 | HYPOX_DFO_HT1080 |
| 2597 | TP63 | SEQ ID NO. 1043 | 23.381 | 9.587 | 0.408 | HYPOX_O2_HCT116 |
| 2598 | TP63 | SEQ ID NO. 1043 | 0.313 | 0.416 | 1.33 | HYPOX_O2_HT1080 |
| 2599 | UGCGL2 | SEQ ID NO. 1044 | 493.37 | 276.419 | 0.56 | HYPOX_DFO_HCT116 |
| 2600 | UGCGL2 | SEQ ID NO. 1044 | 56.411 | 46.338 | 0.821 | HYPOX_DFO_HT1080 |
| 2601 | UGCGL2 | SEQ ID NO. 1044 | 493.37 | 334.624 | 0.678 | HYPOX_O2_HCT116 |
| 2602 | UGCGL2 | SEQ ID NO. 1044 | 56.411 | 48.837 | 0.866 | HYPOX_O2_HT1080 |
| 2603 | ICEBERG | SEQ ID NO. 1045 | 7.934 | 5.367 | 0.676 | HYPOX_DFO_HCT116 |
| 2604 | ICEBERG | SEQ ID NO. 1045 | 0.489 | 0.563 | 1.153 | HYPOX_DFO_HT1080 |
| 2605 | ICEBERG | SEQ ID NO. 1045 | 7.934 | 3.6 | 0.454 | HYPOX_O2_HCT116 |
| 2606 | ICEBERG | SEQ ID NO. 1045 | 0.489 | 0.729 | 1.492 | HYPOX_O2_HT1080 |
| 2607 | LARP5 | SEQ ID NO. 1046 | 3899.605 | 8215.554 | 2.107 | HYPOX_DFO_HCT116 |
| 2608 | LARP5 | SEQ ID NO. 1046 | 1190.004 | 1700.684 | 1.429 | HYPOX_DFO_HT1080 |
| 2609 | LARP5 | SEQ ID NO. 1046 | 3899.605 | 7598.145 | 1.948 | HYPOX_O2_HCT116 |
| 2610 | LARP5 | SEQ ID NO. 1046 | 1190.004 | 1054.265 | 0.886 | HYPOX_O2_HT1080 |
| 2611 | CNOT2 | SEQ ID NO. 1047 | 855.969 | 683.157 | 0.798 | HYPOX_DFO_HCT116 |
| 2612 | CNOT2 | SEQ ID NO. 1047 | 333.067 | 450.456 | 1.352 | HYPOX_DFO_HT1080 |
| 2613 | CNOT2 | SEQ ID NO. 1047 | 855.969 | 514.825 | 0.601 | HYPOX_O2_HCT116 |
| 2614 | CNOT2 | SEQ ID NO. 1047 | 333.067 | 330.242 | 0.992 | HYPOX_O2_HT1080 |
| 2615 | IDS | SEQ ID NO. 1048 | 302.605 | 323.091 | 1.068 | HYPOX_DFO_HCT116 |
| 2616 | IDS | SEQ ID NO. 1048 | 51.982 | 67.317 | 1.295 | HYPOX_DFO_HT1080 |
| 2617 | IDS | SEQ ID NO. 1048 | 302.605 | 217.469 | 0.719 | HYPOX_O2_HCT116 |
| 2618 | IDS | SEQ ID NO. 1048 | 51.982 | 58.205 | 1.122 | HYPOX_O2_HT1080 |
| 2619 | SFRS4 | SEQ ID NO. 1049 | 310.324 | 264.460 | 0.851 | HYPOX_DFO_HCT116 |
| 2620 | SFRS4 | SEQ ID NO. 1049 | 85.432 | 78.388 | 0.918 | HYPOX_DFO_HT1080 |
| 2621 | SFRS4 | SEQ ID NO. 1049 | 310.324 | 260.435 | 0.867 | HYPOX_O2_HCT116 |
| 2622 | SFRS4 | SEQ ID NO. 1049 | 85.432 | 72.077 | 0.844 | HYPOX_O2_HT1080 |
| 2623 | UBE3C | SEQ ID NO. 1050 | 208.597 | 240.703 | 1.154 | HYPOX_DFO_HCT116 |
| 2624 | UBE3C | SEQ ID NO. 1050 | 102.483 | 147.806 | 1.434 | HYPOX_DFO_HT1080 |
| 2625 | UBE3C | SEQ ID NO. 1050 | 208.597 | 240.512 | 1.153 | HYPOX_O2_HCT116 |
| 2626 | UBE3C | SEQ ID NO. 1050 | 102.483 | 97.49 | 0.951 | HYPOX_O2_HT1080 |
| 2627 | SAMD11 | SEQ ID NO. 1051 | 681.227 | 437.396 | 0.642 | HYPOX_DFO_HCT116 |
| 2628 | SAMD11 | SEQ ID NO. 1051 | 31.485 | 20.571 | 0.653 | HYPOX_DFO_HT1080 |
| 2629 | SAMD11 | SEQ ID NO. 1051 | 681.227 | 411.517 | 0.605 | HYPOX_O2_HCT116 |
| 2630 | SAMD11 | SEQ ID NO. 1051 | 31.485 | 33.202 | 1.055 | HYPOX_O2_HT1080 |
| 2631 | CHIC2 | SEQ ID NO. 1052 | 131.827 | 62.821 | 0.477 | HYPOX_DFO_HCT116 |
| 2632 | CHIC2 | SEQ ID NO. 1052 | 27.959 | 18.016 | 0.644 | HYPOX_DFO_HT1080 |
| 2633 | CHIC2 | SEQ ID NO. 1052 | 131.827 | 94.698 | 0.718 | HYPOX_O2_HCT116 |
| 2634 | CHIC2 | SEQ ID NO. 1052 | 27.959 | 24.19 | 0.865 | HYPOX_O2_HT1080 |
| 2635 | ZBTB25 | SEQ ID NO. 1053 | 788.34 | 588.095 | 0.746 | HYPOX_DFO_HCT116 |
| 2636 | ZBTB25 | SEQ ID NO. 1053 | 87.766 | 118.403 | 1.349 | HYPOX_DFO_HT1080 |
| 2637 | ZBTB25 | SEQ ID NO. 1053 | 788.34 | 993.009 | 1.26 | HYPOX_O2_HCT116 |
| 2638 | ZBTB25 | SEQ ID NO. 1053 | 87.766 | 192.443 | 2.193 | HYPOX_O2_HT1080 |
| 2639 | NULL | SEQ ID NO. 1054 | 239.257 | 155.069 | 0.648 | HYPOX_DFO_HCT116 |
| 2640 | NULL | SEQ ID NO. 1054 | 38.991 | 25.845 | 0.665 | HYPOX_DFO_HT1080 |
| 2641 | NULL | SEQ ID NO. 1054 | 239.257 | 129.54 | 0.541 | HYPOX_O2_HCT116 |
| 2642 | NULL | SEQ ID NO. 1054 | 38.991 | 28.851 | 0.74 | HYPOX_O2_HT1080 |

*FIG. 1BR* -- TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS |
|---|---|---|---|---|---|---|
| 2643 | BEX2 | SEQ ID NO. 1055 | 111.152 | 113.159 | 1.018 | HYPOX_DFO_HCT116 |
| 2644 | BEX2 | SEQ ID NO. 1055 | 4.361 | 3.521 | 0.807 | HYPOX_DFO_HT1080 |
| 2645 | BEX2 | SEQ ID NO. 1055 | 111.152 | 65.488 | 0.589 | HYPOX_O2_HCT116 |
| 2646 | BEX2 | SEQ ID NO. 1055 | 4.361 | 2.558 | 0.587 | HYPOX_O2_HT1080 |
| 2647 | CDT1 | SEQ ID NO. 1056 | 183.164 | 143.798 | 0.785 | HYPOX_DFO_HCT116 |
| 2648 | CDT1 | SEQ ID NO. 1056 | 44.047 | 36.126 | 0.82 | HYPOX_DFO_HT1080 |
| 2649 | CDT1 | SEQ ID NO. 1056 | 183.164 | 173.154 | 0.945 | HYPOX_O2_HCT116 |
| 2650 | CDT1 | SEQ ID NO. 1056 | 44.047 | 54.317 | 1.233 | HYPOX_O2_HT1080 |
| 2651 | TTYH2 | SEQ ID NO. 1057 | 203.631 | 84.003 | 0.413 | HYPOX_DFO_HCT116 |
| 2652 | TTYH2 | SEQ ID NO. 1057 | 14.386 | 7.058 | 0.491 | HYPOX_DFO_HT1080 |
| 2653 | TTYH2 | SEQ ID NO. 1057 | 203.631 | 120.014 | 0.589 | HYPOX_O2_HCT116 |
| 2654 | TTYH2 | SEQ ID NO. 1057 | 14.386 | 9.825 | 0.683 | HYPOX_O2_HT1080 |
| 2655 | LAMCL3 | SEQ ID NO. 1058 | 268.137 | 125.807 | 0.466 | HYPOX_DFO_HCT116 |
| 2656 | LAMCL3 | SEQ ID NO. 1058 | 3.835 | 2.771 | 0.723 | HYPOX_DFO_HT1080 |
| 2657 | LAMCL3 | SEQ ID NO. 1058 | 268.137 | 133.19 | 0.497 | HYPOX_O2_HCT116 |
| 2658 | LAMCL3 | SEQ ID NO. 1058 | 3.835 | 2.447 | 0.638 | HYPOX_O2_HT1080 |
| 2659 | ZNF141 | SEQ ID NO. 1059 | 562.088 | 405.123 | 0.721 | HYPOX_DFO_HCT116 |
| 2660 | ZNF141 | SEQ ID NO. 1059 | 155.247 | 85.662 | 0.552 | HYPOX_DFO_HT1080 |
| 2661 | ZNF141 | SEQ ID NO. 1059 | 562.088 | 464.815 | 0.827 | HYPOX_O2_HCT116 |
| 2662 | ZNF141 | SEQ ID NO. 1059 | 155.247 | 119.409 | 0.769 | HYPOX_O2_HT1080 |
| 2663 | UBE2Z | SEQ ID NO. 1060 | 120.314 | 105.083 | 0.873 | HYPOX_DFO_HCT116 |
| 2664 | UBE2Z | SEQ ID NO. 1060 | 34.315 | 40.296 | 1.174 | HYPOX_DFO_HT1080 |
| 2665 | UBE2Z | SEQ ID NO. 1060 | 120.314 | 107.571 | 0.894 | HYPOX_O2_HCT116 |
| 2666 | UBE2Z | SEQ ID NO. 1060 | 34.315 | 38.894 | 1.133 | HYPOX_O2_HT1080 |
| 2667 | PANK1 | SEQ ID NO. 1061 | 289.532 | 124.191 | 0.429 | HYPOX_DFO_HCT116 |
| 2668 | PANK1 | SEQ ID NO. 1061 | 2.021 | 4.63 | 2.291 | HYPOX_DFO_HT1080 |
| 2669 | PANK1 | SEQ ID NO. 1061 | 289.532 | 134.172 | 0.463 | HYPOX_O2_HCT116 |
| 2670 | PANK1 | SEQ ID NO. 1061 | 2.021 | 2.464 | 1.229 | HYPOX_O2_HT1080 |
| 2671 | ZNF770 | SEQ ID NO. 1062 | 1617.683 | 4107.965 | 2.539 | HYPOX_DFO_HCT116 |
| 2672 | ZNF770 | SEQ ID NO. 1062 | 575.422 | 955.614 | 1.661 | HYPOX_DFO_HT1080 |
| 2673 | ZNF770 | SEQ ID NO. 1062 | 1617.683 | 3327.145 | 2.056 | HYPOX_O2_HCT116 |
| 2674 | ZNF770 | SEQ ID NO. 1062 | 575.422 | 650.828 | 1.13 | HYPOX_O2_HT1080 |
| 2675 | SERP2 | SEQ ID NO. 1063 | 66.291 | 47.778 | 0.717 | HYPOX_DFO_HCT116 |
| 2676 | SERP2 | SEQ ID NO. 1063 | 6.291 | 6.514 | 1.035 | HYPOX_DFO_HT1080 |
| 2677 | SERP2 | SEQ ID NO. 1063 | 66.817 | 88.297 | 1.34 | HYPOX_O2_HCT116 |
| 2678 | SERP2 | SEQ ID NO. 1063 | 6.291 | 7.714 | 1.226 | HYPOX_O2_HT1080 |
| 2679 | OTUD7A | SEQ ID NO. 1064 | 232.301 | 301.244 | 1.297 | HYPOX_DFO_HCT116 |
| 2680 | OTUD7A | SEQ ID NO. 1064 | 9.735 | 6.377 | 0.655 | HYPOX_DFO_HT1080 |
| 2681 | OTUD7A | SEQ ID NO. 1064 | 232.301 | 444.763 | 1.915 | HYPOX_O2_HCT116 |
| 2682 | OTUD7A | SEQ ID NO. 1064 | 9.735 | 6.594 | 0.677 | HYPOX_O2_HT1080 |
| 2683 | ZNF146 | SEQ ID NO. 1065 | 1963.442 | 3455.817 | 1.76 | HYPOX_DFO_HCT116 |
| 2684 | ZNF146 | SEQ ID NO. 1065 | 640.241 | 1037.934 | 1.616 | HYPOX_DFO_HT1080 |
| 2685 | ZNF146 | SEQ ID NO. 1065 | 1963.442 | 2156.459 | 1.103 | HYPOX_O2_HCT116 |
| 2686 | ZNF146 | SEQ ID NO. 1065 | 640.241 | 666.212 | 1.037 | HYPOX_O2_HT1080 |
| 2687 | ZNF565 | SEQ ID NO. 1066 | 1784.678 | 3693.728 | 2.07 | HYPOX_DFO_HCT116 |
| 2688 | ZNF565 | SEQ ID NO. 1066 | 252.65 | 352.432 | 1.395 | HYPOX_DFO_HT1080 |
| 2689 | ZNF565 | SEQ ID NO. 1066 | 1784.678 | 1978.935 | 1.109 | HYPOX_O2_HCT116 |
| 2690 | ZNF565 | SEQ ID NO. 1066 | 252.65 | 241.866 | 0.957 | HYPOX_O2_HT1080 |

FIG. 1BS -- TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS* |
|---|---|---|---|---|---|---|
| 2691 | NULL | SEQ ID NO. 1067 | 43.14 | 47.667 | 1.105 | HYPOX_DFO_HCT116 |
| 2692 | NULL | SEQ ID NO. 1067 | 2.992 | 3.11 | 1.039 | HYPOX_DFO_HT1080 |
| 2693 | NULL | SEQ ID NO. 1067 | 43.14 | 46.896 | 1.087 | HYPOX_O2_HCT116 |
| 2694 | NULL | SEQ ID NO. 1067 | 2.992 | 3.556 | 1.189 | HYPOX_O2_HT1080 |
| 2695 | HFE | SEQ ID NO. 1068 | 10.06 | 3.091 | 0.307 | HYPOX_DFO_HCT116 |
| 2696 | HFE | SEQ ID NO. 1068 | 1.133 | 1.017 | 0.898 | HYPOX_DFO_HT1080 |
| 2697 | HFE | SEQ ID NO. 1068 | 10.06 | 5.994 | 0.596 | HYPOX_O2_HCT116 |
| 2698 | HFE | SEQ ID NO. 1068 | 1.133 | 1.184 | 1.045 | HYPOX_O2_HT1080 |
| 2699 | DCBLD1 | SEQ ID NO. 1069 | 213.494 | 198.719 | 0.931 | HYPOX_DFO_HCT116 |
| 2700 | DCBLD1 | SEQ ID NO. 1069 | 6.756 | 6.226 | 0.921 | HYPOX_DFO_HT1080 |
| 2701 | DCBLD1 | SEQ ID NO. 1069 | 213.494 | 244.618 | 1.146 | HYPOX_O2_HCT116 |
| 2702 | DCBLD1 | SEQ ID NO. 1069 | 6.756 | 7.703 | 1.14 | HYPOX_O2_HT1080 |
| 2703 | IPPK | SEQ ID NO. 1070 | 20.383 | 64.317 | 3.155 | HYPOX_DFO_HCT116 |
| 2704 | IPPK | SEQ ID NO. 1070 | 6.977 | 8.872 | 1.272 | HYPOX_DFO_HT1080 |
| 2705 | IPPK | SEQ ID NO. 1070 | 20.383 | 42.433 | 2.082 | HYPOX_O2_HCT116 |
| 2706 | IPPK | SEQ ID NO. 1070 | 6.977 | 7.162 | 1.026 | HYPOX_O2_HT1080 |
| 2707 | NULL | SEQ ID NO. 1071 | 2411.409 | 6641.096 | 2.754 | HYPOX_DFO_HCT116 |
| 2708 | NULL | SEQ ID NO. 1071 | 262.672 | 440.755 | 1.678 | HYPOX_DFO_HT1080 |
| 2709 | NULL | SEQ ID NO. 1071 | 2411.409 | 3588.297 | 1.487 | HYPOX_O2_HCT116 |
| 2710 | NULL | SEQ ID NO. 1071 | 262.672 | 247.492 | 0.942 | HYPOX_O2_HT1080 |
| 2711 | NULL | SEQ ID NO. 1072 | 182.353 | 169.367 | 0.926 | HYPOX_DFO_HCT116 |
| 2712 | NULL | SEQ ID NO. 1072 | 8.164 | 8.429 | 1.155 | HYPOX_DFO_HT1080 |
| 2713 | NULL | SEQ ID NO. 1072 | 182.353 | 181.855 | 0.995 | HYPOX_O2_HCT116 |
| 2714 | NULL | SEQ ID NO. 1072 | 8.164 | 6.848 | 0.839 | HYPOX_O2_HT1080 |
| 2715 | 9-Sep | SEQ ID NO. 1073 | 197.635 | 82.069 | 0.415 | HYPOX_DFO_HCT116 |
| 2716 | 9-Sep | SEQ ID NO. 1073 | 5.486 | 2.823 | 0.515 | HYPOX_DFO_HT1080 |
| 2717 | 9-Sep | SEQ ID NO. 1073 | 197.635 | 153.293 | 0.776 | HYPOX_O2_HCT116 |
| 2718 | 9-Sep | SEQ ID NO. 1073 | 5.486 | 4.855 | 0.903 | HYPOX_O2_HT1080 |
| 2719 | POLI | SEQ ID NO. 1074 | 391.129 | 400.174 | 1.023 | HYPOX_DFO_HCT116 |
| 2720 | POLI | SEQ ID NO. 1074 | 33.926 | 40.255 | 1.187 | HYPOX_DFO_HT1080 |
| 2721 | POLI | SEQ ID NO. 1074 | 391.129 | 181.056 | 0.463 | HYPOX_O2_HCT116 |
| 2722 | POLI | SEQ ID NO. 1074 | 33.926 | 45.160 | 1.331 | HYPOX_O2_HT1080 |
| 2723 | GPBP1 | SEQ ID NO. 1075 | 1451.778 | 2992.651 | 2.061 | HYPOX_DFO_HCT116 |
| 2724 | GPBP1 | SEQ ID NO. 1075 | 423.764 | 670.902 | 1.583 | HYPOX_DFO_HT1080 |
| 2725 | GPBP1 | SEQ ID NO. 1075 | 1451.778 | 2858 | 1.968 | HYPOX_O2_HCT116 |
| 2726 | GPBP1 | SEQ ID NO. 1075 | 423.764 | 385.731 | 0.91 | HYPOX_O2_HT1080 |
| 2727 | NULL | SEQ ID NO. 1076 | 226.476 | 247.792 | 1.094 | HYPOX_DFO_HCT116 |
| 2728 | NULL | SEQ ID NO. 1076 | 60.072 | 88.194 | 1.468 | HYPOX_DFO_HT1080 |
| 2729 | NULL | SEQ ID NO. 1076 | 226.476 | 497.821 | 2.198 | HYPOX_O2_HCT116 |
| 2730 | NULL | SEQ ID NO. 1076 | 60.072 | 73.694 | 1.227 | HYPOX_O2_HT1080 |
| 2731 | WDR54 | SEQ ID NO. 1077 | 425.921 | 531.656 | 1.248 | HYPOX_DFO_HCT116 |
| 2732 | WDR54 | SEQ ID NO. 1077 | 73.643 | 237.014 | 3.218 | HYPOX_DFO_HT1080 |
| 2733 | WDR54 | SEQ ID NO. 1077 | 425.921 | 1090.953 | 2.561 | HYPOX_O2_HCT116 |
| 2734 | WDR54 | SEQ ID NO. 1077 | 73.643 | 102.266 | 1.389 | HYPOX_O2_HT1080 |
| 2735 | TCF15 | SEQ ID NO. 1078 | 294.885 | 203.586 | 0.69 | HYPOX_DFO_HCT116 |
| 2736 | TCF15 | SEQ ID NO. 1078 | 7.345 | 18.087 | 2.19 | HYPOX_DFO_HT1080 |
| 2737 | TCF15 | SEQ ID NO. 1078 | 294.885 | 393.375 | 1.334 | HYPOX_O2_HCT116 |
| 2738 | TCF15 | SEQ ID NO. 1078 | 7.345 | 17.967 | 2.446 | HYPOX_O2_HT1080 |

FIG. 1BT – TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_NO_INDUCTION | PROM_ACTIVITY_WI_INDUCTION | INDUCTION_RATIO | INDUCTION_CONDITIONS |
|---|---|---|---|---|---|---|
| 2739 | CYB5R4 | SEQ ID NO. 1079 | 298.544 | 266.261 | 0.892 | HYPOX_DFO_HCT116 |
| 2740 | CYB5R4 | SEQ ID NO. 1079 | 27.363 | 30.095 | 1.1 | HYPOX_DFO_HT1080 |
| 2741 | CYB5R4 | SEQ ID NO. 1079 | 298.544 | 452.321 | 1.515 | HYPOX_O2_HCT116 |
| 2742 | CYB5R4 | SEQ ID NO. 1079 | 27.363 | 24.299 | 0.888 | HYPOX_O2_HT1080 |
| 2743 | C3orf1 | SEQ ID NO. 1080 | 149.45 | 533.6 | 3.57 | HYPOX_DFO_HCT116 |
| 2744 | C3orf1 | SEQ ID NO. 1080 | 25.311 | 34.675 | 1.343 | HYPOX_DFO_HT1080 |
| 2745 | C3orf1 | SEQ ID NO. 1080 | 149.45 | 209.589 | 1.402 | HYPOX_O2_HCT116 |
| 2746 | C3orf1 | SEQ ID NO. 1080 | 25.311 | 21.105 | 0.818 | HYPOX_O2_HT1080 |
| 2747 | A5813 | SEQ ID NO. 1081 | 165.715 | 154.509 | 0.935 | HYPOX_DFO_HCT116 |
| 2748 | A5813 | SEQ ID NO. 1081 | 10.723 | 9.564 | 0.892 | HYPOX_DFO_HT1080 |
| 2749 | A5813 | SEQ ID NO. 1081 | 165.715 | 130.163 | 0.785 | HYPOX_O2_HCT116 |
| 2750 | A5813 | SEQ ID NO. 1081 | 10.723 | 6.895 | 0.643 | HYPOX_O2_HT1080 |
| 2751 | FLJ25715 | SEQ ID NO. 1082 | 2418.929 | 4677.742 | 1.934 | HYPOX_DFO_HCT116 |
| 2752 | FLJ25715 | SEQ ID NO. 1082 | 293.394 | 681.378 | 2.318 | HYPOX_DFO_HT1080 |
| 2753 | FLJ25715 | SEQ ID NO. 1082 | 2418.929 | 4143.174 | 1.713 | HYPOX_O2_HCT116 |
| 2754 | FLJ25715 | SEQ ID NO. 1082 | 293.394 | 380.925 | 1.296 | HYPOX_O2_HT1080 |
| 2755 | CTDP1 | SEQ ID NO. 1083 | 1442.882 | 4699.858 | 3.396 | HYPOX_DFO_HCT116 |
| 2756 | CTDP1 | SEQ ID NO. 1083 | 625.981 | 1127.803 | 1.802 | HYPOX_DFO_HT1080 |
| 2757 | CTDP1 | SEQ ID NO. 1083 | 1442.882 | 3919.671 | 2.717 | HYPOX_O2_HCT116 |
| 2758 | CTDP1 | SEQ ID NO. 1083 | 625.981 | 553.652 | 0.884 | HYPOX_O2_HT1080 |
| 2759 | NULL | SEQ ID NO. 1084 | 194.849 | 217.718 | 1.117 | HYPOX_DFO_HCT116 |
| 2760 | NULL | SEQ ID NO. 1084 | 25.399 | 37.744 | 1.486 | HYPOX_DFO_HT1080 |
| 2761 | NULL | SEQ ID NO. 1084 | 194.849 | 364.833 | 1.871 | HYPOX_O2_HCT116 |
| 2762 | NULL | SEQ ID NO. 1084 | 25.399 | 33.823 | 1.334 | HYPOX_O2_HT1080 |
| 2763 | SNIP | SEQ ID NO. 1085 | 55.776 | 28.071 | 0.503 | HYPOX_DFO_HCT116 |
| 2764 | SNIP | SEQ ID NO. 1085 | 1.96 | 1.351 | 0.699 | HYPOX_DFO_HT1080 |
| 2765 | SNIP | SEQ ID NO. 1085 | 55.776 | 57.016 | 1.022 | HYPOX_O2_HCT116 |
| 2766 | SNIP | SEQ ID NO. 1085 | 1.96 | 1.645 | 0.839 | HYPOX_O2_HT1080 |
| 2767 | GLS2 | SEQ ID NO. 1086 | 94.73 | 49.512 | 0.523 | HYPOX_DFO_HCT116 |
| 2768 | GLS2 | SEQ ID NO. 1086 | 2.728 | 4.373 | 1.603 | HYPOX_DFO_HT1080 |
| 2769 | GLS2 | SEQ ID NO. 1086 | 94.73 | 50.82 | 0.536 | HYPOX_O2_HCT116 |
| 2770 | GLS2 | SEQ ID NO. 1086 | 2.728 | 3.183 | 1.167 | HYPOX_O2_HT1080 |
| 2771 | TYMP | SEQ ID NO. 1087 | 129.755 | 59.123 | 0.456 | HYPOX_DFO_HCT116 |
| 2772 | TYMP | SEQ ID NO. 1087 | 20.283 | 17.221 | 0.849 | HYPOX_DFO_HT1080 |
| 2773 | TYMP | SEQ ID NO. 1087 | 129.755 | 96.108 | 0.741 | HYPOX_O2_HCT116 |
| 2774 | TYMP | SEQ ID NO. 1087 | 20.283 | 15.463 | 0.763 | HYPOX_O2_HT1080 |
| 2775 | NULL | SEQ ID NO. 1088 | 20.767 | 22.188 | 1.068 | HYPOX_DFO_HCT116 |
| 2776 | NULL | SEQ ID NO. 1088 | 2.549 | 2.795 | 1.096 | HYPOX_DFO_HT1080 |
| 2777 | NULL | SEQ ID NO. 1088 | 20.767 | 37.43 | 1.802 | HYPOX_O2_HCT116 |
| 2778 | NULL | SEQ ID NO. 1088 | 2.549 | 2.197 | 0.862 | HYPOX_O2_HT1080 |
| 2779 | KIAA1143 | SEQ ID NO. 1089 | 675.35 | 1381.697 | 2.046 | HYPOX_DFO_HCT116 |
| 2780 | KIAA1143 | SEQ ID NO. 1089 | 267.99 | 379.429 | 1.343 | HYPOX_DFO_HT1080 |
| 2781 | KIAA1143 | SEQ ID NO. 1089 | 675.35 | 732.568 | 1.085 | HYPOX_O2_HCT116 |
| 2782 | KIAA1143 | SEQ ID NO. 1089 | 267.99 | 290.351 | 1.108 | HYPOX_O2_HT1080 |
| 2783 | PDXK | SEQ ID NO. 1090 | 1354.902 | 1972.828 | 1.456 | HYPOX_DFO_HCT116 |
| 2784 | PDXK | SEQ ID NO. 1090 | 244.714 | 457.194 | 1.868 | HYPOX_DFO_HT1080 |
| 2785 | PDXK | SEQ ID NO. 1090 | 1354.902 | 1637.905 | 1.209 | HYPOX_O2_HCT116 |
| 2786 | PDXK | SEQ ID NO. 1090 | 244.714 | 308.47 | 1.261 | HYPOX_O2_HT1080 |

*FIG. 1BU* — TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_W ITH_INDUCTION | INDUCTION_RATIO | INDUCTION_CONDITIONS |
|---|---|---|---|---|---|---|
| 2787 | PRIM2 | SEQ ID NO. 1091 | 1881.581 | 2728.308 | 1.45 | HYPOX_DFO_HCT116 |
| 2788 | PRIM2 | SEQ ID NO. 1091 | 360.337 | 317.274 | 0.88 | HYPOX_DFO_HT1080 |
| 2789 | PRIM2 | SEQ ID NO. 1091 | 1881.581 | 2071.491 | 1.101 | HYPOX_O2_HCT116 |
| 2790 | PRIM2 | SEQ ID NO. 1091 | 360.337 | 241.624 | 0.671 | HYPOX_O2_HT1080 |
| 2791 | SRPK1 | SEQ ID NO. 1092 | 21.81 | 6.854 | 0.314 | HYPOX_DFO_HCT116 |
| 2792 | SRPK1 | SEQ ID NO. 1092 | 1.668 | 1.583 | 0.949 | HYPOX_DFO_HT1080 |
| 2793 | SRPK1 | SEQ ID NO. 1092 | 21.81 | 10.244 | 0.47 | HYPOX_O2_HCT116 |
| 2794 | SRPK1 | SEQ ID NO. 1092 | 1.668 | 2.028 | 1.216 | HYPOX_O2_HT1080 |
| 2795 | ATP4B | SEQ ID NO. 1093 | 13.398 | 4.531 | 0.338 | HYPOX_DFO_HCT116 |
| 2796 | ATP4B | SEQ ID NO. 1093 | 1.698 | 0.699 | 0.411 | HYPOX_DFO_HT1080 |
| 2797 | ATP4B | SEQ ID NO. 1093 | 13.398 | 13.395 | 1 | HYPOX_O2_HCT116 |
| 2798 | ATP4B | SEQ ID NO. 1093 | 1.698 | 1.437 | 0.846 | HYPOX_O2_HT1080 |
| 2799 | PHPT1 | SEQ ID NO. 1094 | 824.438 | 598.639 | 0.726 | HYPOX_DFO_HCT116 |
| 2800 | PHPT1 | SEQ ID NO. 1094 | 147.928 | 122.253 | 0.826 | HYPOX_DFO_HT1080 |
| 2801 | PHPT1 | SEQ ID NO. 1094 | 824.438 | 826.759 | 1.003 | HYPOX_O2_HCT116 |
| 2802 | PHPT1 | SEQ ID NO. 1094 | 147.928 | 124.645 | 0.843 | HYPOX_O2_HT1080 |
| 2803 | LAP3 | SEQ ID NO. 1095 | 100.93 | 137.346 | 1.36 | HYPOX_DFO_HCT116 |
| 2804 | LAP3 | SEQ ID NO. 1095 | 22.153 | 22.673 | 1.023 | HYPOX_DFO_HT1080 |
| 2805 | LAP3 | SEQ ID NO. 1095 | 100.93 | 117.813 | 1.167 | HYPOX_O2_HCT116 |
| 2806 | LAP3 | SEQ ID NO. 1095 | 22.133 | 19.387 | 0.876 | HYPOX_O2_HT1080 |
| 2807 | NCOR1 | SEQ ID NO. 1096 | 387.739 | 569.853 | 1.47 | HYPOX_DFO_HCT116 |
| 2808 | NCOR1 | SEQ ID NO. 1096 | 126.745 | 112.368 | 0.887 | HYPOX_DFO_HT1080 |
| 2809 | NCOR1 | SEQ ID NO. 1096 | 387.739 | 510.488 | 1.317 | HYPOX_O2_HCT116 |
| 2810 | NCOR1 | SEQ ID NO. 1096 | 126.745 | 92.541 | 0.73 | HYPOX_O2_HT1080 |
| 2811 | C7orf42 | SEQ ID NO. 1097 | 268.202 | 636.238 | 2.208 | HYPOX_DFO_HCT116 |
| 2812 | C7orf42 | SEQ ID NO. 1097 | 59.895 | 103.332 | 1.725 | HYPOX_DFO_HT1080 |
| 2813 | C7orf42 | SEQ ID NO. 1097 | 288.202 | 407.374 | 1.413 | HYPOX_O2_HCT116 |
| 2814 | C7orf42 | SEQ ID NO. 1097 | 59.895 | 74.214 | 1.239 | HYPOX_O2_HT1080 |
| 2815 | NRLL | SEQ ID NO. 1098 | 1.855 | 0.747 | 0.402 | HYPOX_DFO_HCT116 |
| 2816 | NRLL | SEQ ID NO. 1098 | 0.163 | 0.137 | 0.845 | HYPOX_DFO_HT1080 |
| 2817 | NRLL | SEQ ID NO. 1098 | 1.855 | 1.192 | 0.642 | HYPOX_O2_HCT116 |
| 2818 | NRLL | SEQ ID NO. 1098 | 0.163 | 0.096 | 0.589 | HYPOX_O2_HT1080 |
| 2819 | IRSM2 | SEQ ID NO. 1099 | 304.406 | 295.236 | 0.97 | HYPOX_DFO_HCT116 |
| 2820 | IRSM2 | SEQ ID NO. 1099 | 6.601 | 5.569 | 0.844 | HYPOX_DFO_HT1080 |
| 2821 | IRSM2 | SEQ ID NO. 1099 | 304.406 | 221.869 | 0.729 | HYPOX_O2_HCT116 |
| 2822 | IRSM2 | SEQ ID NO. 1099 | 6.601 | 5.935 | 0.899 | HYPOX_O2_HT1080 |
| 2823 | VAV2 | SEQ ID NO. 1100 | 162.438 | 101.883 | 0.627 | HYPOX_DFO_HCT116 |
| 2824 | VAV2 | SEQ ID NO. 1100 | 39.299 | 34.038 | 0.866 | HYPOX_DFO_HT1080 |
| 2825 | VAV2 | SEQ ID NO. 1100 | 162.438 | 194.623 | 1.198 | HYPOX_O2_HCT116 |
| 2826 | VAV2 | SEQ ID NO. 1100 | 39.299 | 40.143 | 1.021 | HYPOX_O2_HT1080 |
| 2827 | NRLL | SEQ ID NO. 1101 | 1669.422 | 3724.206 | 2.23 | HYPOX_DFO_HCT116 |
| 2828 | NRLL | SEQ ID NO. 1101 | 519.428 | 435.218 | 0.838 | HYPOX_DFO_HT1080 |
| 2829 | NRLL | SEQ ID NO. 1101 | 1669.422 | 2871.16 | 1.72 | HYPOX_O2_HCT116 |
| 2830 | NRLL | SEQ ID NO. 1101 | 519.428 | 420.543 | 0.81 | HYPOX_O2_HT1080 |
| 2831 | PLXDC1 | SEQ ID NO. 1102 | 108.693 | 73.802 | 0.679 | HYPOX_DFO_HCT116 |
| 2832 | PLXDC1 | SEQ ID NO. 1102 | 5.387 | 5.168 | 0.959 | HYPOX_DFO_HT1080 |
| 2833 | PLXDC1 | SEQ ID NO. 1102 | 106.693 | 98.36 | 0.905 | HYPOX_O2_HCT116 |
| 2834 | PLXDC1 | SEQ ID NO. 1102 | 5.387 | 4.65 | 0.863 | HYPOX_O2_HT1080 |

FIG. 1BV – TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_ RATIO | INDUCTION_CONDITIONS |
|---|---|---|---|---|---|---|
| 2835 | C12orf45 | SEQ ID NO. 1103 | 472.976 | 285.246 | 0.603 | HYPOX_DFO_HCT116 |
| 2836 | C12orf45 | SEQ ID NO. 1103 | 94.098 | 143.089 | 1.52 | HYPOX_DFO_HT1080 |
| 2837 | C12orf45 | SEQ ID NO. 1103 | 472.976 | 254.565 | 0.538 | HYPOX_O2_HCT116 |
| 2838 | C12orf45 | SEQ ID NO. 1103 | 94.098 | 99.268 | 1.055 | HYPOX_O2_HT1080 |
| 2839 | INA | SEQ ID NO. 1104 | 231.592 | 117.800 | 0.509 | HYPOX_DFO_HCT116 |
| 2840 | INA | SEQ ID NO. 1104 | 10.524 | 9.784 | 0.93 | HYPOX_DFO_HT1080 |
| 2841 | INA | SEQ ID NO. 1104 | 231.592 | 170.271 | 0.735 | HYPOX_O2_HCT116 |
| 2842 | INA | SEQ ID NO. 1104 | 10.524 | 10.297 | 0.979 | HYPOX_O2_HT1080 |
| 2843 | VAPA | SEQ ID NO. 1105 | 1244.997 | 917.092 | 0.737 | HYPOX_DFO_HCT116 |
| 2844 | VAPA | SEQ ID NO. 1105 | 407.734 | 494.577 | 1.213 | HYPOX_DFO_HT1080 |
| 2845 | VAPA | SEQ ID NO. 1105 | 1244.997 | 988.442 | 0.794 | HYPOX_O2_HCT116 |
| 2846 | VAPA | SEQ ID NO. 1105 | 407.734 | 327.697 | 0.804 | HYPOX_O2_HT1080 |
| 2847 | KIF15 | SEQ ID NO. 1106 | 83.514 | 84.71 | 1.014 | HYPOX_DFO_HCT116 |
| 2848 | KIF15 | SEQ ID NO. 1106 | 11.71 | 11.988 | 1.024 | HYPOX_DFO_HT1080 |
| 2849 | KIF15 | SEQ ID NO. 1106 | 83.514 | 46.495 | 0.557 | HYPOX_O2_HCT116 |
| 2850 | KIF15 | SEQ ID NO. 1106 | 11.71 | 14.674 | 1.253 | HYPOX_O2_HT1080 |
| 2851 | TBRG4 | SEQ ID NO. 1107 | 2104.353 | 6899.746 | 3.279 | HYPOX_DFO_HCT116 |
| 2852 | TBRG4 | SEQ ID NO. 1107 | 246.24 | 505.45 | 2.053 | HYPOX_DFO_HT1080 |
| 2853 | TBRG4 | SEQ ID NO. 1107 | 2104.353 | 2994.478 | 1.423 | HYPOX_O2_HCT116 |
| 2854 | TBRG4 | SEQ ID NO. 1107 | 246.24 | 268.537 | 1.091 | HYPOX_O2_HT1080 |
| 2855 | AP3M2 | SEQ ID NO. 1108 | 108.847 | 167.579 | 1.54 | HYPOX_DFO_HCT116 |
| 2856 | AP3M2 | SEQ ID NO. 1108 | 15.712 | 10.633 | 0.677 | HYPOX_DFO_HT1080 |
| 2857 | AP3M2 | SEQ ID NO. 1108 | 108.847 | 101.389 | 0.931 | HYPOX_O2_HCT116 |
| 2858 | AP3M2 | SEQ ID NO. 1108 | 15.712 | 10.086 | 0.642 | HYPOX_O2_HT1080 |
| 2859 | ANAPC2 | SEQ ID NO. 1109 | 630.063 | 1072.577 | 1.702 | HYPOX_DFO_HCT116 |
| 2860 | ANAPC2 | SEQ ID NO. 1109 | 163.306 | 168.089 | 1.029 | HYPOX_DFO_HT1080 |
| 2861 | ANAPC2 | SEQ ID NO. 1109 | 630.063 | 988.001 | 1.568 | HYPOX_O2_HCT116 |
| 2862 | ANAPC2 | SEQ ID NO. 1109 | 163.306 | 134.825 | 0.826 | HYPOX_O2_HT1080 |
| 2863 | NULL | SEQ ID NO. 1110 | 5.117 | 1.983 | 0.388 | HYPOX_DFO_HCT116 |
| 2864 | NULL | SEQ ID NO. 1110 | 0.949 | 1.796 | 1.892 | HYPOX_DFO_HT1080 |
| 2865 | NULL | SEQ ID NO. 1110 | 5.117 | 4.492 | 0.878 | HYPOX_O2_HCT116 |
| 2866 | NULL | SEQ ID NO. 1110 | 0.949 | 1.308 | 1.378 | HYPOX_O2_HT1080 |
| 2867 | PDZD11 | SEQ ID NO. 1111 | 1445.058 | 1699.085 | 1.176 | HYPOX_DFO_HCT116 |
| 2868 | PDZD11 | SEQ ID NO. 1111 | 481.755 | 413.481 | 0.858 | HYPOX_DFO_HT1080 |
| 2869 | PDZD11 | SEQ ID NO. 1111 | 1445.058 | 1567.971 | 1.085 | HYPOX_O2_HCT116 |
| 2870 | PDZD11 | SEQ ID NO. 1111 | 481.755 | 324.456 | 0.673 | HYPOX_O2_HT1080 |
| 2871 | PC | SEQ ID NO. 1111 | 233.302 | 236.092 | 1.012 | HYPOX_DFO_HCT116 |
| 2872 | PC | SEQ ID NO. 1111 | 20.68 | 22.183 | 1.073 | HYPOX_DFO_HT1080 |
| 2873 | PC | SEQ ID NO. 1111 | 233.302 | 314.101 | 1.346 | HYPOX_O2_HCT116 |
| 2874 | PC | SEQ ID NO. 1111 | 20.68 | 15.439 | 0.747 | HYPOX_O2_HT1080 |
| 2875 | CHD9 | SEQ ID NO. 1112 | 127.734 | 111.581 | 0.874 | HYPOX_DFO_HCT116 |
| 2876 | CHD9 | SEQ ID NO. 1112 | 16.794 | 11.343 | 0.675 | HYPOX_DFO_HT1080 |
| 2877 | CHD9 | SEQ ID NO. 1112 | 127.734 | 102.077 | 0.799 | HYPOX_O2_HCT116 |
| 2878 | CHD9 | SEQ ID NO. 1112 | 16.794 | 9.731 | 0.579 | HYPOX_O2_HT1080 |

FIG. 1BW -- TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS |
|---|---|---|---|---|---|---|
| 2879 | CYB561 | SEQ ID NO. 1113 | 185.999 | 108.019 | 0.581 | HYPOX_DFO_HCT116 |
| 2880 | CYB561 | SEQ ID NO. 1113 | 8.146 | 5.401 | 0.663 | HYPOX_DFO_HT1080 |
| 2881 | CYB561 | SEQ ID NO. 1113 | 185.999 | 184.314 | 0.991 | HYPOX_O2_HCT116 |
| 2882 | CYB561 | SEQ ID NO. 1113 | 8.146 | 6.956 | 0.854 | HYPOX_O2_HT1080 |
| 2883 | COL5A1 | SEQ ID NO. 1114 | 850.282 | 470.701 | 0.554 | HYPOX_DFO_HCT116 |
| 2884 | COL5A1 | SEQ ID NO. 1114 | 56.104 | 37.105 | 0.661 | HYPOX_DFO_HT1080 |
| 2885 | COL5A1 | SEQ ID NO. 1114 | 850.282 | 672.772 | 0.791 | HYPOX_O2_HCT116 |
| 2886 | COL5A1 | SEQ ID NO. 1114 | 56.104 | 60.442 | 1.077 | HYPOX_O2_HT1080 |
| 2887 | NFIX | SEQ ID NO. 1115 | 68.751 | 65.533 | 0.953 | HYPOX_DFO_HCT116 |
| 2888 | NFIX | SEQ ID NO. 1115 | 4.008 | 9.405 | 2.346 | HYPOX_DFO_HT1080 |
| 2889 | NFIX | SEQ ID NO. 1115 | 68.751 | 79.18 | 1.152 | HYPOX_O2_HCT116 |
| 2890 | NFIX | SEQ ID NO. 1115 | 4.008 | 8.17 | 2.038 | HYPOX_O2_HT1080 |
| 2891 | NULL | SEQ ID NO. 1116 | 4019.52 | 2652.756 | 0.66 | HYPOX_DFO_HCT116 |
| 2892 | NULL | SEQ ID NO. 1116 | 1622.326 | 1172.313 | 0.723 | HYPOX_DFO_HT1080 |
| 2893 | NULL | SEQ ID NO. 1116 | 4019.52 | 5181.82 | 1.289 | HYPOX_O2_HCT116 |
| 2894 | NULL | SEQ ID NO. 1116 | 1622.326 | 1204.6 | 0.743 | HYPOX_O2_HT1080 |
| 2895 | IRF9 | SEQ ID NO. 1117 | 0.203 | 0.352 | 1.73 | HYPOX_DFO_HCT116 |
| 2896 | IRF9 | SEQ ID NO. 1117 | 0.077 | 0.115 | 1.499 | HYPOX_DFO_HT1080 |
| 2897 | IRF9 | SEQ ID NO. 1117 | 0.203 | 0.568 | 2.792 | HYPOX_O2_HCT116 |
| 2898 | IRF9 | SEQ ID NO. 1117 | 0.077 | 0.571 | 7.423 | HYPOX_O2_HT1080 |
| 2899 | COL8A2 | SEQ ID NO. 1118 | 27.781 | 7.244 | 0.261 | HYPOX_DFO_HCT116 |
| 2900 | COL8A2 | SEQ ID NO. 1118 | 1.184 | 1.337 | 1.129 | HYPOX_DFO_HT1080 |
| 2901 | COL8A2 | SEQ ID NO. 1118 | 27.781 | 17.752 | 0.639 | HYPOX_O2_HCT116 |
| 2902 | COL8A2 | SEQ ID NO. 1118 | 1.184 | 1.14 | 0.962 | HYPOX_O2_HT1080 |
| 2903 | RGMB | SEQ ID NO. 1119 | 225.195 | 123.023 | 0.542 | HYPOX_DFO_HCT116 |
| 2904 | RGMB | SEQ ID NO. 1119 | 37.482 | 21.035 | 0.561 | HYPOX_DFO_HT1080 |
| 2905 | RGMB | SEQ ID NO. 1119 | 225.195 | 180.103 | 0.8 | HYPOX_O2_HCT116 |
| 2906 | RGMB | SEQ ID NO. 1119 | 37.482 | 22.524 | 0.601 | HYPOX_O2_HT1080 |
| 2907 | MZF1 | SEQ ID NO. 1120 | 898.437 | 1144.64 | 1.274 | HYPOX_DFO_HCT116 |
| 2908 | MZF1 | SEQ ID NO. 1120 | 259.175 | 511.137 | 1.972 | HYPOX_DFO_HT1080 |
| 2909 | MZF1 | SEQ ID NO. 1120 | 898.437 | 1650.623 | 1.837 | HYPOX_O2_HCT116 |
| 2910 | MZF1 | SEQ ID NO. 1120 | 259.175 | 295.531 | 1.14 | HYPOX_O2_HT1080 |
| 2911 | CSGALNACT2 | SEQ ID NO. 1121 | 319.7 | 235.41 | 0.736 | HYPOX_DFO_HCT116 |
| 2912 | CSGALNACT2 | SEQ ID NO. 1121 | 37.217 | 45.961 | 1.235 | HYPOX_DFO_HT1080 |
| 2913 | CSGALNACT2 | SEQ ID NO. 1121 | 319.7 | 571.559 | 1.788 | HYPOX_O2_HCT116 |
| 2914 | CSGALNACT2 | SEQ ID NO. 1121 | 37.217 | 41.782 | 1.123 | HYPOX_O2_HT1080 |
| 2915 | PGD | SEQ ID NO. 1121 | 1078.115 | 495.957 | 0.46 | HYPOX_DFO_HCT116 |
| 2916 | PGD | SEQ ID NO. 1121 | 58.103 | 34.036 | 0.586 | HYPOX_DFO_HT1080 |
| 2917 | PGD | SEQ ID NO. 1121 | 1078.115 | 831.598 | 0.771 | HYPOX_O2_HCT116 |
| 2918 | PGD | SEQ ID NO. 1121 | 58.103 | 40.498 | 0.697 | HYPOX_O2_HT1080 |
| 2919 | VCAM1 | SEQ ID NO. 1121 | 63.318 | 21.12 | 0.334 | HYPOX_DFO_HCT116 |
| 2920 | VCAM1 | SEQ ID NO. 1121 | 2.879 | 1.376 | 0.478 | HYPOX_DFO_HT1080 |
| 2921 | VCAM1 | SEQ ID NO. 1121 | 63.318 | 35.856 | 0.566 | HYPOX_O2_HCT116 |
| 2922 | VCAM1 | SEQ ID NO. 1121 | 2.879 | 2.007 | 0.697 | HYPOX_O2_HT1080 |

FIG. 1BX -- TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_WI TH_INDUCTION | INDUCTION _RATIO | INDUCTION_CONDITIONS |
|---|---|---|---|---|---|---|
| 2923 | MXI1 | SEQ ID NO. 1122 | 117.161 | 76.35 | 0.652 | HYPOX_DFO_HCT116 |
| 2924 | MXI1 | SEQ ID NO. 1122 | 11.146 | 10.291 | 0.923 | HYPOX_DFO_HT1080 |
| 2925 | MXI1 | SEQ ID NO. 1122 | 117.161 | 84.411 | 0.72 | HYPOX_O2_HCT116 |
| 2926 | MXI1 | SEQ ID NO. 1122 | 11.146 | 6.241 | 0.56 | HYPOX_O2_HT1080 |
| 2927 | MXI1 | SEQ ID NO. 1123 | 249.783 | 143.25 | 0.574 | HYPOX_DFO_HCT116 |
| 2928 | MXI1 | SEQ ID NO. 1123 | 2.504 | 1.715 | 0.685 | HYPOX_DFO_HT1080 |
| 2929 | MXI1 | SEQ ID NO. 1123 | 249.783 | 127.591 | 0.511 | HYPOX_O2_HCT116 |
| 2930 | MXI1 | SEQ ID NO. 1123 | 2.504 | 1.766 | 0.705 | HYPOX_O2_HT1080 |
| 2931 | CDH15 | SEQ ID NO. 1124 | 233.161 | 214.473 | 0.92 | HYPOX_DFO_HCT116 |
| 2932 | CDH15 | SEQ ID NO. 1124 | 9.087 | 37.122 | 4.085 | HYPOX_DFO_HT1080 |
| 2933 | CDH15 | SEQ ID NO. 1124 | 233.161 | 212 | 0.909 | HYPOX_O2_HCT116 |
| 2934 | CDH15 | SEQ ID NO. 1124 | 9.087 | 19.252 | 2.119 | HYPOX_O2_HT1080 |
| 2935 | FOXR | SEQ ID NO. 1125 | 451.511 | 589.931 | 1.307 | HYPOX_DFO_HCT116 |
| 2936 | FOXR | SEQ ID NO. 1125 | 127.31 | 162.734 | 1.278 | HYPOX_DFO_HT1080 |
| 2937 | FOXR | SEQ ID NO. 1125 | 451.511 | 447.571 | 0.991 | HYPOX_O2_HCT116 |
| 2938 | FOXR | SEQ ID NO. 1125 | 127.31 | 87.618 | 0.688 | HYPOX_O2_HT1080 |
| 2939 | COX7A2L | SEQ ID NO. 1126 | 1618.004 | 2467.981 | 1.527 | HYPOX_DFO_HCT116 |
| 2940 | COX7A2L | SEQ ID NO. 1126 | 538.856 | 469.048 | 0.87 | HYPOX_DFO_HT1080 |
| 2941 | COX7A2L | SEQ ID NO. 1126 | 1618.004 | 2917.884 | 1.806 | HYPOX_O2_HCT116 |
| 2942 | COX7A2L | SEQ ID NO. 1126 | 538.856 | 343.284 | 0.637 | HYPOX_O2_HT1080 |
| 2943 | APOBEC3C | SEQ ID NO. 1127 | 228.438 | 69.388 | 0.306 | HYPOX_DFO_HCT116 |
| 2944 | APOBEC3C | SEQ ID NO. 1127 | 12.139 | 6.125 | 0.505 | HYPOX_DFO_HT1080 |
| 2945 | APOBEC3C | SEQ ID NO. 1127 | 228.438 | 149.426 | 0.66 | HYPOX_O2_HCT116 |
| 2946 | APOBEC3C | SEQ ID NO. 1127 | 12.139 | 9.694 | 0.799 | HYPOX_O2_HT1080 |
| 2947 | SEC62 | SEQ ID NO. 1128 | 244.948 | 98.272 | 0.401 | HYPOX_DFO_HCT116 |
| 2948 | SEC62 | SEQ ID NO. 1128 | 109.85 | 61.217 | 0.557 | HYPOX_DFO_HT1080 |
| 2949 | SEC62 | SEQ ID NO. 1128 | 244.948 | 167.911 | 0.685 | HYPOX_O2_HCT116 |
| 2950 | SEC62 | SEQ ID NO. 1128 | 109.85 | 100.495 | 0.915 | HYPOX_O2_HT1080 |
| 2951 | SEC62 | SEQ ID NO. 1129 | 32.43 | 9.335 | 0.288 | HYPOX_DFO_HCT116 |
| 2952 | SEC62 | SEQ ID NO. 1129 | 0.883 | 1.269 | 1.437 | HYPOX_DFO_HT1080 |
| 2953 | SEC62 | SEQ ID NO. 1129 | 32.43 | 13.575 | 0.419 | HYPOX_O2_HCT116 |
| 2954 | SEC62 | SEQ ID NO. 1129 | 0.883 | 0.549 | 0.622 | HYPOX_O2_HT1080 |
| 2955 | SEC62 | SEQ ID NO. 1129 | 2.535 | 1.7 | 0.671 | HYPOX_DFO_HCT116 |
| 2956 | SEC62 | SEQ ID NO. 1130 | 0.456 | 0.478 | 1.048 | HYPOX_DFO_HT1080 |
| 2957 | SEC62 | SEQ ID NO. 1130 | 2.535 | 1.836 | 0.724 | HYPOX_O2_HCT116 |
| 2958 | SEC62 | SEQ ID NO. 1130 | 0.456 | 0.381 | 0.835 | HYPOX_O2_HT1080 |
| 2959 | MAPK10 | SEQ ID NO. 1131 | 32.522 | 11.66 | 0.359 | HYPOX_DFO_HCT116 |
| 2960 | MAPK10 | SEQ ID NO. 1131 | 11.962 | 7.743 | 0.647 | HYPOX_DFO_HT1080 |
| 2961 | MAPK10 | SEQ ID NO. 1131 | 32.522 | 10.983 | 0.338 | HYPOX_O2_HCT116 |
| 2962 | MAPK10 | SEQ ID NO. 1131 | 11.962 | 8.437 | 0.705 | HYPOX_O2_HT1080 |
| 2963 | MAPK10 | SEQ ID NO. 1132 | 3.778 | 1.549 | 0.41 | HYPOX_DFO_HCT116 |
| 2964 | MAPK10 | SEQ ID NO. 1132 | 0.276 | 0.186 | 0.674 | HYPOX_DFO_HT1080 |
| 2965 | MAPK10 | SEQ ID NO. 1132 | 3.778 | 3.258 | 0.862 | HYPOX_O2_HCT116 |
| 2966 | MAPK10 | SEQ ID NO. 1132 | 0.276 | 0.179 | 0.649 | HYPOX_O2_HT1080 |
| 2967 | GCLC | SEQ ID NO. 1133 | 427.273 | 326.084 | 0.763 | HYPOX_DFO_HCT116 |
| 2968 | GCLC | SEQ ID NO. 1133 | 26.311 | 23.887 | 0.909 | HYPOX_DFO_HT1080 |
| 2969 | GCLC | SEQ ID NO. 1133 | 427.273 | 213.887 | 0.501 | HYPOX_O2_HCT116 |
| 2970 | GCLC | SEQ ID NO. 1133 | 26.311 | 16.274 | 0.619 | HYPOX_O2_HT1080 |

FIG. 1BY -- TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_NO_INDUCTION | PROM_ACTIVITY_WITH_INDUCTION | PROM_ACTIVITY_WI_INDUCTION_RATIO | INDUCTION_CONDITIONS |
|---|---|---|---|---|---|---|
| 2971 | RHOBTB2 | SEQ ID NO. 1134 | 88.457 | 38.354 | 0.433 | HYPOX_DFO_HCT116 |
| 2972 | RHOBTB2 | SEQ ID NO. 1134 | 17.727 | 14.451 | 0.815 | HYPOX_DFO_HT1080 |
| 2973 | RHOBTB2 | SEQ ID NO. 1134 | 88.457 | 76.841 | 0.869 | HYPOX_O2_HCT116 |
| 2974 | RHOBTB2 | SEQ ID NO. 1134 | 17.727 | 13.943 | 0.787 | HYPOX_O2_HT1080 |
| 2975 | NDRG1 | SEQ ID NO. 1135 | 2939.795 | 4068.42 | 1.384 | HYPOX_DFO_HCT116 |
| 2976 | NDRG1 | SEQ ID NO. 1135 | 256.435 | 372.719 | 1.453 | HYPOX_DFO_HT1080 |
| 2977 | NDRG1 | SEQ ID NO. 1135 | 2939.795 | 5016.674 | 1.706 | HYPOX_O2_HCT116 |
| 2978 | NDRG1 | SEQ ID NO. 1135 | 256.435 | 252.6656 | 0.985 | HYPOX_O2_HT1080 |
| 2979 | PAPPA | SEQ ID NO. 1136 | 2.441 | 3.112 | 1.275 | HYPOX_DFO_HCT116 |
| 2980 | PAPPA | SEQ ID NO. 1136 | 1.21 | 1.817 | 1.503 | HYPOX_DFO_HT1080 |
| 2981 | PAPPA | SEQ ID NO. 1136 | 2.441 | 2.165 | 0.887 | HYPOX_O2_HCT116 |
| 2982 | PAPPA | SEQ ID NO. 1136 | 1.21 | 0.771 | 0.637 | HYPOX_O2_HT1080 |
| 2983 | PAPPA | SEQ ID NO. 1137 | 71.409 | 29.141 | 0.408 | HYPOX_DFO_HCT116 |
| 2984 | PAPPA | SEQ ID NO. 1137 | 1.068 | 0.726 | 0.68 | HYPOX_DFO_HT1080 |
| 2985 | PAPPA | SEQ ID NO. 1137 | 71.409 | 29.606 | 0.415 | HYPOX_O2_HCT116 |
| 2986 | PAPPA | SEQ ID NO. 1137 | 1.068 | 0.811 | 0.76 | HYPOX_O2_HT1080 |
| 2987 | PTGES | SEQ ID NO. 1138 | 10.928 | 18.356 | 1.68 | HYPOX_DFO_HCT116 |
| 2988 | PTGES | SEQ ID NO. 1138 | 1.589 | 1.667 | 1.049 | HYPOX_DFO_HT1080 |
| 2989 | PTGES | SEQ ID NO. 1138 | 10.928 | 10.799 | 0.968 | HYPOX_O2_HCT116 |
| 2990 | PTGES | SEQ ID NO. 1138 | 1.589 | 3.935 | 2.477 | HYPOX_O2_HT1080 |
| 2991 | HOOK1 | SEQ ID NO. 1139 | 8.206 | 4.065 | 0.495 | HYPOX_DFO_HCT116 |
| 2992 | HOOK1 | SEQ ID NO. 1139 | 0.311 | 0.155 | 0.5 | HYPOX_DFO_HT1080 |
| 2993 | HOOK1 | SEQ ID NO. 1139 | 8.206 | 5.33 | 0.65 | HYPOX_O2_HCT116 |
| 2994 | HOOK1 | SEQ ID NO. 1139 | 0.311 | 0.226 | 0.727 | HYPOX_O2_HT1080 |
| 2995 | APOA2 | SEQ ID NO. 1139 | 6.296 | 6.93 | 1.418 | HYPOX_DFO_HCT116 |
| 2996 | APOA2 | SEQ ID NO. 1139 | 0.293 | 0.335 | 1.148 | HYPOX_DFO_HT1080 |
| 2997 | APOA2 | SEQ ID NO. 1139 | 6.296 | 3.677 | 0.584 | HYPOX_O2_HCT116 |
| 2998 | APOA2 | SEQ ID NO. 1139 | 0.293 | 0.822 | 2.808 | HYPOX_O2_HT1080 |
| 2999 | HSP90AA1 | SEQ ID NO. 1140 | 231.185 | 301.027 | 1.302 | HYPOX_DFO_HCT116 |
| 3000 | HSP90AA1 | SEQ ID NO. 1140 | 56.298 | 76.957 | 1.367 | HYPOX_DFO_HT1080 |
| 3001 | HSP90AA1 | SEQ ID NO. 1140 | 231.185 | 263.914 | 1.142 | HYPOX_O2_HCT116 |
| 3002 | HSP90AA1 | SEQ ID NO. 1140 | 56.298 | 77.36 | 1.374 | HYPOX_O2_HT1080 |
| 3003 | MT3 | SEQ ID NO. 1141 | 32.693 | 56.563 | 1.733 | HYPOX_DFO_HCT116 |
| 3004 | MT3 | SEQ ID NO. 1141 | 1.124 | 2.204 | 1.96 | HYPOX_DFO_HT1080 |
| 3005 | MT3 | SEQ ID NO. 1141 | 32.693 | 75.536 | 2.315 | HYPOX_O2_HCT116 |
| 3006 | MT3 | SEQ ID NO. 1141 | 1.124 | 2.135 | 1.898 | HYPOX_O2_HT1080 |
| 3007 | NOS2A | SEQ ID NO. 1142 | 240.793 | 136.88 | 0.568 | HYPOX_DFO_HCT116 |
| 3008 | NOS2A | SEQ ID NO. 1142 | 36.486 | 38.019 | 1.042 | HYPOX_DFO_HT1080 |
| 3009 | NOS2A | SEQ ID NO. 1142 | 240.793 | 137.713 | 0.572 | HYPOX_O2_HCT116 |
| 3010 | NOS2A | SEQ ID NO. 1142 | 36.486 | 27.474 | 0.753 | HYPOX_O2_HT1080 |
| 3011 | IL1R2 | SEQ ID NO. 1143 | 53.825 | 37.34 | 0.694 | HYPOX_DFO_HCT116 |
| 3012 | IL1R2 | SEQ ID NO. 1143 | 4.362 | 4.348 | 0.997 | HYPOX_DFO_HT1080 |
| 3013 | IL1R2 | SEQ ID NO. 1143 | 53.825 | 37.555 | 0.698 | HYPOX_O2_HCT116 |
| 3014 | IL1R2 | SEQ ID NO. 1143 | 4.362 | 2.974 | 0.682 | HYPOX_O2_HT1080 |
| 3015 | IL1R1 | SEQ ID NO. 1144 | 91.2 | 53.659 | 0.588 | HYPOX_DFO_HCT116 |
| 3016 | IL1R1 | SEQ ID NO. 1144 | 2.335 | 2.384 | 1.021 | HYPOX_DFO_HT1080 |
| 3017 | IL1R1 | SEQ ID NO. 1144 | 91.2 | 106.45 | 1.167 | HYPOX_O2_HCT116 |
| 3018 | IL1R1 | SEQ ID NO. 1144 | 2.335 | 2.126 | 0.911 | HYPOX_O2_HT1080 |

FIG. 1BZ — TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_M O_INDUCTION | PROM_ACTIVITY_W TH_INDUCTION | PROM_ACTIVITY_WI _RATIO | INDUCTION | INDUCTION_CONDITIONS |
|---|---|---|---|---|---|---|---|
| 3019 | TXNRD2 | SEQ ID NO. 1145 | 9.209 | 5.261 | 0.571 | | HYPOX_DFO_HCT116 |
| 3020 | TXNRD2 | SEQ ID NO. 1145 | 1.254 | 1.404 | 1.119 | | HYPOX_DFO_HT1080 |
| 3021 | TXNRD2 | SEQ ID NO. 1145 | 9.209 | 5.378 | 0.584 | | HYPOX_O2_HCT116 |
| 3022 | TXNRD2 | SEQ ID NO. 1145 | 1.254 | 1.457 | 1.162 | | HYPOX_O2_HT1080 |
| 3023 | GPX1 | SEQ ID NO. 1145 | 292.708 | 333.944 | 1.141 | | HYPOX_DFO_HCT116 |
| 3024 | GPX1 | SEQ ID NO. 1145 | 75.309 | 95.871 | 1.273 | | HYPOX_DFO_HT1080 |
| 3025 | GPX1 | SEQ ID NO. 1145 | 292.708 | 227.491 | 0.777 | | HYPOX_O2_HCT116 |
| 3026 | GPX1 | SEQ ID NO. 1145 | 75.309 | 74.135 | 0.984 | | HYPOX_O2_HT1080 |
| 3027 | TFRC | SEQ ID NO. 1146 | 11.089 | 3.389 | 0.306 | | HYPOX_DFO_HCT116 |
| 3028 | TFRC | SEQ ID NO. 1146 | 0.877 | 0.716 | 0.817 | | HYPOX_DFO_HT1080 |
| 3029 | TFRC | SEQ ID NO. 1146 | 11.089 | 2.88 | 0.258 | | HYPOX_O2_HCT116 |
| 3030 | TFRC | SEQ ID NO. 1146 | 0.877 | 0.932 | 1.066 | | HYPOX_O2_HT1080 |
| 3031 | VEGFA | SEQ ID NO. 1147 | 718.472 | 252.636 | 0.351 | | HYPOX_DFO_HCT116 |
| 3032 | VEGFA | SEQ ID NO. 1147 | 26.895 | 21.278 | 0.791 | | HYPOX_DFO_HT1080 |
| 3033 | VEGFA | SEQ ID NO. 1147 | 718.472 | 634.547 | 0.883 | | HYPOX_O2_HCT116 |
| 3034 | VEGFA | SEQ ID NO. 1147 | 26.895 | 30.382 | 1.13 | | HYPOX_O2_HT1080 |
| 3035 | AK3 | SEQ ID NO. 1148 | 2.735 | 2.654 | 0.963 | | HYPOX_DFO_HCT116 |
| 3036 | AK3 | SEQ ID NO. 1148 | 0.735 | 2.72 | 3.7 | | HYPOX_DFO_HT1080 |
| 3037 | AK3 | SEQ ID NO. 1148 | 2.735 | 6.365 | 2.545 | | HYPOX_O2_HCT116 |
| 3038 | AK3 | SEQ ID NO. 1148 | 0.735 | 1.692 | 2.302 | | HYPOX_O2_HT1080 |
| 3039 | APOA2 | SEQ ID NO. 1149 | 8.311 | 6.751 | 0.812 | | HYPOX_DFO_HCT116 |
| 3040 | APOA2 | SEQ ID NO. 1149 | 0.695 | 0.637 | 0.915 | | HYPOX_DFO_HT1080 |
| 3041 | APOA2 | SEQ ID NO. 1149 | 8.311 | 6.996 | 0.842 | | HYPOX_O2_HCT116 |
| 3042 | APOA2 | SEQ ID NO. 1149 | 0.695 | 0.498 | 0.716 | | HYPOX_O2_HT1080 |
| 3043 | APAF1 | SEQ ID NO. 1150 | 2.902 | 1.073 | 0.37 | | HYPOX_DFO_HCT116 |
| 3044 | APAF1 | SEQ ID NO. 1150 | 0.284 | 0.192 | 0.676 | | HYPOX_DFO_HT1080 |
| 3045 | APAF1 | SEQ ID NO. 1150 | 2.902 | 1.387 | 0.478 | | HYPOX_O2_HCT116 |
| 3046 | APAF1 | SEQ ID NO. 1150 | 0.284 | 0.178 | 0.625 | | HYPOX_O2_HT1080 |
| 3047 | ARNT2 | SEQ ID NO. 1151 | 2.923 | 1.761 | 0.604 | | HYPOX_DFO_HCT116 |
| 3048 | ARNT2 | SEQ ID NO. 1151 | 0.443 | 0.603 | 1.361 | | HYPOX_DFO_HT1080 |
| 3049 | ARNT2 | SEQ ID NO. 1151 | 2.823 | 2.351 | 0.833 | | HYPOX_O2_HCT116 |
| 3050 | ARNT2 | SEQ ID NO. 1151 | 0.443 | 0.31 | 0.699 | | HYPOX_O2_HT1080 |
| 3051 | CCL5 | SEQ ID NO. 1151 | 53.656 | 51.684 | 0.963 | | HYPOX_DFO_HCT116 |
| 3052 | CCL5 | SEQ ID NO. 1151 | 10.392 | 8.019 | 0.772 | | HYPOX_DFO_HT1080 |
| 3053 | CCL5 | SEQ ID NO. 1151 | 53.656 | 46.585 | 0.868 | | HYPOX_O2_HCT116 |
| 3054 | CCL5 | SEQ ID NO. 1151 | 10.392 | 8.145 | 0.784 | | HYPOX_O2_HT1080 |
| 3055 | IL1R1 | SEQ ID NO. 1152 | 138.218 | 31.966 | 0.23 | | HYPOX_DFO_HCT116 |
| 3056 | IL1R1 | SEQ ID NO. 1152 | 8.055 | 4.872 | 0.605 | | HYPOX_DFO_HT1080 |
| 3057 | IL1R1 | SEQ ID NO. 1152 | 138.218 | 60.312 | 0.434 | | HYPOX_O2_HCT116 |
| 3058 | IL1R1 | SEQ ID NO. 1152 | 8.055 | 4.386 | 0.544 | | HYPOX_O2_HT1080 |
| 3059 | IL18R1 | SEQ ID NO. 1153 | 2.83 | 2.859 | 1.011 | | HYPOX_DFO_HCT116 |
| 3060 | IL18R1 | SEQ ID NO. 1153 | 0.14 | 1.116 | 7.957 | | HYPOX_DFO_HT1080 |
| 3061 | IL18R1 | SEQ ID NO. 1153 | 2.83 | 1.33 | 0.47 | | HYPOX_O2_HCT116 |
| 3062 | IL18R1 | SEQ ID NO. 1153 | 0.14 | 0.315 | 2.245 | | HYPOX_O2_HT1080 |
| 3063 | IL13 | SEQ ID NO. 1154 | 7.749 | 3.068 | 0.396 | | HYPOX_DFO_HCT116 |
| 3064 | IL13 | SEQ ID NO. 1154 | 1.195 | 0.967 | 0.809 | | HYPOX_DFO_HT1080 |
| 3065 | IL13 | SEQ ID NO. 1154 | 7.749 | 3.259 | 0.421 | | HYPOX_O2_HCT116 |
| 3066 | IL13 | SEQ ID NO. 1154 | 1.195 | 1.214 | 1.016 | | HYPOX_O2_HT1080 |

FIG. 1CA – TABLE 1 TRANSCRIPTIONAL BIOMARKER FUNCTIONAL DATA
SECTION 1A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS* |
|---|---|---|---|---|---|---|
| 3067 | PRKAA1 | SEQ ID NO. 1155 | 275.175 | 272.407 | 0.99 | HYPOX_DFO_HCT116 |
| 3068 | PRKAA1 | SEQ ID NO. 1155 | 107.763 | 88.086 | 0.817 | HYPOX_DFO_HT1080 |
| 3069 | PRKAA1 | SEQ ID NO. 1155 | 275.175 | 391.132 | 1.422 | HYPOX_O2_HCT116 |
| 3070 | PRKAA1 | SEQ ID NO. 1155 | 107.763 | 82.24 | 0.763 | HYPOX_O2_HT1080 |
| 3071 | EDN1 | SEQ ID NO. 1156 | 318.531 | 259.461 | 0.815 | HYPOX_DFO_HCT116 |
| 3072 | EDN1 | SEQ ID NO. 1156 | 79.058 | 71.137 | 0.9 | HYPOX_DFO_HT1080 |
| 3073 | EDN1 | SEQ ID NO. 1156 | 318.531 | 257.6 | 0.809 | HYPOX_O2_HCT116 |
| 3074 | EDN1 | SEQ ID NO. 1156 | 79.058 | 61.91 | 0.783 | HYPOX_O2_HT1080 |
| 3075 | IL1RN | SEQ ID NO. 1157 | 146.842 | 69.106 | 0.471 | HYPOX_DFO_HCT116 |
| 3076 | IL1RN | SEQ ID NO. 1157 | 12.826 | 7.35 | 0.573 | HYPOX_DFO_HT1080 |
| 3077 | IL1RN | SEQ ID NO. 1157 | 146.842 | 70.045 | 0.477 | HYPOX_O2_HCT116 |
| 3078 | IL1RN | SEQ ID NO. 1157 | 12.826 | 10.516 | 0.82 | HYPOX_O2_HT1080 |
| 3079 | TF | SEQ ID NO. 1158 | 24.907 | 14.833 | 0.596 | HYPOX_DFO_HCT116 |
| 3080 | TF | SEQ ID NO. 1158 | 2.218 | 1.553 | 0.7 | HYPOX_DFO_HT1080 |
| 3081 | TF | SEQ ID NO. 1158 | 24.907 | 19.689 | 0.791 | HYPOX_O2_HCT116 |
| 3082 | TF | SEQ ID NO. 1158 | 2.218 | 1.87 | 0.843 | HYPOX_O2_HT1080 |
| 3083 | ZBTB1 | SEQ ID NO. 1159 | 328.433 | 313.236 | 0.954 | HYPOX_DFO_HCT116 |
| 3084 | ZBTB1 | SEQ ID NO. 1159 | 43.19 | 44.614 | 1.033 | HYPOX_DFO_HT1080 |
| 3085 | ZBTB1 | SEQ ID NO. 1159 | 328.433 | 540.552 | 1.646 | HYPOX_O2_HCT116 |
| 3086 | ZBTB1 | SEQ ID NO. 1159 | 43.19 | 40.664 | 0.942 | HYPOX_O2_HT1080 |

*FIG. 1CB* -- TABLE 1 TRANSCRIPTIONAL BIOMARKER FUNCTIONAL DATA
SECTION 11A

| LINE_ID | GENE_SYMBOL | SEQUENCE_ID_LISTING | PROM_ACTIVITY_N_O_INDUCTION | PROM_ACTIVITY_WI_TH_INDUCTION | INDUCTION_RATIO | INDUCTION_CONDITIONS |
|---|---|---|---|---|---|---|
| 3087 | COMT | SEQ ID NO. 1158 | 0.606 | 0.578 | 0.954 | NFKB |
| 3088 | NULL | SEQ ID NO. 1159 | 0.042 | 0.086 | 2.032 | NFKB |
| 3089 | NR4A2 | SEQ ID NO. 1160 | 7.855 | 9.788 | 1.246 | NFKB |
| 3090 | RNASE2 | SEQ ID NO. 1161 | 0.27 | 0.31 | 1.151 | NFKB |
| 3091 | CCL15 | SEQ ID NO. 1161 | 0.212 | 0.271 | 1.281 | NFKB |
| 3092 | SCNN1A | SEQ ID NO. 1162 | 0.059 | 0.125 | 2.136 | NFKB |
| 3093 | SLC3A5 | SEQ ID NO. 1162 | 0.331 | 0.304 | 0.947 | NFKB |
| 3094 | BCL2 | SEQ ID NO. 1162 | 0.07 | 0.13 | 1.848 | NFKB |
| 3095 | TFPI2 | SEQ ID NO. 1163 | 3.172 | 4.916 | 1.283 | NFKB |
| 3096 | MEST | SEQ ID NO. 1163 | 0.958 | 0.924 | 0.965 | NFKB |
| 3097 | IL2 | SEQ ID NO. 1164 | 0.076 | 0.114 | 1.505 | NFKB |
| 3098 | IFNB1 | SEQ ID NO. 1165 | 23.527 | 24.962 | 1.061 | NFKB |
| 3099 | IL2RA | SEQ ID NO. 1166 | 0.401 | 0.475 | 1.185 | NFKB |
| 3100 | IER3 | SEQ ID NO. 1167 | 18.433 | 51.529 | 2.795 | NFKB |
| 3101 | CD36 | SEQ ID NO. 1168 | 0.331 | 0.201 | 0.607 | NFKB |
| 3102 | CCKBR | SEQ ID NO. 1168 | 3.92 | 2.9 | 0.74 | NFKB |
| 3103 | LTB | SEQ ID NO. 1169 | 1.365 | 1.165 | 0.854 | NFKB |
| 3104 | BCL2L1 | SEQ ID NO. 1170 | 1.903 | 2.002 | 1.052 | NFKB |
| 3105 | ADM | SEQ ID NO. 1170 | 19.475 | 17.251 | 0.886 | NFKB |
| 3106 | CCL2 | SEQ ID NO. 1170 | 20.678 | 13.789 | 0.667 | NFKB |
| 3107 | NOS2A | SEQ ID NO. 1170 | 0.964 | 0.923 | 0.958 | NFKB |
| 3108 | IL1B | SEQ ID NO. 1170 | 7.952 | 10.816 | 1.36 | NFKB |
| 3109 | LTA | SEQ ID NO. 1170 | 1.339 | 1.817 | 1.357 | NFKB |
| 3110 | IL6 | SEQ ID NO. 1170 | 0.076 | 0.115 | 1.512 | NFKB |
| 3111 | IRF7 | SEQ ID NO. 1170 | 16.126 | 16.868 | 1.047 | NFKB |
| 3112 | CXCL5 | SEQ ID NO. 1170 | 0.844 | 1.978 | 2.343 | NFKB |
| 3113 | VEGFA | SEQ ID NO. 1170 | 0.168 | 0.25 | 1.49 | NFKB |
| 3114 | IL13 | SEQ ID NO. 1170 | 0.459 | 0.65 | 1.416 | NFKB |
| 3115 | SCGBR | SEQ ID NO. 1170 | 1.849 | 1.829 | 0.989 | NFKB |
| 3116 | IL15 | SEQ ID NO. 1171 | 0.055 | 0.124 | 2.28 | NFKB |
| 3117 | SEPP1 | SEQ ID NO. 1172 | 0.063 | 0.087 | 1.288 | NFKB |
| 3118 | SEPP1 | SEQ ID NO. 1173 | 4.914 | 3.85 | 0.783 | NFKB |
| 3119 | SELP | SEQ ID NO. 1174 | 5.567 | 5.29 | 0.95 | NFKB |
| 3120 | IL1A | SEQ ID NO. 1175 | 0.039 | 0.064 | 1.659 | NFKB |
| 3121 | BDKRB1 | SEQ ID NO. 1176 | 8.428 | 22.715 | 2.695 | NFKB |
| 3122 | PTX3 | SEQ ID NO. 1177 | 0.541 | 2.433 | 4.491 | NFKB |
| 3123 | SEPP1 | SEQ ID NO. 1178 | 0.04 | 0.062 | 1.58 | NFKB |
| 3124 | BCL2 | SEQ ID NO. 1179 | 0.289 | 0.236 | 0.819 | NFKB |
| 3125 | DEFB104A | SEQ ID NO. 1180 | 0.057 | 0.059 | 1.041 | NFKB |
| 3126 | IL1RN | SEQ ID NO. 1181 | 0.109 | 0.137 | 1.255 | NFKB |
| 3127 | CCL11 | SEQ ID NO. 1182 | 0.045 | 0.063 | 1.381 | NFKB |
| 3128 | CSRP1 | SEQ ID NO. 1183 | 0.902 | 0.662 | 0.734 | NFKB |
| 3129 | CNTN1 | SEQ ID NO. 1184 | 0.641 | 0.412 | 0.643 | NFKB |
| 3130 | CXCR5 | SEQ ID NO. 1185 | 0.410 | 0.539 | 1.288 | NFKB |
| 3131 | TAP1 | SEQ ID NO. 1186 | 0.045 | 0.062 | 1.357 | NFKB |
| 3132 | CD209 | SEQ ID NO. 1187 | 1.736 | 1.494 | 0.861 | NFKB |
| 3133 | ELF3 | SEQ ID NO. 1188 | 0.027 | 0.047 | 1.728 | NFKB |
| 3134 | IRF2 | SEQ ID NO. 1189 | 0.141 | 0.185 | 1.307 | NFKB |

FIG. 1CC -- TABLE 1 TRANSCRIPTIONAL BIOMARKER FUNCTIONAL DATA
SECTION 11A

| LINE_ID | GENE_SYMBOL | SEQUENCE_ID_LISTING | PROM_ACTIVITY_N O_INDUCTION | PROM_ACTIVITY_WI TH_INDUCTION | INDUCTION _RATIO | INDUCTION_CONDITIONS |
|---|---|---|---|---|---|---|
| 3135 | SCNN1A | SEQ ID NO. 1190 | 0.121 | 0.152 | 1.261 | NFkB |
| 3136 | CD74 | SEQ ID NO. 1191 | 1.729 | 7.298 | 4.221 | NFkB |
| 3137 | OPRM1 | SEQ ID NO. 1192 | 0.038 | 0.036 | 0.955 | NFkB |
| 3138 | IL1RN | SEQ ID NO. 1193 | 5.36 | 16.203 | 3.023 | NFkB |
| 3139 | VEGFA | SEQ ID NO. 1194 | 0.107 | 0.154 | 1.439 | NFkB |
| 3140 | TGM2 | SEQ ID NO. 1195 | 0.317 | 0.322 | 1.016 | NFkB |
| 3141 | MMP9 | SEQ ID NO. 1196 | 0.557 | 2.334 | 4.188 | NFkB |
| 3142 | IL15RA | SEQ ID NO. 1197 | 0.096 | 0.089 | 0.923 | NFkB |
| 3143 | HMOX1 | SEQ ID NO. 1198 | 1.188 | 0.897 | 0.755 | NFkB |
| 3144 | IRF4 | SEQ ID NO. 1199 | 0.287 | 0.178 | 0.619 | NFkB |
| 3145 | AGER | SEQ ID NO. 1200 | 2.225 | 2.456 | 1.104 | NFkB |
| 3146 | CD33 | SEQ ID NO. 1201 | 0.314 | 1.386 | 4.411 | NFkB |
| 3147 | PSMA2 | SEQ ID NO. 1202 | 15.596 | 13.998 | 0.898 | NFkB |
| 3148 | NOD2 | SEQ ID NO. 1203 | 0.543 | 2.678 | 4.931 | NFkB |
| 3149 | PTGS2 | SEQ ID NO. 1204 | 0.584 | 0.533 | 0.913 | NFkB |
| 3150 | TNC | SEQ ID NO. 1205 | 2.225 | 2.175 | 0.978 | NFkB |
| 3151 | CSRP1 | SEQ ID NO. 1206 | 6.03 | 8.169 | 1.355 | NFkB |
| 3152 | MYC | SEQ ID NO. 1207 | 3.09 | 2.91 | 0.942 | NFkB |
| 3153 | CSF1 | SEQ ID NO. 1208 | 0.509 | 0.343 | 0.674 | NFkB |
| 3154 | CSF3 | SEQ ID NO. 1209 | 0.116 | 0.295 | 2.554 | NFkB |
| 3155 | IL15 | SEQ ID NO. 1210 | 3.574 | 11.835 | 3.325 | NFkB |
| 3156 | MYC | SEQ ID NO. 1211 | 0.082 | 0.085 | 1.044 | NFkB |
| 3157 | CD44 | SEQ ID NO. 1212 | 1.456 | 1.321 | 0.907 | NFkB |
| 3158 | PITX3 | SEQ ID NO. 1213 | 0.24 | 0.246 | 1.026 | NFkB |
| 3159 | EMG | SEQ ID NO. 1214 | 7.391 | 7.475 | 1.011 | NFkB |
| 3160 | NOL3 | SEQ ID NO. 1215 | 77.312 | 83.453 | 1.079 | NFkB |
| 3161 | PDGFB | SEQ ID NO. 1216 | 0.624 | 0.575 | 0.922 | NFkB |
| 3162 | PLCD1 | SEQ ID NO. 1217 | 1.783 | 1.082 | 0.607 | NFkB |
| 3163 | SOD2 | SEQ ID NO. 1218 | 30.694 | 30.468 | 0.993 | NFkB |
| 3164 | IRF4 | SEQ ID NO. 1219 | 2.495 | 2.518 | 1.009 | NFkB |
| 3165 | IL11 | SEQ ID NO. 1220 | 6.139 | 3.504 | 0.571 | NFkB |
| 3166 | SEPP1 | SEQ ID NO. 1221 | 0.101 | 0.127 | 1.267 | NFkB |
| 3167 | SOD2 | SEQ ID NO. 1222 | 0.118 | 0.13 | 1.101 | NFkB |
| 3168 | CD69 | SEQ ID NO. 1223 | 0.257 | 1.957 | 7.62 | NFkB |
| 3169 | IL9 | SEQ ID NO. 1224 | 1.156 | 1.247 | 1.079 | NFkB |

FIG. 1CD -- TABLE 1 TRANSCRIPTIONAL BIOMARKER FUNCTIONAL DATA
SECTION 11A

| LINE_ID | GENE_SYMBOL | SEQUENCE_ID_LISTING | PROM_ACTIVITY_N O_INDUCTION | PROM_ACTIVITY_W TH_INDUCTION | PROM_ACTIVITY_WI _RATIO | INDUCTION INDUCTION_CONDITIONS |
|---|---|---|---|---|---|---|
| 3170 | CRP | SEQ ID NO. 1224 | 0.111 | 0.1 | 0.897 | NFkB |
| 3171 | CCL15 | SEQ ID NO. 1225 | 0.148 | 0.139 | 0.944 | NFkB |
| 3172 | NOS2A | SEQ ID NO. 1226 | 16.271 | 8.751 | 0.538 | NFkB |
| 3173 | F3 | SEQ ID NO. 1227 | 0.103 | 0.236 | 2.289 | NFkB |
| 3174 | DEFB4 | SEQ ID NO. 1228 | 0.191 | 0.289 | 1.512 | NFkB |
| 3175 | TGM2 | SEQ ID NO. 1229 | 0.094 | 0.091 | 0.963 | NFkB |
| 3176 | ELF3 | SEQ ID NO. 1230 | 1.385 | 2.337 | 1.688 | NFkB |
| 3177 | TPMT | SEQ ID NO. 1231 | 12.025 | 12.06 | 1.003 | NFkB |
| 3178 | IL6 | SEQ ID NO. 1232 | 0.22 | 0.23 | 1.045 | NFkB |
| 3179 | TGM2 | SEQ ID NO. 1233 | 0.585 | 1.173 | 2.005 | NFkB |
| 3180 | PTAFR | SEQ ID NO. 1234 | 0.169 | 0.197 | 1.166 | NFkB |
| 3181 | TNKC1 | SEQ ID NO. 1235 | 2.425 | 2.396 | 0.988 | NFkB |
| 3182 | ELF3 | SEQ ID NO. 1236 | 0.068 | 0.167 | 2.45 | NFkB |
| 3183 | MR4A2 | SEQ ID NO. 1237 | 0.186 | 0.13 | 0.7 | NFkB |
| 3184 | PSMB9 | SEQ ID NO. 1238 | 0.654 | 6.828 | 10.435 | NFkB |
| 3185 | PER1 | SEQ ID NO. 1238 | 15.89 | 8.45 | 0.532 | NFkB |
| 3186 | SNTA1 | SEQ ID NO. 1238 | 13.936 | 11.658 | 0.837 | NFkB |

FIG. 1CE -- TABLE 1 TRANSCRIPTIONAL BIOMARKER FUNCTIONAL DATA
SECTION 4A

| LINE_ID | GENE_SYMBOL | SEQUENCE_ID_LISTING | PROM_ACTIVITY_N O_INDUCTION | PROM_ACTIVITY_WI TH_INDUCTION | INDUCTION RATIO | INDUCTION_CONDITIONS* |
|---|---|---|---|---|---|---|
| 3187 | GLRX2 | SEQ ID NO. 1238 | 1.114 | 0.943 | 0.847 | p53 |
| 3188 | NULL | SEQ ID NO. 1239 | 0.561 | 1.82 | 3.243 | p53 |
| 3189 | GLRX2 | SEQ ID NO. 1239 | 0.577 | 0.815 | 1.411 | p53 |
| 3190 | RAB14 | SEQ ID NO. 1240 | 0.484 | 0.506 | 1.045 | p53 |
| 3191 | NEDD9 | SEQ ID NO. 1240 | 2.467 | 1.902 | 0.771 | p53 |
| 3192 | IHPK2 | SEQ ID NO. 1241 | 0.248 | 0.323 | 1.3 | p53 |
| 3193 | TAX1BP1 | SEQ ID NO. 1242 | 0.08 | 0.075 | 0.935 | p53 |
| 3194 | NULL | SEQ ID NO. 1243 | 0.596 | 1.369 | 2.299 | p53 |
| 3195 | NULL | SEQ ID NO. 1244 | 2.067 | 2.025 | 0.979 | p53 |
| 3196 | PNPLA8 | SEQ ID NO. 1245 | 52.658 | 52.968 | 1.006 | p53 |
| 3197 | DNAH11 | SEQ ID NO. 1246 | 13.357 | 11.099 | 0.831 | p53 |
| 3198 | NULL | SEQ ID NO. 1247 | 0.154 | 0.385 | 2.503 | p53 |
| 3199 | RBM33 | SEQ ID NO. 1248 | 1.822 | 2.491 | 1.367 | p53 |
| 3200 | TARP | SEQ ID NO. 1249 | 0.046 | 0.039 | 1.93 | p53 |
| 3201 | RAC1 | SEQ ID NO. 1250 | 0.21 | 0.511 | 2.43 | p53 |
| 3202 | NULL | SEQ ID NO. 1251 | 25.297 | 8.524 | 0.337 | p53 |
| 3203 | TAS2R4 | SEQ ID NO. 1252 | 0.201 | 0.281 | 1.397 | p53 |
| 3204 | NULL | SEQ ID NO. 1253 | 0.138 | 0.303 | 2.192 | p53 |
| 3205 | NULL | SEQ ID NO. 1254 | 0.277 | 0.717 | 2.593 | p53 |
| 3206 | NULL | SEQ ID NO. 1255 | 0.196 | 0.311 | 1.589 | p53 |
| 3207 | NULL | SEQ ID NO. 1256 | 0.262 | 0.312 | 1.192 | p53 |
| 3208 | EEPD1 | SEQ ID NO. 1257 | 0.213 | 0.302 | 1.414 | p53 |
| 3209 | RSPH10B | SEQ ID NO. 1258 | 0.85 | 1.109 | 1.305 | p53 |
| 3210 | CPA4 | SEQ ID NO. 1259 | 387.071 | 321.26 | 0.832 | p53 |
| 3211 | NULL | SEQ ID NO. 1260 | 10.49 | 29.57 | 2.819 | p53 |
| 3212 | NULL | SEQ ID NO. 1261 | 0.226 | 0.523 | 2.314 | p53 |
| 3213 | NULL | SEQ ID NO. 1262 | 1.896 | 1.098 | 0.579 | p53 |
| 3214 | PRSS2 | SEQ ID NO. 1263 | 0.147 | 0.215 | 1.461 | p53 |
| 3215 | LAMB1 | SEQ ID NO. 1264 | 0.087 | 0.172 | 1.976 | p53 |
| 3216 | EYA1 | SEQ ID NO. 1265 | 0.18 | 0.563 | 3.121 | p53 |
| 3217 | CALD1 | SEQ ID NO. 1266 | 0.588 | 0.691 | 1.175 | p53 |
| 3218 | WIPI2 | SEQ ID NO. 1267 | 0.648 | 0.92 | 1.42 | p53 |
| 3219 | NULL | SEQ ID NO. 1268 | 0.947 | 1.516 | 1.6 | p53 |
| 3220 | ATXN7L1 | SEQ ID NO. 1269 | 0.138 | 0.168 | 1.222 | p53 |
| 3221 | NULL | SEQ ID NO. 1270 | 1.997 | 2.889 | 1.447 | p53 |
| 3222 | TARP | SEQ ID NO. 1271 | 0.038 | 0.046 | 1.274 | p53 |
| 3223 | CPA2 | SEQ ID NO. 1272 | 12.223 | 5.197 | 0.425 | p53 |
| 3224 | bag7.1177 | SEQ ID NO. 1273 | 9.953 | 10.519 | 1.057 | p53 |
| 3225 | NULL | SEQ ID NO. 1274 | 0.147 | 0.184 | 1.247 | p53 |
| 3226 | TMEM209 | SEQ ID NO. 1275 | 656.53 | 363.552 | 0.554 | p53 |
| 3227 | NULL | SEQ ID NO. 1276 | 0.139 | 0.392 | 2.814 | p53 |
| 3228 | ZNSCAN1 | SEQ ID NO. 1277 | 1.107 | 1.666 | 1.506 | p53 |
| 3229 | LRCH4 | SEQ ID NO. 1278 | 0.083 | 0.144 | 1.725 | p53 |
| 3230 | NULL | SEQ ID NO. 1279 | 1.082 | 1 | 0.924 | p53 |
| 3231 | NULL | SEQ ID NO. 1280 | 11.641 | 13.087 | 1.124 | p53 |
| 3232 | MRPL32 | SEQ ID NO. 1281 | 6.719 | 6.878 | 1.024 | p53 |

FIG. 1CF -- TABLE 1 TRANSCRIPTIONAL BIOMARKER FUNCTIONAL DATA
SECTION 4A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS |
|---|---|---|---|---|---|---|
| 3233 | CALU | SEQ ID NO. 1282 | 13.329 | 14.714 | 1.104 | p53 |
| 3234 | CMPK4 | SEQ ID NO. 1283 | 1.53 | 1.874 | 1.224 | p53 |
| 3235 | GNA12 | SEQ ID NO. 1284 | 0.187 | 0.102 | 0.547 | p53 |
| 3236 | SRCRB4D | SEQ ID NO. 1285 | 4.325 | 2.489 | 0.575 | p53 |
| 3237 | C7orf60 | SEQ ID NO. 1286 | 139.096 | 165.029 | 1.179 | p53 |
| 3238 | NULL | SEQ ID NO. 1287 | 0.357 | 0.321 | 0.9 | p53 |
| 3239 | CALM1 | SEQ ID NO. 1288 | 0.596 | 1.08 | 1.812 | p53 |
| 3240 | TAF6 | SEQ ID NO. 1289 | 7.044 | 9.372 | 1.33 | p53 |
| 3241 | PSPH | SEQ ID NO. 1290 | 0.54 | 0.871 | 1.611 | p53 |
| 3242 | PSMA2 | SEQ ID NO. 1291 | 0.928 | 1.419 | 1.53 | p53 |
| 3243 | NULL | SEQ ID NO. 1292 | 0.348 | 0.43 | 1.237 | p53 |
| 3244 | AKAP9 | SEQ ID NO. 1293 | 4.542 | 5.428 | 1.195 | p53 |
| 3245 | FAM3C | SEQ ID NO. 1294 | 2.446 | 2.545 | 1.04 | p53 |
| 3246 | CCT6A | SEQ ID NO. 1295 | 19.278 | 22.722 | 1.179 | p53 |
| 3247 | NULL | SEQ ID NO. 1296 | 30.786 | 26.841 | 0.872 | p53 |
| 3248 | ECOP | SEQ ID NO. 1297 | 2.936 | 3.049 | 1.038 | p53 |
| 3249 | MY01G | SEQ ID NO. 1298 | 0.324 | 0.538 | 1.662 | p53 |
| 3250 | MY01G | SEQ ID NO. 1299 | 0.484 | 0.536 | 1.113 | p53 |
| 3251 | NULL | SEQ ID NO. 1300 | 0.249 | 0.376 | 1.512 | p53 |
| 3252 | ZCWPW1 | SEQ ID NO. 1301 | 18.967 | 12.441 | 0.656 | p53 |
| 3253 | GRM8 | SEQ ID NO. 1302 | 0.2 | 0.238 | 1.192 | p53 |
| 3254 | NULL | SEQ ID NO. 1303 | 35.408 | 14.135 | 0.399 | p53 |
| 3255 | MEPCE | SEQ ID NO. 1304 | 7.09 | 7.992 | 1.127 | p53 |
| 3256 | NULL | SEQ ID NO. 1305 | 3.017 | 1.08 | 0.535 | p53 |
| 3257 | HCAP7 | SEQ ID NO. 1306 | 5.65 | 2.543 | 0.45 | p53 |
| 3258 | SMX8 | SEQ ID NO. 1307 | 1.6 | 1.902 | 1.188 | p53 |
| 3259 | GNB2 | SEQ ID NO. 1308 | 0.574 | 0.57 | 0.992 | p53 |
| 3260 | ZCWPW1 | SEQ ID NO. 1309 | 1.108 | 1.107 | 0.999 | p53 |
| 3261 | CENTA1 | SEQ ID NO. 1310 | 0.358 | 0.406 | 1.134 | p53 |
| 3262 | PLOD3 | SEQ ID NO. 1311 | 23.238 | 31.698 | 1.364 | p53 |
| 3263 | TRIM74 | SEQ ID NO. 1312 | 0.432 | 0.919 | 2.128 | p53 |
| 3264 | NULL | SEQ ID NO. 1313 | 29.506 | 19.815 | 0.672 | p53 |
| 3265 | NULL | SEQ ID NO. 1314 | 5.941 | 6.129 | 1.032 | p53 |
| 3266 | TRIM74 | SEQ ID NO. 1315 | 0.216 | 0.537 | 2.487 | p53 |
| 3267 | MEPCE | SEQ ID NO. 1316 | 7.958 | 7.144 | 0.898 | p53 |
| 3268 | HERPUD2 | SEQ ID NO. 1317 | 1.679 | 2.111 | 1.258 | p53 |
| 3269 | PKBP9 | SEQ ID NO. 1318 | 0.289 | 0.67 | 2.317 | p53 |
| 3270 | NULL | SEQ ID NO. 1319 | 1.298 | 1.033 | 0.796 | p53 |
| 3271 | MCAPG2 | SEQ ID NO. 1320 | 34.013 | 7.626 | 0.224 | p53 |
| 3272 | NULL | SEQ ID NO. 1321 | 19.69 | 28.614 | 1.453 | p53 |
| 3273 | NULL | SEQ ID NO. 1322 | 0.317 | 0.513 | 1.618 | p53 |
| 3274 | NUB1 | SEQ ID NO. 1323 | 91.834 | 107.605 | 1.174 | p53 |
| 3275 | NULL | SEQ ID NO. 1324 | 3.656 | 11.242 | 3.075 | p53 |
| 3276 | SLC4A2 | SEQ ID NO. 1325 | 1.452 | 1.472 | 1.014 | p53 |
| 3277 | NULL | SEQ ID NO. 1326 | 0.204 | 0.25 | 1.224 | p53 |
| 3278 | NULL | SEQ ID NO. 1327 | 1.226 | 0.843 | 0.688 | p53 |
| 3279 | PSPH | SEQ ID NO. 1328 | 4.182 | 5.887 | 1.408 | p53 |
| 3280 | ZNF765 | SEQ ID NO. 1329 | 0.401 | 0.551 | 1.374 | p53 |

FIG. 1CG – TABLE 1 TRANSCRIPTIONAL BIOMARKER FUNCTIONAL DATA
SECTION 4A

| LINE_ID | GENE_SYMBOL | SEQUENCE_ID_LISTING | PROM_ACTIVITY_N O_INDUCTION | PROM_ACTIVITY_W TH_INDUCTION | INDUCTION_RATIO | INDUCTION_CONDITIONS* |
|---|---|---|---|---|---|---|
| 3281 | REPIN1 | SEQ ID NO. 1313 | 3.631 | 4.983 | 1.372 | p53 |
| 3282 | ACTB | SEQ ID NO. 1314 | 77.805 | 88.967 | 1.143 | p53 |
| 3283 | MTCALL2 | SEQ ID NO. 1315 | 1.714 | 1.412 | 0.824 | p53 |
| 3284 | PDIK | SEQ ID NO. 1316 | 0.519 | 0.417 | 0.804 | p53 |
| 3285 | NOTCH2 | SEQ ID NO. 1317 | 0.249 | 0.293 | 1.175 | p53 |
| 3286 | USP16 | SEQ ID NO. 1318 | 0.076 | 0.062 | 0.811 | p53 |
| 3287 | LIG4 | SEQ ID NO. 1319 | 0.288 | 2.667 | 9.255 | p53 |
| 3288 | MCL1 | SEQ ID NO. 1320 | 0.182 | 0.19 | 1.043 | p53 |
| 3289 | NCKAP1 | SEQ ID NO. 1321 | 0.093 | 0.506 | 5.46 | p53 |
| 3290 | TIA1 | SEQ ID NO. 1322 | 0.079 | 0.156 | 1.972 | p53 |
| 3291 | RAB10 | SEQ ID NO. 1323 | 0.244 | 0.282 | 1.152 | p53 |
| 3292 | ALB | SEQ ID NO. 1324 | 0.728 | 0.728 | 0.423 | p53 |
| 3293 | PRG4 | SEQ ID NO. 1325 | 1.554 | 1.009 | 0.649 | p53 |
| 3294 | CDC42 | SEQ ID NO. 1326 | 0.028 | 0.036 | 1.27 | p53 |
| 3295 | GAS2 | SEQ ID NO. 1327 | 0.227 | 0.409 | 1.799 | p53 |
| 3296 | CD86 | SEQ ID NO. 1328 | 0.222 | 0.39 | 1.755 | p53 |
| 3297 | RBM5 | SEQ ID NO. 1329 | 0.215 | 0.159 | 0.741 | p53 |
| 3298 | TP63 | SEQ ID NO. 1330 | 0.26 | 0.282 | 1.085 | p53 |
| 3299 | APP | SEQ ID NO. 1331 | 0.558 | 0.924 | 1.656 | p53 |
| 3300 | EIF2AK2 | SEQ ID NO. 1332 | 0.2 | 0.197 | 0.985 | p53 |
| 3301 | PBOV1 | SEQ ID NO. 1333 | 0.75 | 0.657 | 0.9 | p53 |
| 3302 | GAS1 | SEQ ID NO. 1334 | 0.191 | 0.141 | 0.738 | p53 |
| 3303 | CTNNBL1 | SEQ ID NO. 1335 | 0.085 | 0.097 | 1.143 | p53 |
| 3304 | 1-Dec | SEQ ID NO. 1336 | 0.544 | 0.585 | 1.076 | p53 |
| 3305 | NPBL | SEQ ID NO. 1337 | 0.121 | 0.176 | 1.455 | p53 |
| 3306 | USP16 | SEQ ID NO. 1338 | 1.246 | 1.619 | 1.299 | p53 |
| 3307 | GEM1 | SEQ ID NO. 1339 | 0.132 | 0.203 | 1.538 | p53 |
| 3308 | BACA | SEQ ID NO. 1340 | 0.417 | 0.432 | 1.036 | p53 |
| 3309 | IL17A | SEQ ID NO. 1341 | 0.489 | 1.084 | 2.219 | p53 |
| 3310 | RFPL | SEQ ID NO. 1342 | 29.892 | 20.644 | 0.691 | p53 |
| 3311 | MAP2K6 | SEQ ID NO. 1343 | 3.266 | 1.438 | 0.44 | p53 |
| 3312 | ST3 | SEQ ID NO. 1344 | 0.309 | 0.34 | 1.137 | p53 |
| 3313 | RAB7L1 | SEQ ID NO. 1345 | 3.057 | 3.322 | 1.087 | p53 |
| 3314 | SYCP1 | SEQ ID NO. 1346 | 0.411 | 0.28 | 0.681 | p53 |
| 3315 | IFNW1 | SEQ ID NO. 1347 | 0.213 | 0.258 | 1.213 | p53 |
| 3316 | RBM5 | SEQ ID NO. 1348 | 0.283 | 0.221 | 0.641 | p53 |
| 3317 | CD5L | SEQ ID NO. 1349 | 0.25 | 0.279 | 1.115 | p53 |
| 3318 | FILIP1L | SEQ ID NO. 1350 | 0.307 | 0.675 | 2.201 | p53 |
| 3319 | POLR3 | SEQ ID NO. 1351 | 10.218 | 3.168 | 0.31 | p53 |
| 3320 | CIDEC | SEQ ID NO. 1352 | 0.178 | 0.183 | 1.025 | p53 |
| 3321 | CCNG1 | SEQ ID NO. 1353 | 6.609 | 8.855 | 1.34 | p53 |
| 3322 | NONO | SEQ ID NO. 1354 | 0.266 | 0.227 | 0.846 | p53 |
| 3323 | XRCC6 | SEQ ID NO. 1355 | 0.675 | 0.658 | 0.975 | p53 |
| 3324 | CASC3 | SEQ ID NO. 1356 | 0.322 | 0.412 | 1.28 | p53 |
| 3325 | CD86 | SEQ ID NO. 1357 | 0.891 | 0.678 | 0.76 | p53 |
| 3326 | BRMS1L | SEQ ID NO. 1358 | 1.728 | 2.293 | 1.327 | p53 |
| 3327 | TERF1 | SEQ ID NO. 1359 | 0.071 | 0.157 | 2.201 | p53 |
| 3328 | CIDEC | SEQ ID NO. 1360 | 0.105 | 0.179 | 1.7 | p53 |

*FIG. 1CH* -- TABLE 1 TRANSCRIPTIONAL BIOMARKER FUNCTIONAL DATA
SECTION 4A

| LINE_ID | GENE_SYMBOL | SEQUENCE_ID_LISTING | PROM_ACTIVITY_N O_INDUCTION | PROM_ACTIVITY_WI TH_INDUCTION | INDUCTION RATIO | INDUCTION_CONDITIONS* |
|---|---|---|---|---|---|---|
| 3329 | RAB27B | SEQ ID NO. 1360 | 3.150 | 5.205 | 1.651 | p53 |
| 3330 | DNASE1L3 | SEQ ID NO. 1361 | 0.412 | 0.585 | 1.42 | p53 |
| 3331 | POLE | SEQ ID NO. 1362 | 0.041 | 0.054 | 1.328 | p53 |
| 3332 | FOXN3 | SEQ ID NO. 1363 | 0.814 | 1.233 | 1.515 | p53 |
| 3333 | NAPRE2 | SEQ ID NO. 1364 | 8.672 | 13.299 | 1.533 | p53 |
| 3334 | CIDEC | SEQ ID NO. 1365 | 0.205 | 0.343 | 1.672 | p53 |
| 3335 | CIDEC | SEQ ID NO. 1366 | 0.439 | 0.629 | 1.432 | p53 |
| 3336 | CD38 | SEQ ID NO. 1367 | 0.114 | 0.129 | 1.13 | p53 |
| 3337 | ERCC3 | SEQ ID NO. 1368 | 17.890 | 14.026 | 0.784 | p53 |
| 3338 | XPC | SEQ ID NO. 1369 | 314.068 | 736.905 | 2.345 | p53 |
| 3339 | RIPK3 | SEQ ID NO. 1370 | 0.865 | 0.808 | 0.934 | p53 |
| 3340 | CIT | SEQ ID NO. 1371 | 0.985 | 0.632 | 0.642 | p53 |
| 3341 | MTSS1 | SEQ ID NO. 1372 | 0.597 | 0.636 | 1.065 | p53 |
| 3342 | GFI1B | SEQ ID NO. 1373 | 0.563 | 0.558 | 0.991 | p53 |
| 3343 | NHLRC2 | SEQ ID NO. 1374 | 14.872 | 11.929 | 0.803 | p53 |
| 3344 | PTTG1IP | SEQ ID NO. 1375 | 0.206 | 0.158 | 0.766 | p53 |
| 3345 | PINK1 | SEQ ID NO. 1376 | 115.527 | 107.228 | 0.928 | p53 |
| 3346 | TOP2A | SEQ ID NO. 1377 | 12.808 | 5.484 | 0.428 | p53 |
| 3347 | MRPS11 | SEQ ID NO. 1378 | 5.102 | 6.931 | 1.359 | p53 |
| 3348 | GTF2H4 | SEQ ID NO. 1379 | 203.133 | 205.13 | 1.01 | p53 |
| 3349 | GGNBF | SEQ ID NO. 1380 | 0.823 | 0.814 | 0.989 | p53 |
| 3350 | IER3 | SEQ ID NO. 1381 | 4.978 | 19.089 | 3.834 | p53 |
| 3351 | SPHK1 | SEQ ID NO. 1382 | 0.069 | 0.122 | 1.757 | p53 |
| 3352 | RUVBL2 | SEQ ID NO. 1383 | 0.824 | 0.68 | 0.825 | p53 |
| 3353 | NXN2 | SEQ ID NO. 1384 | 0.225 | 0.33 | 1.467 | p53 |
| 3354 | IL2RA | SEQ ID NO. 1385 | 0.128 | 0.342 | 2.675 | p53 |
| 3355 | PRLG2 | SEQ ID NO. 1386 | 1.508 | 1.381 | 0.916 | p53 |
| 3356 | TRAF1 | SEQ ID NO. 1387 | 1.243 | 3.327 | 2.678 | p53 |
| 3357 | SULT1A3 | SEQ ID NO. 1388 | 1.198 | 1.37 | 1.144 | p53 |
| 3358 | PPM1F | SEQ ID NO. 1389 | 64.594 | 26.375 | 0.408 | p53 |
| 3359 | GLCCI1 | SEQ ID NO. 1390 | 1.299 | 1.151 | 0.886 | p53 |
| 3360 | GATC | SEQ ID NO. 1391 | 0.562 | 0.629 | 1.119 | p53 |
| 3361 | RAE7L1 | SEQ ID NO. 1392 | 0.396 | 0.465 | 1.174 | p53 |
| 3362 | CLK1 | SEQ ID NO. 1393 | 10.726 | 21.485 | 2.003 | p53 |
| 3363 | SON | SEQ ID NO. 1394 | 0.416 | 0.33 | 0.793 | p53 |
| 3364 | OPA1 | SEQ ID NO. 1395 | 95.116 | 105.705 | 1.111 | p53 |
| 3365 | SRLV | SEQ ID NO. 1396 | 0.173 | 0.186 | 1.046 | p53 |
| 3366 | CARD14 | SEQ ID NO. 1397 | 9.477 | 9.482 | 1.001 | p53 |
| 3367 | PARC | SEQ ID NO. 1398 | 1.065 | 0.65 | 0.61 | p53 |
| 3368 | MRPL45 | SEQ ID NO. 1399 | 0.853 | 1.207 | 1.415 | p53 |
| 3369 | RPA3 | SEQ ID NO. 1400 | 1.225 | 3.862 | 3.154 | p53 |
| 3370 | TNFRSF10B | SEQ ID NO. 1401 | 1.181 | 0.739 | 0.626 | p53 |
| 3371 | IGHMBP2 | SEQ ID NO. 1402 | 0.758 | 1.115 | 1.47 | p53 |
| 3372 | TOX4 | SEQ ID NO. 1403 | 95.223 | 109.497 | 1.15 | p53 |
| 3373 | ITGB2 | SEQ ID NO. 1404 | 0.432 | 1.602 | 3.713 | p53 |
| 3374 | GART | SEQ ID NO. 1405 | 7.855 | 12.378 | 1.576 | p53 |
| 3375 | LCAT | SEQ ID NO. 1406 | 41.177 | 30.935 | 0.751 | p53 |
| 3376 | CCNY | SEQ ID NO. 1407 | 0.795 | 0.543 | 0.682 | p53 |

FIG. 1CI – TABLE 1 TRANSCRIPTIONAL BIOMARKER FUNCTIONAL DATA
SECTION 4A

| LINE_ID | GENE_SYMBOL | SEQUENCE_ID_LISTING | PROM_ACTIVITY_N_O_INDUCTION | PROM_ACTIVITY_N_TH_INDUCTION | PROM_ACTIVITY_WT_INDUCTION | INDUCTION_RATIO | INDUCTION_CONDITIONS* |
|---|---|---|---|---|---|---|---|
| 3377 | FGF1 | SEQ ID NO. 1407 | 0.293 | 1.49 | 5.084 | p53 |
| 3378 | PTTG1IP | SEQ ID NO. 1408 | 1.173 | 0.972 | 0.829 | p53 |
| 3379 | BSCS | SEQ ID NO. 1409 | 2.676 | 3.947 | 1.475 | p53 |
| 3380 | HSPA5 | SEQ ID NO. 1410 | 2226.016 | 2222.837 | 0.999 | p53 |
| 3381 | SELV | SEQ ID NO. 1411 | 0.043 | 0.071 | 1.633 | p53 |
| 3382 | SPN | SEQ ID NO. 1412 | 2.032 | 2.092 | 1.029 | p53 |
| 3383 | GCM | SEQ ID NO. 1413 | 6.772 | 10.342 | 1.527 | p53 |
| 3384 | ATP13A4 | SEQ ID NO. 1414 | 0.654 | 0.541 | 0.828 | p53 |
| 3385 | RPA3 | SEQ ID NO. 1415 | 4.315 | 2.604 | 0.618 | p53 |
| 3386 | PRKCZ | SEQ ID NO. 1416 | 0.78 | 0.824 | 1.084 | p53 |
| 3387 | STAG3 | SEQ ID NO. 1417 | 1.681 | 1.642 | 0.977 | p53 |
| 3388 | TAF3 | SEQ ID NO. 1418 | 8.929 | 6.077 | 0.681 | p53 |
| 3389 | EPM2AIP1 | SEQ ID NO. 1419 | 2.608 | 1.354 | 0.519 | p53 |
| 3390 | MLH1 | SEQ ID NO. 1420 | 88.387 | 120.426 | 1.362 | p53 |
| 3391 | RAB33B | SEQ ID NO. 1421 | 1.037 | 1.543 | 1.42 | p53 |
| 3392 | MYO18A | SEQ ID NO. 1422 | 0.724 | 2.453 | 3.391 | p53 |
| 3393 | APC2 | SEQ ID NO. 1423 | 1.805 | 1.765 | 0.973 | p53 |
| 3394 | TRIAP1 | SEQ ID NO. 1424 | 13.722 | 16.686 | 1.216 | p53 |
| 3395 | MRP1 | SEQ ID NO. 1425 | 0.236 | 0.498 | 2.112 | p53 |
| 3396 | CCT7 | SEQ ID NO. 1426 | 0.391 | 0.215 | 0.741 | p53 |
| 3397 | MCM8 | SEQ ID NO. 1427 | 1.956 | 1.296 | 0.663 | p53 |
| 3398 | IHPK3 | SEQ ID NO. 1428 | 0.94 | 3.261 | 3.469 | p53 |
| 3399 | KATNB1 | SEQ ID NO. 1429 | 0.899 | 1.128 | 1.255 | p53 |
| 3400 | DD82 | SEQ ID NO. 1430 | 52.554 | 65.637 | 1.249 | p53 |
| 3401 | PTP4A1 | SEQ ID NO. 1431 | 121.74 | 143.251 | 1.177 | p53 |
| 3402 | GART | SEQ ID NO. 1432 | 18.03 | 21.07 | 1.169 | p53 |
| 3403 | S100A6 | SEQ ID NO. 1433 | 3.492 | 4.375 | 1.253 | p53 |
| 3404 | RAB2B | SEQ ID NO. 1434 | 11.2 | 14.536 | 1.298 | p53 |
| 3405 | APBB1 | SEQ ID NO. 1435 | 0.147 | 0.166 | 1.126 | p53 |
| 3406 | MCC | SEQ ID NO. 1436 | 0.605 | 0.71 | 1.173 | p53 |
| 3407 | HPS5 | SEQ ID NO. 1437 | 3.308 | 4.962 | 1.5 | p53 |
| 3408 | RAB8B | SEQ ID NO. 1438 | 0.463 | 0.661 | 1.427 | p53 |
| 3409 | LSM3 | SEQ ID NO. 1439 | 3.187 | 1.641 | 0.515 | p53 |
| 3410 | FGFR1OP2 | SEQ ID NO. 1440 | 68.89 | 96.993 | 1.408 | p53 |
| 3411 | SOCS2 | SEQ ID NO. 1441 | 0.242 | 0.188 | 0.777 | p53 |
| 3412 | DDX41 | SEQ ID NO. 1442 | 37.563 | 17.286 | 0.46 | p53 |
| 3413 | PPP1R13L | SEQ ID NO. 1443 | 0.493 | 0.741 | 1.505 | p53 |
| 3414 | E2F7 | SEQ ID NO. 1444 | 0.528 | 1.302 | 2.503 | p53 |
| 3415 | ANAPC4 | SEQ ID NO. 1445 | 1.182 | 0.953 | 0.806 | p53 |
| 3416 | DDT | SEQ ID NO. 1446 | 4.835 | 2.638 | 0.582 | p53 |
| 3417 | GSTP1 | SEQ ID NO. 1447 | 0.11 | 0.23 | 2.083 | p53 |
| 3418 | RAD23A | SEQ ID NO. 1448 | 2.413 | 2.645 | 1.096 | p53 |
| 3419 | MBD6 | SEQ ID NO. 1449 | 8.526 | 6.626 | 0.777 | p53 |
| 3420 | DUSP6 | SEQ ID NO. 1450 | 0.49 | 0.783 | 1.597 | p53 |
| 3421 | PITPNM1 | SEQ ID NO. 1451 | 0.28 | 0.406 | 1.453 | p53 |
| 3422 | RAP2B | SEQ ID NO. 1452 | 3.805 | 5.179 | 1.361 | p53 |
| 3423 | NULL | SEQ ID NO. 1453 | 9.351 | 4.617 | 0.494 | p53 |
| 3424 | MRPS26 | SEQ ID NO. 1454 | 0.769 | 0.451 | 0.586 | p53 |

*FIG. 1CJ* -- TABLE 1 TRANSCRIPTIONAL BIOMARKER FUNCTIONAL DATA
SECTION 4A

| LINE_ID | GENE_SYMBOL | SEQUENCE_ID_LISTING | PROM_ACTIVITY_N Q_INDUCTION | PROM_ACTIVITY_WI TH_INDUCTION | INDUCTION RATIO | INDUCTION_CONDITIONS |
|---|---|---|---|---|---|---|
| 3425 | C12orf11 | SEQ ID NO. 1453 | 79.355 | 85.1 | 1.072 | p53 |
| 3426 | MOAP1 | SEQ ID NO. 1454 | 3.217 | 4.613 | 1.434 | p53 |
| 3427 | STAG3 | SEQ ID NO. 1455 | 8.916 | 1.891 | 0.212 | p53 |
| 3428 | MAFK | SEQ ID NO. 1456 | 1.418 | 1.992 | 1.405 | p53 |
| 3429 | APC2 | SEQ ID NO. 1457 | 0.4 | 0.43 | 1.075 | p53 |
| 3430 | RAD1 | SEQ ID NO. 1458 | 0.188 | 0.209 | 1.112 | p53 |
| 3431 | MRPL21 | SEQ ID NO. 1459 | 0.794 | 1.162 | 1.463 | p53 |
| 3432 | DAPK2 | SEQ ID NO. 1460 | 0.274 | 0.221 | 0.808 | p53 |
| 3433 | NULL | SEQ ID NO. 1461 | 1.897 | 2.573 | 1.356 | p53 |
| 3434 | KIAA0562 | SEQ ID NO. 1462 | 6.076 | 9.823 | 1.628 | p53 |
| 3435 | CDKN1B | SEQ ID NO. 1463 | 46.625 | 27.06 | 0.58 | p53 |
| 3436 | FGF4 | SEQ ID NO. 1464 | 0.661 | 0.881 | 1.332 | p53 |
| 3437 | RAN | SEQ ID NO. 1465 | 53.687 | 43.127 | 0.803 | p53 |
| 3438 | ACVR1C | SEQ ID NO. 1466 | 0.643 | 0.754 | 1.174 | p53 |
| 3439 | PAB33B | SEQ ID NO. 1467 | 1.324 | 1.445 | 1.092 | p53 |
| 3440 | APC2 | SEQ ID NO. 1468 | 7.454 | 5.89 | 0.79 | p53 |
| 3441 | CDKN1A | SEQ ID NO. 1469 | 0.075 | 0.133 | 1.775 | p53 |
| 3442 | RAP2B | SEQ ID NO. 1470 | 0.777 | 0.777 | 1.001 | p53 |
| 3443 | TRAF4 | SEQ ID NO. 1471 | 5.074 | 11.761 | 2.318 | p53 |
| 3444 | LIG1 | SEQ ID NO. 1472 | 37.313 | 37.011 | 0.992 | p53 |
| 3445 | ARHGEF6 | SEQ ID NO. 1473 | 0.566 | 0.666 | 1.177 | p53 |
| 3446 | PLK3 | SEQ ID NO. 1474 | 2.582 | 5.455 | 2.112 | p53 |
| 3447 | IK3P | SEQ ID NO. 1475 | 6.37 | 32.701 | 5.133 | p53 |
| 3448 | HSPE1 | SEQ ID NO. 1476 | 5.513 | 4.127 | 0.748 | p53 |
| 3449 | IT3AE | SEQ ID NO. 1477 | 2.005 | 3.078 | 1.536 | p53 |
| 3450 | PRELID1 | SEQ ID NO. 1478 | 279.554 | 231.028 | 0.826 | p53 |
| 3451 | LTB4R | SEQ ID NO. 1479 | 2.245 | 1.716 | 0.764 | p53 |
| 3452 | JAK2 | SEQ ID NO. 1480 | 8.756 | 6.751 | 0.771 | p53 |
| 3453 | NULL | SEQ ID NO. 1481 | 77.819 | 47.292 | 0.608 | p53 |
| 3454 | LTBP2 | SEQ ID NO. 1482 | 0.457 | 0.285 | 0.623 | p53 |
| 3455 | PRKCE | SEQ ID NO. 1483 | 0.612 | 0.756 | 1.236 | p53 |
| 3456 | UBE7 | SEQ ID NO. 1484 | 6.156 | 9.662 | 1.57 | p53 |
| 3457 | NULL | SEQ ID NO. 1485 | 3.253 | 2.533 | 0.778 | p53 |
| 3458 | LOC114236 | SEQ ID NO. 1486 | 0.14 | 0.525 | 3.755 | p53 |
| 3459 | CD85R1 | SEQ ID NO. 1487 | 0.81 | 0.894 | 1.104 | p53 |
| 3460 | C20orf177 | SEQ ID NO. 1488 | 0.688 | 0.4 | 0.581 | p53 |
| 3461 | SOCS3 | SEQ ID NO. 1489 | 1.155 | 1.276 | 1.105 | p53 |
| 3462 | RAB40C | SEQ ID NO. 1490 | 7.146 | 9.35 | 1.308 | p53 |
| 3463 | YWHAH | SEQ ID NO. 1491 | 7.289 | 2.31 | 0.317 | p53 |
| 3464 | TP53I13 | SEQ ID NO. 1492 | 0.653 | 0.72 | 1.102 | p53 |
| 3465 | PIK3R5 | SEQ ID NO. 1493 | 0.254 | 0.506 | 1.995 | p53 |
| 3466 | RTEL1 | SEQ ID NO. 1494 | 16.562 | 21.216 | 1.281 | p53 |
| 3467 | NULL | SEQ ID NO. 1495 | 21.745 | 9.44 | 0.434 | p53 |
| 3468 | GGCT | SEQ ID NO. 1496 | 202.063 | 105.979 | 0.524 | p53 |
| 3469 | FANCF | SEQ ID NO. 1497 | 5.616 | 4.687 | 0.835 | p53 |
| 3470 | PTP4A1 | SEQ ID NO. 1498 | 0.257 | 0.405 | 1.578 | p53 |
| 3471 | RAN | SEQ ID NO. 1499 | 1.207 | 0.447 | 0.371 | p53 |
| 3472 | BAG3 | SEQ ID NO. 1500 | 0.078 | 0.077 | 0.976 | p53 |

FIG. 1CK -- TABLE 1 TRANSCRIPTIONAL BIOMARKER FUNCTIONAL DATA
SECTION 4A

| LINE_ID | GENE_SYMBOL | SEQUENCE_ID_LISTING | PROM_ACTIVITY_NO_INDUCTION | PROM_ACTIVITY_WITH_INDUCTION | INDUCTION_RATIO | INDUCTION_CONDITIONS* |
|---|---|---|---|---|---|---|
| 3473 | APTX | SEQ ID NO. 1500 | 0.709 | 0.464 | 0.655 | p53 |
| 3474 | RAGE | SEQ ID NO. 1501 | 1.781 | 3.482 | 1.955 | p53 |
| 3475 | USMG5 | SEQ ID NO. 1502 | 984.112 | 695.876 | 0.707 | p53 |
| 3476 | NULL | SEQ ID NO. 1503 | 1.071 | 1.863 | 1.74 | p53 |
| 3477 | TPD52L1 | SEQ ID NO. 1504 | 0.163 | 0.302 | 1.854 | p53 |
| 3478 | TRMT6 | SEQ ID NO. 1505 | 0.627 | 1.308 | 2.085 | p53 |
| 3479 | REV3L | SEQ ID NO. 1506 | 14.86 | 25.552 | 1.72 | p53 |
| 3480 | PDGFB | SEQ ID NO. 1507 | 1.485 | 0.918 | 0.618 | p53 |
| 3481 | GSG2 | SEQ ID NO. 1508 | 2.486 | 0.801 | 0.322 | p53 |
| 3482 | CARD10 | SEQ ID NO. 1509 | 0.885 | 0.909 | 1.028 | p53 |
| 3483 | REV3L | SEQ ID NO. 1510 | 0.349 | 1.372 | 3.928 | p53 |
| 3484 | MGAM | SEQ ID NO. 1511 | 0.062 | 0.04 | 0.651 | p53 |
| 3485 | RAD21 | SEQ ID NO. 1512 | 1.325 | 1.168 | 0.882 | p53 |
| 3486 | MAPK1 | SEQ ID NO. 1513 | 0.122 | 0.168 | 1.378 | p53 |
| 3487 | DNASE1 | SEQ ID NO. 1514 | 0.962 | 0.81 | 0.842 | p53 |
| 3488 | ACTA2 | SEQ ID NO. 1515 | 11.921 | 17.825 | 1.495 | p53 |
| 3489 | CASP8AP2 | SEQ ID NO. 1516 | 9.196 | 2.638 | 0.287 | p53 |
| 3490 | CDK5R1 | SEQ ID NO. 1517 | 1.781 | 1.44 | 0.808 | p53 |
| 3491 | CIDEB | SEQ ID NO. 1517 | 1.032 | 0.888 | 0.861 | p53 |

*FIG. 1CL* -- TABLE 1 TRANSCRIPTIONAL BIOMARKER FUNCTIONAL DATA
SECTION 4A

| LINE_ID | GENE_SYMBOL | SEQUENCE_ID_LISTING | PROM_ACTIVITY_N_O_INDUCTION | PROM_ACTIVITY_N_TH_INDUCTION | PROM_ACTIVITY_WI_INDUCTION | INDUCTION_RATIO | INDUCTION_CONDITIONS |
|---|---|---|---|---|---|---|---|
| 3492 | MTL5 | SEQ ID NO. 1518 | 0.448 | 0.185 | 0.415 | p53 |
| 3493 | SLC2A1 | SEQ ID NO. 1518 | 1.271 | 1.088 | 0.855 | p53 |
| 3494 | ARNT | SEQ ID NO. 1518 | 1.238 | 1.498 | 1.209 | p53 |
| 3495 | HK1 | SEQ ID NO. 1518 | 0.213 | 0.339 | 1.59 | p53 |
| 3496 | PTEN | SEQ ID NO. 1518 | 2.736 | 6.078 | 2.221 | p53 |
| 3497 | CASP1 | SEQ ID NO. 1518 | 0.166 | 0.811 | 4.889 | p53 |
| 3498 | MDM2 | SEQ ID NO. 1518 | 126.801 | 349.008 | 2.752 | p53 |
| 3499 | APAF1 | SEQ ID NO. 1518 | 6.33 | 35.549 | 5.616 | p53 |
| 3500 | HSP90AA1 | SEQ ID NO. 1518 | 21.599 | 18.935 | 0.877 | p53 |
| 3501 | ARPP-19 | SEQ ID NO. 1518 | 0.114 | 0.312 | 2.725 | p53 |
| 3502 | PKM2 | SEQ ID NO. 1518 | 1.633 | 0.851 | 0.521 | p53 |
| 3503 | SELS | SEQ ID NO. 1518 | 9.371 | 7.781 | 0.83 | p53 |
| 3504 | ACE | SEQ ID NO. 1518 | 3.011 | 4.026 | 1.337 | p53 |
| 3505 | IL1R2 | SEQ ID NO. 1518 | 0.205 | 0.261 | 1.275 | p53 |
| 3506 | HMOX1 | SEQ ID NO. 1518 | 0.455 | 0.413 | 0.91 | p53 |
| 3507 | EGF | SEQ ID NO. 1518 | 6.369 | 6.201 | 0.974 | p53 |
| 3508 | CDKN1A | SEQ ID NO. 1518 | 10.868 | 6.887 | 0.834 | p53 |
| 3509 | TXN | SEQ ID NO. 1518 | 1.494 | 1.465 | 0.981 | p53 |
| 3510 | CYCS | SEQ ID NO. 1518 | 19.71 | 21.775 | 1.105 | p53 |
| 3511 | MX1 | SEQ ID NO. 1518 | 9.999 | 10.481 | 1.048 | p53 |
| 3512 | DAPK3 | SEQ ID NO. 1518 | 0.258 | 0.628 | 2.437 | p53 |
| 3513 | F11R | SEQ ID NO. 1518 | 0.227 | 0.214 | 0.942 | p53 |
| 3514 | TNFRSF10A | SEQ ID NO. 1518 | 0.134 | 0.163 | 1.22 | p53 |
| 3515 | MPR1 | SEQ ID NO. 1518 | 0.143 | 0.074 | 0.515 | p53 |
| 3516 | MDH1 | SEQ ID NO. 1518 | 1.809 | 1.285 | 0.711 | p53 |
| 3517 | BAX | SEQ ID NO. 1518 | 2.252 | 1.162 | 0.516 | p53 |
| 3518 | ACO2 | SEQ ID NO. 1518 | 5.754 | 8.319 | 1.446 | p53 |
| 3519 | MIF | SEQ ID NO. 1518 | 0.866 | 3.401 | 3.928 | p53 |
| 3520 | RHOB | SEQ ID NO. 1518 | 0.051 | 0.035 | 0.682 | p53 |
| 3521 | H6PD | SEQ ID NO. 1518 | 0.074 | 0.349 | 4.703 | p53 |
| 3522 | AHSG | SEQ ID NO. 1518 | 0.366 | 0.539 | 1.471 | p53 |
| 3523 | PANK1 | SEQ ID NO. 1518 | 2.372 | 4.926 | 2.077 | p53 |
| 3524 | DCBLD1 | SEQ ID NO. 1518 | 0.267 | 0.252 | 0.945 | p53 |
| 3525 | NULL | SEQ ID NO. 1518 | 8.736 | 9.633 | 1.1 | p53 |
| 3526 | NULL | SEQ ID NO. 1518 | 28.048 | 38.343 | 1.329 | p53 |
| 3527 | GLS2 | SEQ ID NO. 1518 | 0.203 | 0.872 | 4.3 | p53 |
| 3528 | C12orf45 | SEQ ID NO. 1518 | 5.495 | 11.184 | 2.035 | p53 |
| 3529 | MZF1 | SEQ ID NO. 1518 | 4.44 | 6.7 | 1.509 | p53 |
| 3530 | MXI1 | SEQ ID NO. 1518 | 3.138 | 1.848 | 0.589 | p53 |
| 3531 | APOBEC3C | SEQ ID NO. 1518 | 0.4 | 0.596 | 1.491 | p53 |
| 3532 | GCLC | SEQ ID NO. 1518 | 0.606 | 0.844 | 1.393 | p53 |
| 3533 | MT3 | SEQ ID NO. 1518 | 0.564 | 0.782 | 1.388 | p53 |
| 3534 | TXNRD2 | SEQ ID NO. 1518 | 0.385 | 0.553 | 1.435 | p53 |

FIG. 1CM -- TABLE 1 TRANSCRIPTIONAL BIOMARKER FUNCTIONAL DATA
SECTION 9A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS* |
|---|---|---|---|---|---|---|
| 3535 | RBKS | SEQ ID NO. 1519 | 0.079 | 0.081 | 1.022 | PPAR_alpha |
| 3536 | RBKS | SEQ ID NO. 1519 | 0.029 | 0.02 | 0.677 | PPAR_delta |
| 3537 | RBKS | SEQ ID NO. 1519 | 0.041 | 0.066 | 1.635 | PPAR_gamma |
| 3538 | NULL | SEQ ID NO. 1520 | 0.054 | 0.051 | 0.951 | PPAR_alpha |
| 3539 | NULL | SEQ ID NO. 1520 | 0.009 | 0.009 | 0.978 | PPAR_delta |
| 3540 | NULL | SEQ ID NO. 1520 | 0.029 | 0.064 | 2.238 | PPAR_gamma |
| 3541 | GLRX2 | SEQ ID NO. 1520 | 0.025 | 0.024 | 0.95 | PPAR_alpha |
| 3542 | GLRX2 | SEQ ID NO. 1520 | 0.007 | 0.007 | 0.935 | PPAR_delta |
| 3543 | GLRX2 | SEQ ID NO. 1520 | 0.014 | 0.017 | 1.208 | PPAR_gamma |
| 3544 | SLC7A5 | SEQ ID NO. 1521 | 0.025 | 0.037 | 1.498 | PPAR_alpha |
| 3545 | SLC7A5 | SEQ ID NO. 1521 | 0.007 | 0.008 | 1.091 | PPAR_delta |
| 3546 | SLC7A5 | SEQ ID NO. 1521 | 0.017 | 0.024 | 1.435 | PPAR_gamma |
| 3547 | CDK3 | SEQ ID NO. 1522 | 0.021 | 0.023 | 1.146 | PPAR_alpha |
| 3548 | CDK3 | SEQ ID NO. 1522 | 0.009 | 0.013 | 1.54 | PPAR_delta |
| 3549 | CDK3 | SEQ ID NO. 1522 | 0.011 | 0.014 | 1.318 | PPAR_gamma |
| 3550 | N4BP2L1 | SEQ ID NO. 1523 | 0.106 | 0.186 | 1.759 | PPAR_alpha |
| 3551 | N4BP2L1 | SEQ ID NO. 1523 | 0.046 | 0.073 | 1.589 | PPAR_delta |
| 3552 | N4BP2L1 | SEQ ID NO. 1523 | 0.113 | 0.147 | 1.304 | PPAR_gamma |
| 3553 | PARP12 | SEQ ID NO. 1524 | 0.107 | 0.136 | 1.263 | PPAR_alpha |
| 3554 | PARP12 | SEQ ID NO. 1524 | 0.009 | 0.014 | 1.669 | PPAR_delta |
| 3555 | PARP12 | SEQ ID NO. 1524 | 0.032 | 0.056 | 1.752 | PPAR_gamma |
| 3556 | AKAP9 | SEQ ID NO. 1524 | 1.002 | 1.107 | 1.105 | PPAR_alpha |
| 3557 | AKAP9 | SEQ ID NO. 1524 | 0.195 | 0.13 | 0.666 | PPAR_delta |
| 3558 | AKAP9 | SEQ ID NO. 1524 | 0.664 | 0.536 | 0.806 | PPAR_gamma |
| 3559 | NULL | SEQ ID NO. 1524 | 0.112 | 0.065 | 0.579 | PPAR_alpha |
| 3560 | NULL | SEQ ID NO. 1524 | 0.033 | 0.056 | 1.686 | PPAR_delta |
| 3561 | NULL | SEQ ID NO. 1524 | 0.044 | 0.049 | 1.097 | PPAR_gamma |
| 3562 | NUB1 | SEQ ID NO. 1524 | 2.404 | 1.71 | 0.711 | PPAR_alpha |
| 3563 | NUB1 | SEQ ID NO. 1524 | 0.754 | 1.157 | 1.533 | PPAR_delta |
| 3564 | NUB1 | SEQ ID NO. 1524 | 1.788 | 1.594 | 0.891 | PPAR_gamma |
| 3565 | REPIN1 | SEQ ID NO. 1524 | 0.405 | 0.277 | 0.686 | PPAR_alpha |
| 3566 | REPIN1 | SEQ ID NO. 1524 | 0.074 | 0.068 | 0.922 | PPAR_delta |
| 3567 | REPIN1 | SEQ ID NO. 1524 | 0.209 | 0.289 | 1.382 | PPAR_gamma |

FIG. 1CN -- TABLE 1 TRANSCRIPTIONAL BIOMARKER FUNCTIONAL DATA
SECTION 10A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS* |
|---|---|---|---|---|---|---|
| 3568 | SCD | SEQ ID NO. 1525 | 0.007 | 0.009 | 1.265 | RAR_alpha |
| 3569 | SCD | SEQ ID NO. 1525 | 0.017 | 0.027 | 1.567 | RAR_beta |
| 3570 | SCD | SEQ ID NO. 1525 | 0.03 | 0.017 | 0.548 | RAR_gamma |
| 3571 | ABCA1 | SEQ ID NO. 1525 | 0.209 | 0.32 | 1.532 | RAR_alpha |
| 3572 | ABCA1 | SEQ ID NO. 1525 | 0.226 | 0.446 | 1.98 | RAR_gamma |
| 3573 | NEDD9 | SEQ ID NO. 1525 | 0.17 | 0.09 | 0.532 | RAR_alpha |
| 3574 | NEDD9 | SEQ ID NO. 1525 | 0.278 | 0.206 | 0.743 | RAR_beta |
| 3575 | NEDD9 | SEQ ID NO. 1525 | 0.203 | 0.161 | 0.793 | RAR_gamma |
| 3576 | ABCC6 | SEQ ID NO. 1526 | 0.039 | 0.042 | 1.083 | RAR_alpha |
| 3577 | ABCC6 | SEQ ID NO. 1526 | 0.073 | 0.061 | 0.83 | RAR_beta |
| 3578 | ABCC6 | SEQ ID NO. 1526 | 0.063 | 0.045 | 0.686 | RAR_gamma |
| 3579 | CYP26A1 | SEQ ID NO. 1527 | 0.014 | 0.024 | 1.729 | RAR_alpha |
| 3580 | CYP26A1 | SEQ ID NO. 1527 | 0.032 | 0.032 | 1.012 | RAR_beta |
| 3581 | CYP26A1 | SEQ ID NO. 1527 | 0.024 | 0.024 | 1.003 | RAR_gamma |
| 3582 | AKAP9 | SEQ ID NO. 1527 | 0.336 | 0.184 | 0.549 | RAR_alpha |
| 3583 | AKAP9 | SEQ ID NO. 1527 | 0.383 | 0.252 | 0.657 | RAR_beta |
| 3584 | AKAP9 | SEQ ID NO. 1527 | 0.158 | 0.188 | 1.187 | RAR_gamma |
| 3585 | NULL | SEQ ID NO. 1527 | 0.049 | 0.045 | 0.929 | RAR_alpha |
| 3586 | NULL | SEQ ID NO. 1527 | 0.039 | 0.046 | 1.192 | RAR_beta |
| 3587 | NULL | SEQ ID NO. 1527 | 0.075 | 0.041 | 0.544 | RAR_gamma |
| 3588 | HOXA1 | SEQ ID NO. 1527 | 0.062 | 0.056 | 0.903 | RAR_alpha |
| 3589 | HOXA1 | SEQ ID NO. 1527 | 0.108 | 0.105 | 0.973 | RAR_gamma |
| 3590 | NUB1 | SEQ ID NO. 1527 | 0.816 | 0.915 | 1.122 | RAR_alpha |
| 3591 | NUB1 | SEQ ID NO. 1527 | 0.667 | 0.748 | 1.121 | RAR_gamma |
| 3592 | REPIN1 | SEQ ID NO. 1527 | 0.13 | 0.107 | 0.824 | RAR_alpha |
| 3593 | REPIN1 | SEQ ID NO. 1527 | 0.117 | 0.111 | 0.942 | RAR_beta |
| 3594 | REPIN1 | SEQ ID NO. 1527 | 0.117 | 0.096 | 0.815 | RAR_gamma |
| 3595 | NEDD9 | SEQ ID NO. 1528 | 0.012 | 0.009 | 0.791 | RAR_alpha |
| 3596 | NEDD9 | SEQ ID NO. 1528 | 0.019 | 0.013 | 0.67 | RAR_beta |
| 3597 | NEDD9 | SEQ ID NO. 1528 | 0.009 | 0.015 | 1.551 | RAR_gamma |
| 3598 | PKD1 | SEQ ID NO. 1528 | 0.035 | 0.012 | 0.334 | RAR_alpha |
| 3599 | PKD1 | SEQ ID NO. 1528 | 0.016 | 0.019 | 1.197 | RAR_gamma |
| 3600 | PKD1 | SEQ ID NO. 1529 | 0.049 | 0.037 | 0.773 | RAR_alpha |
| 3601 | PKD1 | SEQ ID NO. 1529 | 0.08 | 0.055 | 0.69 | RAR_beta |
| 3602 | PKD1 | SEQ ID NO. 1529 | 0.126 | 0.033 | 0.265 | RAR_gamma |
| 3603 | NEDD9 | SEQ ID NO. 1529 | 0.035 | 0.018 | 0.495 | RAR_alpha |
| 3604 | NEDD9 | SEQ ID NO. 1529 | 0.058 | 0.042 | 0.727 | RAR_beta |
| 3605 | NEDD9 | SEQ ID NO. 1529 | 0.037 | 0.023 | 0.624 | RAR_gamma |
| 3606 | CXCR5 | SEQ ID NO. 1529 | 0.013 | 0.022 | 1.617 | RAR_alpha |
| 3607 | CXCR5 | SEQ ID NO. 1529 | 0.034 | 0.031 | 0.935 | RAR_beta |
| 3608 | CXCR5 | SEQ ID NO. 1529 | 0.027 | 0.022 | 0.8 | RAR_gamma |

*FIG. 1CO -- TABLE 1 TRANSCRIPTIONAL BIOMARKER FUNCTIONAL DATA*
*SECTION 10A*

| LINE_ID | GENE_SYMBOL | SEQUENCE_ID_LISTING | PROM_ACTIVITY_N O_INDUCTION | PROM_ACTIVITY_WI TH_INDUCTION | INDUCTION RATIO | INDUCTION_CONDITIONS |
|---|---|---|---|---|---|---|
| 3609 | PCK2 | SEQ ID NO. 1530 | 0.229 | 0.194 | 0.849 | RAR_alpha |
| 3610 | PCK2 | SEQ ID NO. 1530 | 0.269 | 0.174 | 0.646 | RAR_beta |
| 3611 | PCK2 | SEQ ID NO. 1530 | 0.423 | 0.177 | 0.418 | RAR_gamma |
| 3612 | HOXB1 | SEQ ID NO. 1531 | 0.005 | 0.007 | 1.208 | RAR_alpha |
| 3613 | HOXB1 | SEQ ID NO. 1531 | 0.004 | 0.003 | 0.783 | RAR_beta |
| 3614 | HOXB1 | SEQ ID NO. 1531 | 0.007 | 0.006 | 0.842 | RAR_gamma |
| 3615 | SCD | SEQ ID NO. 1532 | 0.005 | 0.005 | 1.044 | RAR_alpha |
| 3616 | SCD | SEQ ID NO. 1532 | 0.006 | 0.014 | 2.089 | RAR_beta |
| 3617 | SCD | SEQ ID NO. 1532 | 0.009 | 0.01 | 1.091 | RAR_gamma |
| 3618 | FOXA1 | SEQ ID NO. 1533 | 0.009 | 0.007 | 0.837 | RAR_alpha |
| 3619 | FOXA1 | SEQ ID NO. 1533 | 0.009 | 0.01 | 1.167 | RAR_beta |
| 3620 | FOXA1 | SEQ ID NO. 1533 | 0.011 | 0.012 | 1.068 | RAR_gamma |
| 3621 | RAI14 | SEQ ID NO. 1534 | 0.004 | 0.004 | 1.22 | RAR_alpha |
| 3622 | RAI14 | SEQ ID NO. 1534 | 0.005 | 0.004 | 0.76 | RAR_beta |
| 3623 | RAI14 | SEQ ID NO. 1534 | 0.006 | 0.006 | 0.907 | RAR_gamma |

*FIG. 1CP* — TABLE 1 TRANSCRIPTIONAL BIOMARKER FUNCTIONAL DATA
SECTION 5A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS* |
|---|---|---|---|---|---|---|
| 3624 | LZTFL1 | SEQ ID NO. 1535 | 0.545 | 0.846 | 1.552 | SREBP_lov |
| 3625 | LZTFL1 | SEQ ID NO. 1535 | 0.545 | 0.42 | 0.772 | SREBP_synth |
| 3626 | LZTFL1 | SEQ ID NO. 1535 | 0.545 | 0.663 | 1.217 | SREBP_U18666A |
| 3627 | SCD | SEQ ID NO. 1535 | 0.435 | 2.051 | 4.721 | SREBP_lov |
| 3628 | SCD | SEQ ID NO. 1535 | 0.435 | 0.13 | 0.3 | SREBP_synth |
| 3629 | SCD | SEQ ID NO. 1535 | 0.435 | 1.668 | 3.838 | SREBP_U18666A |
| 3630 | TIPARP | SEQ ID NO. 1535 | 14.099 | 14.145 | 1.003 | SREBP_lov |
| 3631 | TIPARP | SEQ ID NO. 1535 | 14.099 | 16.856 | 1.196 | SREBP_synth |
| 3632 | TIPARP | SEQ ID NO. 1535 | 14.099 | 21.59 | 1.531 | SREBP_U18666A |
| 3633 | ACSL1 | SEQ ID NO. 1536 | 0.054 | 0.212 | 3.96 | SREBP_lov |
| 3634 | ACSL1 | SEQ ID NO. 1536 | 0.054 | 0.024 | 0.454 | SREBP_synth |
| 3635 | ACSL1 | SEQ ID NO. 1536 | 0.054 | 0.075 | 1.39 | SREBP_U18666A |
| 3636 | ACSL1 | SEQ ID NO. 1537 | 0.484 | 0.42 | 0.868 | SREBP_lov |
| 3637 | ACSL1 | SEQ ID NO. 1537 | 0.484 | 0.54 | 1.117 | SREBP_synth |
| 3638 | ACSL1 | SEQ ID NO. 1537 | 0.484 | 0.373 | 0.771 | SREBP_U18666A |
| 3639 | ACSL5 | SEQ ID NO. 1538 | 0.319 | 0.458 | 1.436 | SREBP_lov |
| 3640 | ACSL5 | SEQ ID NO. 1538 | 0.319 | 0.305 | 0.957 | SREBP_synth |
| 3641 | ACSL5 | SEQ ID NO. 1538 | 0.319 | 0.443 | 1.387 | SREBP_U18666A |
| 3642 | ACSL4 | SEQ ID NO. 1539 | 3.094 | 10.125 | 3.273 | SREBP_lov |
| 3643 | ACSL4 | SEQ ID NO. 1539 | 3.094 | 2.01 | 0.65 | SREBP_synth |
| 3644 | ACSL4 | SEQ ID NO. 1539 | 3.094 | 6.926 | 2.239 | SREBP_U18666A |
| 3645 | ACSL5 | SEQ ID NO. 1540 | 0.874 | 0.884 | 1.012 | SREBP_lov |
| 3646 | ACSL5 | SEQ ID NO. 1540 | 0.874 | 0.876 | 1.002 | SREBP_synth |
| 3647 | ACSL5 | SEQ ID NO. 1540 | 0.874 | 0.869 | 0.995 | SREBP_U18666A |
| 3648 | ACOT8 | SEQ ID NO. 1541 | 14.572 | 15.857 | 1.088 | SREBP_lov |
| 3649 | ACOT8 | SEQ ID NO. 1541 | 14.572 | 15.23 | 1.045 | SREBP_synth |
| 3650 | ACOT8 | SEQ ID NO. 1541 | 14.572 | 18.298 | 1.256 | SREBP_U18666A |
| 3651 | LIMS3 | SEQ ID NO. 1542 | 1.066 | 1.131 | 1.061 | SREBP_lov |
| 3652 | LIMS3 | SEQ ID NO. 1542 | 1.066 | 1.571 | 1.473 | SREBP_synth |
| 3653 | LIMS3 | SEQ ID NO. 1542 | 1.066 | 1.125 | 1.055 | SREBP_U18666A |
| 3654 | ATP6AP1 | SEQ ID NO. 1542 | 0.528 | 0.51 | 0.966 | SREBP_lov |
| 3655 | ATP6AP1 | SEQ ID NO. 1542 | 0.528 | 0.459 | 0.868 | SREBP_synth |
| 3656 | ATP6AP1 | SEQ ID NO. 1542 | 0.528 | 0.45 | 0.852 | SREBP_U18666A |
| 3657 | AKAP9 | SEQ ID NO. 1542 | 15.144 | 15.112 | 0.998 | SREBP_lov |
| 3658 | AKAP9 | SEQ ID NO. 1542 | 15.144 | 16.672 | 1.101 | SREBP_synth |
| 3659 | AKAP9 | SEQ ID NO. 1542 | 15.144 | 18.881 | 1.247 | SREBP_U18666A |

FIG. 1CQ – TABLE 1 TRANSCRIPTIONAL BIOMARKER FUNCTIONAL DATA
SECTION 5A

| LINE_ID | GENE_SYMBOL | SEQUENCE_ID_LISTING | PROM_ACTIVITY_N O_INDUCTION | PROM_ACTIVITY_WI TH_INDUCTION | INDUCTION RATIO | INDUCTION_CONDITIONS* |
|---|---|---|---|---|---|---|
| 3660 | CYP51A1 | SEQ ID NO. 1543 | 0.113 | 0.376 | 3.337 | SREBP_low |
| 3661 | CYP51A1 | SEQ ID NO. 1543 | 0.113 | 0.095 | 0.84 | SREBP_synth |
| 3662 | CYP51A1 | SEQ ID NO. 1543 | 0.113 | 0.254 | 2.250 | SREBP_U18666A |
| 3663 | SNX8 | SEQ ID NO. 1543 | 5.099 | 6.656 | 1.305 | SREBP_low |
| 3664 | SNX8 | SEQ ID NO. 1543 | 5.099 | 6.406 | 1.256 | SREBP_synth |
| 3665 | SNX8 | SEQ ID NO. 1543 | 5.099 | 5.562 | 1.091 | SREBP_U18666A |
| 3666 | NULL | SEQ ID NO. 1543 | 51.527 | 48.051 | 0.933 | SREBP_low |
| 3667 | NULL | SEQ ID NO. 1543 | 51.527 | 46.693 | 0.906 | SREBP_synth |
| 3668 | NULL | SEQ ID NO. 1543 | 51.527 | 52.694 | 1.023 | SREBP_U18666A |
| 3669 | NULL | SEQ ID NO. 1543 | 13.355 | 12.508 | 0.937 | SREBP_low |
| 3670 | NULL | SEQ ID NO. 1543 | 13.355 | 12.069 | 0.904 | SREBP_synth |
| 3671 | NULL | SEQ ID NO. 1543 | 13.355 | 11.209 | 0.839 | SREBP_U18666A |
| 3672 | HERPUD2 | SEQ ID NO. 1543 | 11.269 | 9.929 | 0.881 | SREBP_low |
| 3673 | HERPUD2 | SEQ ID NO. 1543 | 11.269 | 9.617 | 0.853 | SREBP_synth |
| 3674 | HERPUD2 | SEQ ID NO. 1543 | 11.269 | 11.612 | 1.03 | SREBP_U18666A |
| 3675 | NULL | SEQ ID NO. 1543 | 1.806 | 1.747 | 0.968 | SREBP_low |
| 3676 | NULL | SEQ ID NO. 1543 | 1.806 | 1.66 | 0.919 | SREBP_synth |
| 3677 | NULL | SEQ ID NO. 1543 | 1.806 | 1.998 | 1.106 | SREBP_U18666A |
| 3678 | SCRN1 | SEQ ID NO. 1544 | 2.776 | 2.821 | 1.02 | SREBP_low |
| 3679 | SCRN1 | SEQ ID NO. 1544 | 2.776 | 2.831 | 1.02 | SREBP_synth |
| 3680 | SCRN1 | SEQ ID NO. 1544 | 2.776 | 2.187 | 0.788 | SREBP_U18666A |
| 3681 | NCAPG2 | SEQ ID NO. 1544 | 11.552 | 8.964 | 0.776 | SREBP_low |
| 3682 | NCAPG2 | SEQ ID NO. 1544 | 11.552 | 10.683 | 0.925 | SREBP_synth |
| 3683 | NCAPG2 | SEQ ID NO. 1544 | 11.552 | 7.687 | 0.665 | SREBP_U18666A |
| 3684 | NUB1 | SEQ ID NO. 1544 | 45.268 | 53.521 | 1.182 | SREBP_low |
| 3685 | NUB1 | SEQ ID NO. 1544 | 45.268 | 55.779 | 1.232 | SREBP_synth |
| 3686 | NUB1 | SEQ ID NO. 1544 | 45.268 | 53.21 | 1.175 | SREBP_U18666A |
| 3687 | SLC4A2 | SEQ ID NO. 1544 | 0.388 | 0.322 | 0.83 | SREBP_low |
| 3688 | SLC4A2 | SEQ ID NO. 1544 | 0.388 | 0.21 | 0.543 | SREBP_synth |
| 3689 | SLC4A2 | SEQ ID NO. 1544 | 0.388 | 0.256 | 0.661 | SREBP_U18666A |
| 3690 | NULL | SEQ ID NO. 1544 | 0.92 | 1.015 | 1.103 | SREBP_low |
| 3691 | NULL | SEQ ID NO. 1544 | 0.92 | 0.826 | 0.897 | SREBP_synth |
| 3692 | NULL | SEQ ID NO. 1544 | 0.921 | 1.778 | 1.932 | SREBP_U18666A |
| 3693 | REPIN1 | SEQ ID NO. 1544 | 11.036 | 12.84 | 1.163 | SREBP_low |
| 3694 | REPIN1 | SEQ ID NO. 1544 | 11.036 | 9.452 | 0.856 | SREBP_synth |
| 3695 | REPIN1 | SEQ ID NO. 1544 | 11.036 | 10.889 | 0.987 | SREBP_U18666A |
| 3696 | MICALL2 | SEQ ID NO. 1544 | 2.401 | 2.14 | 0.891 | SREBP_low |
| 3697 | MICALL2 | SEQ ID NO. 1544 | 2.401 | 2.573 | 1.072 | SREBP_synth |
| 3698 | MICALL2 | SEQ ID NO. 1544 | 2.401 | 2.321 | 0.967 | SREBP_U18666A |
| 3699 | CCAR1 | SEQ ID NO. 1545 | 17.85 | 18.268 | 1.025 | SREBP_low |
| 3700 | CCAR1 | SEQ ID NO. 1545 | 17.85 | 26.692 | 1.495 | SREBP_synth |
| 3701 | CCAR1 | SEQ ID NO. 1545 | 17.85 | 21.699 | 1.216 | SREBP_U18666A |
| 3702 | FLCN | SEQ ID NO. 1546 | 4 | 3.28 | 0.82 | SREBP_low |
| 3703 | FLCN | SEQ ID NO. 1546 | 4 | 6.528 | 1.632 | SREBP_synth |
| 3704 | FLCN | SEQ ID NO. 1546 | 4 | 6.86 | 1.715 | SREBP_U18666A |

FIG. 1CR -- TABLE 1 TRANSCRIPTIONAL BIOMARKER FUNCTIONAL DATA
SECTION 5A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS |
|---|---|---|---|---|---|---|
| 3705 | PIM2 | SEQ ID NO. 1547 | 4.809 | 9.348 | 1.944 | SREBP_lov |
| 3706 | PIM2 | SEQ ID NO. 1547 | 4.809 | 4.309 | 0.896 | SREBP_synth |
| 3707 | PIM2 | SEQ ID NO. 1547 | 4.809 | 9.36 | 1.947 | SREBP_U18666A |
| 3708 | CCNC | SEQ ID NO. 1548 | 90.653 | 100.57 | 1.109 | SREBP_lov |
| 3709 | CCNC | SEQ ID NO. 1548 | 90.653 | 120.893 | 1.334 | SREBP_synth |
| 3710 | CCNC | SEQ ID NO. 1548 | 90.653 | 111.557 | 1.231 | SREBP_U18666A |
| 3711 | GTF2H1 | SEQ ID NO. 1548 | 14.288 | 12.009 | 0.84 | SREBP_lov |
| 3712 | GTF2H1 | SEQ ID NO. 1548 | 14.288 | 17.84 | 1.249 | SREBP_synth |
| 3713 | GTF2H1 | SEQ ID NO. 1548 | 14.288 | 12.442 | 0.871 | SREBP_U18666A |
| 3714 | APEX1 | SEQ ID NO. 1548 | 14.125 | 11.96 | 0.847 | SREBP_lov |
| 3715 | APEX1 | SEQ ID NO. 1548 | 14.125 | 16.29 | 1.153 | SREBP_synth |
| 3716 | APEX1 | SEQ ID NO. 1548 | 14.125 | 11.452 | 0.811 | SREBP_U18666A |
| 3717 | MAPK3 | SEQ ID NO. 1549 | 0.397 | 0.438 | 1.102 | SREBP_lov |
| 3718 | MAPK3 | SEQ ID NO. 1549 | 0.397 | 0.477 | 1.203 | SREBP_synth |
| 3719 | MAPK3 | SEQ ID NO. 1549 | 0.397 | 0.41 | 1.033 | SREBP_U18666A |
| 3720 | UBE4B | SEQ ID NO. 1550 | 53.835 | 54.445 | 1.011 | SREBP_lov |
| 3721 | UBE4B | SEQ ID NO. 1550 | 53.835 | 61.92 | 1.15 | SREBP_synth |
| 3722 | UBE4B | SEQ ID NO. 1550 | 53.835 | 54.081 | 1.005 | SREBP_U18666A |
| 3723 | HPS5 | SEQ ID NO. 1550 | 14.051 | 12.142 | 0.864 | SREBP_lov |
| 3724 | HPS5 | SEQ ID NO. 1550 | 14.051 | 18.379 | 1.308 | SREBP_synth |
| 3725 | HPS5 | SEQ ID NO. 1550 | 14.051 | 22.351 | 1.591 | SREBP_U18666A |
| 3726 | MOSPD2 | SEQ ID NO. 1551 | 9.724 | 13.783 | 1.417 | SREBP_lov |
| 3727 | MOSPD2 | SEQ ID NO. 1551 | 9.724 | 10.647 | 1.095 | SREBP_synth |
| 3728 | MOSPD2 | SEQ ID NO. 1551 | 9.724 | 14.187 | 1.459 | SREBP_U18666A |
| 3729 | USP1 | SEQ ID NO. 1552 | 4.107 | 3.606 | 0.878 | SREBP_lov |
| 3730 | USP1 | SEQ ID NO. 1552 | 4.107 | 5.465 | 1.331 | SREBP_synth |
| 3731 | USP1 | SEQ ID NO. 1552 | 4.107 | 3.711 | 0.904 | SREBP_U18666A |
| 3732 | DUSP1 | SEQ ID NO. 1552 | 52.44 | 60.878 | 1.161 | SREBP_lov |
| 3733 | DUSP1 | SEQ ID NO. 1552 | 52.44 | 93.735 | 1.787 | SREBP_synth |
| 3734 | DUSP1 | SEQ ID NO. 1552 | 52.44 | 62.143 | 1.185 | SREBP_U18666A |
| 3735 | UBE4B | SEQ ID NO. 1553 | 20.528 | 23.551 | 1.147 | SREBP_lov |
| 3736 | UBE4B | SEQ ID NO. 1553 | 20.528 | 25.972 | 1.265 | SREBP_synth |
| 3737 | UBE4B | SEQ ID NO. 1553 | 20.528 | 25.703 | 1.252 | SREBP_U18666A |
| 3738 | LZTS2 | SEQ ID NO. 1554 | 3.022 | 2.715 | 0.898 | SREBP_lov |
| 3739 | LZTS2 | SEQ ID NO. 1554 | 3.022 | 3.658 | 1.21 | SREBP_synth |
| 3740 | LZTS2 | SEQ ID NO. 1554 | 3.022 | 2.515 | 0.832 | SREBP_U18666A |
| 3741 | HDAC5 | SEQ ID NO. 1555 | 4.696 | 6.434 | 1.37 | SREBP_lov |
| 3742 | HDAC5 | SEQ ID NO. 1555 | 4.696 | 5.841 | 1.244 | SREBP_synth |
| 3743 | HDAC5 | SEQ ID NO. 1555 | 4.696 | 5.711 | 1.216 | SREBP_U18666A |
| 3744 | NTHL1 | SEQ ID NO. 1556 | 6.147 | 5.148 | 0.838 | SREBP_lov |
| 3745 | NTHL1 | SEQ ID NO. 1556 | 6.147 | 6.195 | 1.008 | SREBP_synth |
| 3746 | NTHL1 | SEQ ID NO. 1556 | 6.147 | 4.652 | 0.757 | SREBP_U18666A |
| 3747 | TSC2 | SEQ ID NO. 1557 | 1.251 | 1.411 | 1.128 | SREBP_lov |
| 3748 | TSC2 | SEQ ID NO. 1557 | 1.251 | 1.72 | 1.375 | SREBP_synth |
| 3749 | TSC2 | SEQ ID NO. 1557 | 1.251 | 1.286 | 1.028 | SREBP_U18666A |

FIG. 1CS – TABLE 1 TRANSCRIPTIONAL BIOMARKER FUNCTIONAL DATA
SECTION 5A

| LINE_ID | GENE_SYMBOL | SEQUENCE_ID_LISTING | PROM_ACTIVITY_N O_INDUCTION | PROM_ACTIVITY_WI TH_INDUCTION | INDUCTION _RATIO | INDUCTION_CONDITIONS* |
|---|---|---|---|---|---|---|
| 3750 | RAD9A | SEQ ID NO. 1558 | 4.92 | 6.511 | 1.323 | SREBP_lov |
| 3751 | RAD9A | SEQ ID NO. 1558 | 4.92 | 5.116 | 1.04 | SREBP_synth |
| 3752 | RAD9A | SEQ ID NO. 1558 | 4.92 | 6.507 | 1.323 | SREBP_U18666A |
| 3753 | HDAC5 | SEQ ID NO. 1559 | 7.129 | 9.037 | 1.268 | SREBP_lov |
| 3754 | HDAC5 | SEQ ID NO. 1559 | 7.129 | 8.649 | 1.213 | SREBP_synth |
| 3755 | HDAC5 | SEQ ID NO. 1559 | 7.129 | 9.589 | 1.345 | SREBP_U18666A |
| 3756 | TSC2 | SEQ ID NO. 1560 | 6.224 | 5.85 | 0.94 | SREBP_lov |
| 3757 | TSC2 | SEQ ID NO. 1560 | 6.224 | 7.304 | 1.174 | SREBP_synth |
| 3758 | TSC2 | SEQ ID NO. 1560 | 6.224 | 5.85 | 0.94 | SREBP_U18666A |
| 3759 | SIRT1 | SEQ ID NO. 1561 | 1.301 | 1.256 | 0.965 | SREBP_lov |
| 3760 | SIRT1 | SEQ ID NO. 1561 | 1.301 | 1.614 | 1.241 | SREBP_synth |
| 3761 | SIRT1 | SEQ ID NO. 1561 | 1.301 | 1.082 | 0.832 | SREBP_U18666A |
| 3762 | G6PD | SEQ ID NO. 1562 | 19.863 | 22.318 | 1.124 | SREBP_lov |
| 3763 | G6PD | SEQ ID NO. 1562 | 19.863 | 20.706 | 1.043 | SREBP_synth |
| 3764 | G6PD | SEQ ID NO. 1562 | 19.863 | 21.952 | 1.105 | SREBP_U18666A |
| 3765 | TDG | SEQ ID NO. 1563 | 75.61 | 81.383 | 1.076 | SREBP_lov |
| 3766 | TDG | SEQ ID NO. 1563 | 75.61 | 92.965 | 1.23 | SREBP_synth |
| 3767 | TDG | SEQ ID NO. 1563 | 75.61 | 68.026 | 0.899 | SREBP_U18666A |
| 3768 | NU1L | SEQ ID NO. 1564 | 14.323 | 15.655 | 1.093 | SREBP_lov |
| 3769 | NU1L | SEQ ID NO. 1564 | 14.323 | 18.585 | 1.298 | SREBP_synth |
| 3770 | NU1L | SEQ ID NO. 1564 | 14.323 | 20.513 | 1.432 | SREBP_U18666A |
| 3771 | ESPL1 | SEQ ID NO. 1565 | 1.634 | 1.754 | 1.074 | SREBP_lov |
| 3772 | ESPL1 | SEQ ID NO. 1565 | 1.634 | 1.646 | 1.007 | SREBP_synth |
| 3773 | ESPL1 | SEQ ID NO. 1565 | 1.634 | 1.35 | 0.826 | SREBP_U18666A |
| 3774 | OSGEP | SEQ ID NO. 1566 | 4.079 | 4.181 | 1.025 | SREBP_lov |
| 3775 | OSGEP | SEQ ID NO. 1566 | 4.079 | 3.566 | 0.874 | SREBP_synth |
| 3776 | OSGEP | SEQ ID NO. 1566 | 4.079 | 4.148 | 1.017 | SREBP_U18666A |
| 3777 | CDKL3 | SEQ ID NO. 1567 | 29.327 | 31.578 | 1.077 | SREBP_lov |
| 3778 | CDKL3 | SEQ ID NO. 1567 | 29.327 | 30.559 | 1.042 | SREBP_synth |
| 3779 | CDKL3 | SEQ ID NO. 1567 | 29.327 | 29.589 | 1.009 | SREBP_U18666A |
| 3780 | BAX | SEQ ID NO. 1567 | 0.89 | 0.872 | 0.98 | SREBP_lov |
| 3781 | BAX | SEQ ID NO. 1567 | 0.89 | 0.976 | 1.096 | SREBP_synth |
| 3782 | BAX | SEQ ID NO. 1567 | 0.89 | 0.814 | 0.914 | SREBP_U18666A |
| 3783 | PMVK | SEQ ID NO. 1567 | 2.027 | 1.759 | 0.868 | SREBP_lov |
| 3784 | PMVK | SEQ ID NO. 1567 | 2.027 | 2.072 | 1.022 | SREBP_synth |
| 3785 | PMVK | SEQ ID NO. 1567 | 2.027 | 2.204 | 1.087 | SREBP_U18666A |
| 3786 | SUPV3L1 | SEQ ID NO. 1568 | 10.547 | 11.118 | 1.054 | SREBP_lov |
| 3787 | SUPV3L1 | SEQ ID NO. 1568 | 10.547 | 11.792 | 1.118 | SREBP_synth |
| 3788 | SUPV3L1 | SEQ ID NO. 1568 | 10.547 | 12.999 | 1.232 | SREBP_U18666A |
| 3789 | ID1 | SEQ ID NO. 1568 | 10.5 | 8.855 | 0.843 | SREBP_lov |
| 3790 | ID1 | SEQ ID NO. 1568 | 10.5 | 10.055 | 0.958 | SREBP_synth |
| 3791 | ID1 | SEQ ID NO. 1568 | 10.5 | 9.843 | 0.937 | SREBP_U18666A |
| 3792 | PWP1 | SEQ ID NO. 1568 | 123.443 | 121.06 | 0.981 | SREBP_lov |
| 3793 | PWP1 | SEQ ID NO. 1568 | 123.443 | 140.448 | 1.138 | SREBP_synth |
| 3794 | PWP1 | SEQ ID NO. 1568 | 123.443 | 131.261 | 1.063 | SREBP_U18666A |
| 3795 | TIMM13 | SEQ ID NO. 1568 | 12.461 | 12.228 | 0.98 | SREBP_lov |
| 3796 | TIMM13 | SEQ ID NO. 1568 | 12.461 | 15.464 | 1.239 | SREBP_synth |
| 3797 | TIMM13 | SEQ ID NO. 1568 | 12.461 | 16.918 | 1.355 | SREBP_U18666A |

*FIG. 1CT* — TABLE 1 TRANSCRIPTIONAL BIOMARKER FUNCTIONAL DATA
SECTION 5A

| LINE_ID | GENE_SYMBOL | SEQUENCE_ID_LISTING | PROM_ACTIVITY_NO_INDUCTION | PROM_ACTIVITY_WITH_INDUCTION | INDUCTION_RATIO | INDUCTION_CONDITIONS* |
|---|---|---|---|---|---|---|
| 3798 | MAP1LC3B | SEQ ID NO. 1569 | 64.441 | 68.853 | 1.068 | SREBP_lov |
| 3799 | MAP1LC3B | SEQ ID NO. 1569 | 64.441 | 94.544 | 1.467 | SREBP_synth |
| 3800 | MAP1LC3B | SEQ ID NO. 1569 | 64.441 | 117.332 | 1.821 | SREBP_U18666A |
| 3801 | ACACA | SEQ ID NO. 1570 | 3.186 | 3.657 | 1.148 | SREBP_lov |
| 3802 | ACACA | SEQ ID NO. 1570 | 3.186 | 4.424 | 1.389 | SREBP_synth |
| 3803 | ACACA | SEQ ID NO. 1570 | 3.186 | 3.599 | 1.13 | SREBP_U18666A |
| 3804 | CYP51A1 | SEQ ID NO. 1571 | 0.258 | 0.493 | 1.911 | SREBP_lov |
| 3805 | CYP51A1 | SEQ ID NO. 1571 | 0.258 | 0.176 | 0.684 | SREBP_synth |
| 3806 | CYP51A1 | SEQ ID NO. 1571 | 0.258 | 0.356 | 1.38 | SREBP_U18666A |
| 3807 | ACACA | SEQ ID NO. 1572 | 1.733 | 4.278 | 2.469 | SREBP_lov |
| 3808 | ACACA | SEQ ID NO. 1572 | 1.733 | 1.707 | 0.985 | SREBP_synth |
| 3809 | ACACA | SEQ ID NO. 1572 | 1.733 | 3.582 | 2.067 | SREBP_U18666A |
| 3810 | ACSL1 | SEQ ID NO. 1573 | 0.109 | 0.165 | 1.512 | SREBP_lov |
| 3811 | ACSL1 | SEQ ID NO. 1573 | 0.109 | 0.096 | 0.875 | SREBP_synth |
| 3812 | ACSL1 | SEQ ID NO. 1573 | 0.109 | 0.12 | 1.098 | SREBP_U18666A |
| 3813 | ELOVL6 | SEQ ID NO. 1574 | 0.683 | 0.836 | 1.225 | SREBP_lov |
| 3814 | ELOVL6 | SEQ ID NO. 1574 | 0.683 | 0.728 | 1.067 | SREBP_synth |
| 3815 | ELOVL6 | SEQ ID NO. 1574 | 0.683 | 0.908 | 1.331 | SREBP_U18666A |
| 3816 | SCD | SEQ ID NO. 1574 | 0.034 | 0.066 | 1.952 | SREBP_lov |
| 3817 | SCD | SEQ ID NO. 1574 | 0.034 | 0.034 | 0.994 | SREBP_synth |
| 3818 | SCD | SEQ ID NO. 1574 | 0.034 | 0.053 | 1.548 | SREBP_U18666A |
| 3819 | GGPS1 | SEQ ID NO. 1575 | 9.524 | 8.738 | 0.917 | SREBP_lov |
| 3820 | GGPS1 | SEQ ID NO. 1575 | 9.524 | 10.481 | 1.1 | SREBP_synth |
| 3821 | GGPS1 | SEQ ID NO. 1575 | 9.524 | 11.436 | 1.201 | SREBP_U18666A |
| 3822 | PHGDH | SEQ ID NO. 1576 | 0.389 | 0.339 | 0.87 | SREBP_lov |
| 3823 | PHGDH | SEQ ID NO. 1576 | 0.389 | 0.382 | 0.98 | SREBP_synth |
| 3824 | PHGDH | SEQ ID NO. 1576 | 0.389 | 0.389 | 0.999 | SREBP_U18666A |
| 3825 | SC5DL | SEQ ID NO. 1577 | 9.002 | 29.708 | 3.3 | SREBP_lov |
| 3826 | SC5DL | SEQ ID NO. 1577 | 9.002 | 7.443 | 0.827 | SREBP_synth |
| 3827 | SC5DL | SEQ ID NO. 1577 | 9.002 | 25.694 | 2.854 | SREBP_U18666A |
| 3828 | GPAM | SEQ ID NO. 1578 | 31.195 | 25.684 | 0.823 | SREBP_lov |
| 3829 | GPAM | SEQ ID NO. 1578 | 31.195 | 38.092 | 1.221 | SREBP_synth |
| 3830 | GPAM | SEQ ID NO. 1578 | 31.195 | 35.088 | 1.125 | SREBP_U18666A |
| 3831 | C19orf47 | SEQ ID NO. 1578 | 0.061 | 0.075 | 1.222 | SREBP_lov |
| 3832 | C19orf47 | SEQ ID NO. 1578 | 0.061 | 0.071 | 1.166 | SREBP_synth |
| 3833 | C19orf47 | SEQ ID NO. 1578 | 0.061 | 0.078 | 1.269 | SREBP_U18666A |

*FIG. 1CU* -- TABLE 1 TRANSCRIPTIONAL BIOMARKER FUNCTIONAL DATA
SECTION 13A

| LINE_ID | GENE_SYMBOL | SEQUENCE_ID_LISTING | PROM_ACTIVITY_N O_INDUCTION | PROM_ACTIVITY_WI TH_INDUCTION | INDUCTION _RATIO | INDUCTION_CONDITIONS* |
|---|---|---|---|---|---|---|
| 3834 | EEF1B2 | SEQ ID NO. 1579 | 8.232 | 13.143 | 1.596 | SRF |
| 3835 | CPVL | SEQ ID NO. 1580 | 2.617 | 3.279 | 1.253 | SRF |
| 3836 | AKAP9 | SEQ ID NO. 1580 | 1.632 | 1.168 | 0.716 | SRF |
| 3837 | NULL | SEQ ID NO. 1580 | 1.956 | 2.11 | 1.078 | SRF |
| 3838 | NUB1 | SEQ ID NO. 1580 | 102.449 | 79.8 | 0.78 | SRF |
| 3839 | REPIN1 | SEQ ID NO. 1580 | 2.771 | 3.165 | 1.142 | SRF |
| 3840 | GADD45G | SEQ ID NO. 1580 | 1.783 | 2.079 | 1.166 | SRF |

FIG. 1CV — TABLE 1 TRANSCRIPTIONAL BIOMARKER FUNCTIONAL DATA
SECTION 6A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS* |
|---|---|---|---|---|---|---|
| 3841 | LPP | SEQ ID NO. 1581 | 42.698 | 59.848 | 1.402 | STAT_IFNa |
| 3842 | LPP | SEQ ID NO. 1581 | 42.698 | 55.781 | 1.306 | STAT_IFNg |
| 3843 | NULL | SEQ ID NO. 1581 | 1.19 | 0.968 | 0.813 | STAT_IFNa |
| 3844 | NULL | SEQ ID NO. 1581 | 1.19 | 1.07 | 0.899 | STAT_IFNg |
| 3845 | HECW1 | SEQ ID NO. 1582 | 0.239 | 0.486 | 2.035 | STAT_IFNa |
| 3846 | HECW1 | SEQ ID NO. 1582 | 0.239 | 2.562 | 10.734 | STAT_IFNg |
| 3847 | CPA2 | SEQ ID NO. 1583 | 0.488 | 0.568 | 1.165 | STAT_IFNa |
| 3848 | CPA2 | SEQ ID NO. 1583 | 0.488 | 3.271 | 6.705 | STAT_IFNg |
| 3849 | AKAP9 | SEQ ID NO. 1583 | 69.535 | 62.343 | 0.897 | STAT_IFNa |
| 3850 | AKAP9 | SEQ ID NO. 1583 | 69.535 | 43.045 | 0.619 | STAT_IFNg |
| 3851 | RFC2 | SEQ ID NO. 1584 | 22.47 | 25.211 | 1.122 | STAT_IFNa |
| 3852 | RFC2 | SEQ ID NO. 1584 | 22.47 | 29.637 | 1.319 | STAT_IFNg |
| 3853 | NULL | SEQ ID NO. 1584 | 285.842 | 307.122 | 1.074 | STAT_IFNa |
| 3854 | NULL | SEQ ID NO. 1584 | 285.842 | 379.79 | 1.329 | STAT_IFNg |
| 3855 | NULL | SEQ ID NO. 1584 | 47.246 | 48.031 | 1.017 | STAT_IFNa |
| 3856 | NULL | SEQ ID NO. 1584 | 47.246 | 53.016 | 1.122 | STAT_IFNg |
| 3857 | HERPUD2 | SEQ ID NO. 1584 | 26.04 | 28.169 | 1.082 | STAT_IFNa |
| 3858 | HERPUD2 | SEQ ID NO. 1584 | 26.04 | 31.782 | 1.221 | STAT_IFNg |
| 3859 | NULL | SEQ ID NO. 1584 | 5.309 | 4.752 | 0.895 | STAT_IFNa |
| 3860 | NULL | SEQ ID NO. 1584 | 5.309 | 4.653 | 0.876 | STAT_IFNg |
| 3861 | POR | SEQ ID NO. 1584 | 203.913 | 254.43 | 1.248 | STAT_IFNa |
| 3862 | POR | SEQ ID NO. 1584 | 203.913 | 193.497 | 0.949 | STAT_IFNg |
| 3863 | NCAPG2 | SEQ ID NO. 1584 | 393.419 | 363.65 | 0.924 | STAT_IFNa |
| 3864 | NCAPG2 | SEQ ID NO. 1584 | 393.419 | 377.54 | 0.96 | STAT_IFNg |
| 3865 | NUB1 | SEQ ID NO. 1584 | 460.495 | 519.14 | 1.127 | STAT_IFNa |
| 3866 | NUB1 | SEQ ID NO. 1584 | 460.495 | 457.424 | 0.993 | STAT_IFNg |
| 3867 | SLC4A2 | SEQ ID NO. 1584 | 6.117 | 6.847 | 1.119 | STAT_IFNa |
| 3868 | SLC4A2 | SEQ ID NO. 1584 | 6.117 | 5.512 | 0.901 | STAT_IFNg |
| 3869 | NULL | SEQ ID NO. 1584 | 10.756 | 10.988 | 1.022 | STAT_IFNa |
| 3870 | NULL | SEQ ID NO. 1584 | 10.756 | 8.276 | 0.769 | STAT_IFNg |
| 3871 | PSPH | SEQ ID NO. 1584 | 51.492 | 54.541 | 1.059 | STAT_IFNa |
| 3872 | PSPH | SEQ ID NO. 1584 | 51.492 | 49.004 | 0.952 | STAT_IFNg |
| 3873 | REPIN1 | SEQ ID NO. 1584 | 11.709 | 9.696 | 0.828 | STAT_IFNa |
| 3874 | REPIN1 | SEQ ID NO. 1584 | 11.709 | 10.314 | 0.881 | STAT_IFNg |
| 3875 | MICAL2 | SEQ ID NO. 1584 | 13.814 | 11.283 | 0.817 | STAT_IFNa |
| 3876 | MICAL2 | SEQ ID NO. 1584 | 13.814 | 11.791 | 0.853 | STAT_IFNg |
| 3877 | PRKG2 | SEQ ID NO. 1585 | 0.403 | 0.74 | 1.834 | STAT_IFNa |
| 3878 | PRKG2 | SEQ ID NO. 1585 | 0.403 | 0.916 | 2.271 | STAT_IFNg |
| 3879 | ERG | SEQ ID NO. 1586 | 0.272 | 0.27 | 0.994 | STAT_IFNa |
| 3880 | ERG | SEQ ID NO. 1586 | 0.272 | 0.41 | 1.507 | STAT_IFNg |
| 3881 | TIMP3 | SEQ ID NO. 1587 | 0.361 | 1.084 | 3.005 | STAT_IFNa |
| 3882 | TIMP3 | SEQ ID NO. 1587 | 0.361 | 1.093 | 3.03 | STAT_IFNg |
| 3883 | CTNNBL1 | SEQ ID NO. 1588 | 271.107 | 349.239 | 1.288 | STAT_IFNa |
| 3884 | CTNNBL1 | SEQ ID NO. 1588 | 271.107 | 319.525 | 1.179 | STAT_IFNg |
| 3885 | DCLRE1C | SEQ ID NO. 1589 | 27.358 | 42.369 | 1.549 | STAT_IFNa |
| 3886 | DCLRE1C | SEQ ID NO. 1589 | 27.358 | 27.737 | 1.014 | STAT_IFNg |

FIG. 1CW -- TABLE 1 TRANSCRIPTIONAL BIOMARKER FUNCTIONAL DATA
SECTION 6A

| LINE_ID | GENE_SYMBOL | SEQUENCE_ID_LISTING | PROM_ACTIVITY_N O_INDUCTION | PROM_ACTIVITY_WI TH_INDUCTION | INDUCTION RATIO | INDUCTION_CONDITIONS |
|---|---|---|---|---|---|---|
| 3887 | TP53BP1 | SEQ ID NO. 1590 | 11.752 | 13.904 | 1.183 | STAT_IFNa |
| 3888 | TP53BP1 | SEQ ID NO. 1590 | 11.752 | 24.782 | 2.107 | STAT_IFNa |
| 3889 | CASP7 | SEQ ID NO. 1591 | 4.489 | 7.319 | 1.631 | STAT_IFNa |
| 3890 | CASP7 | SEQ ID NO. 1591 | 4.489 | 5.323 | 1.186 | STAT_IFNa |
| 3891 | RAB7L1 | SEQ ID NO. 1591 | 1.522 | 2.71 | 1.78 | STAT_IFNa |
| 3892 | RAB7L1 | SEQ ID NO. 1591 | 1.522 | 2.365 | 1.554 | STAT_IFNa |
| 3893 | PYCARD | SEQ ID NO. 1592 | 0.976 | 2.623 | 2.687 | STAT_IFNa |
| 3894 | PYCARD | SEQ ID NO. 1592 | 0.976 | 1.595 | 1.634 | STAT_IFNa |
| 3895 | PPP1CA | SEQ ID NO. 1593 | 184.624 | 172.575 | 0.935 | STAT_IFNg |
| 3896 | PPP1CA | SEQ ID NO. 1593 | 184.624 | 165.72 | 0.898 | STAT_IFNa |
| 3897 | NOL3 | SEQ ID NO. 1594 | 2.102 | 1.669 | 0.794 | STAT_IFNa |
| 3898 | NOL3 | SEQ ID NO. 1594 | 2.102 | 1.559 | 0.742 | STAT_IFNa |
| 3899 | STAT1 | SEQ ID NO. 1595 | 191.128 | 474.353 | 2.482 | STAT_IFNa |
| 3900 | STAT1 | SEQ ID NO. 1595 | 191.128 | 182.175 | 0.953 | STAT_IFNa |
| 3901 | C1QTNF6 | SEQ ID NO. 1596 | 0.494 | 0.781 | 1.581 | STAT_IFNa |
| 3902 | C1QTNF6 | SEQ ID NO. 1596 | 0.494 | 0.981 | 1.985 | STAT_IFNa |
| 3903 | CCND1 | SEQ ID NO. 1596 | 8.38 | 8.499 | 1.014 | STAT_IFNa |
| 3904 | CCND1 | SEQ ID NO. 1596 | 8.38 | 7.946 | 0.948 | STAT_IFNa |
| 3905 | OSM | SEQ ID NO. 1597 | 1.566 | 1.874 | 1.196 | STAT_IFNa |
| 3906 | OSM | SEQ ID NO. 1597 | 1.566 | 1.937 | 1.237 | STAT_IFNa |
| 3907 | MIS12 | SEQ ID NO. 1598 | 89.558 | 77.8 | 0.866 | STAT_IFNa |
| 3908 | MIS12 | SEQ ID NO. 1598 | 89.558 | 74.879 | 0.836 | STAT_IFNa |
| 3909 | MCL1 | SEQ ID NO. 1599 | 32.124 | 25.69 | 0.8 | STAT_IFNa |
| 3910 | MCL1 | SEQ ID NO. 1599 | 32.124 | 25.087 | 0.781 | STAT_IFNa |
| 3911 | DERL2 | SEQ ID NO. 1600 | 29.781 | 46.522 | 1.561 | STAT_IFNa |
| 3912 | DERL2 | SEQ ID NO. 1600 | 29.781 | 38.818 | 1.303 | STAT_IFNa |
| 3913 | RAB20 | SEQ ID NO. 1601 | 2.643 | 4.377 | 1.656 | STAT_IFNa |
| 3914 | RAB20 | SEQ ID NO. 1601 | 2.643 | 3.643 | 1.379 | STAT_IFNa |
| 3915 | HSPB1 | SEQ ID NO. 1602 | 3.534 | 2.092 | 0.592 | STAT_IFNa |
| 3916 | HSPB1 | SEQ ID NO. 1602 | 3.534 | 1.803 | 0.51 | STAT_IFNa |
| 3917 | BAG1 | SEQ ID NO. 1603 | 102.529 | 193.932 | 1.891 | STAT_IFNa |
| 3918 | BAG1 | SEQ ID NO. 1603 | 102.529 | 122.107 | 1.191 | STAT_IFNa |
| 3919 | MIS12 | SEQ ID NO. 1604 | 114.698 | 142.883 | 1.245 | STAT_IFNa |
| 3920 | MIS12 | SEQ ID NO. 1604 | 114.698 | 143.868 | 1.254 | STAT_IFNa |
| 3921 | UFC1 | SEQ ID NO. 1605 | 21.056 | 21.376 | 1.015 | STAT_IFNa |
| 3922 | UFC1 | SEQ ID NO. 1605 | 21.056 | 16.09 | 0.764 | STAT_IFNa |
| 3923 | IRF1 | SEQ ID NO. 1605 | 0.379 | 1.44 | 3.805 | STAT_IFNa |
| 3924 | IRF1 | SEQ ID NO. 1605 | 0.379 | 12.998 | 34.335 | STAT_IFNa |
| 3925 | C19orf12 | SEQ ID NO. 1606 | 54.242 | 59.458 | 1.096 | STAT_IFNa |
| 3926 | C19orf12 | SEQ ID NO. 1606 | 54.242 | 79.133 | 1.459 | STAT_IFNa |
| 3927 | PARD3B | SEQ ID NO. 1607 | 6.672 | 8.272 | 1.24 | STAT_IFNa |
| 3928 | PARD3B | SEQ ID NO. 1607 | 6.672 | 6.015 | 0.902 | STAT_IFNa |
| 3929 | CDKN1C | SEQ ID NO. 1608 | 73.915 | 86.368 | 1.168 | STAT_IFNa |
| 3930 | CDKN1C | SEQ ID NO. 1608 | 73.915 | 116.247 | 1.573 | STAT_IFNa |
| 3931 | C7orf64 | SEQ ID NO. 1609 | 0.333 | 0.774 | 2.333 | STAT_IFNa |
| 3932 | C7orf64 | SEQ ID NO. 1609 | 0.333 | 1.128 | 3.387 | STAT_IFNa |
| 3933 | C7orf49 | SEQ ID NO. 1610 | 0.233 | 0.388 | 1.662 | STAT_IFNa |
| 3934 | C7orf49 | SEQ ID NO. 1610 | 0.233 | 0.7 | 2.998 | STAT_IFNa |

*FIG. 1CX* -- TABLE 1 TRANSCRIPTIONAL BIOMARKER FUNCTIONAL DATA
SECTION 6A

| LINE_ID | GENE_SYMBOL | SEQUENCE_ID_LISTING | PROM_ACTIVITY_N O_INDUCTION | PROM_ACTIVITY_WI TH_INDUCTION | INDUCTION_RATIO | INDUCTION_CONDITIONS |
|---|---|---|---|---|---|---|
| 3935 | NULL | SEQ ID NO. 1611 | 108.32 | 108.988 | 1.007 | STAT_IFNa |
| 3936 | NULL | SEQ ID NO. 1611 | 108.23 | 116.144 | 1.073 | STAT_IFNg |
| 3937 | NLRP3 | SEQ ID NO. 1612 | 11.138 | 27.112 | 2.434 | STAT_IFNa |
| 3938 | NLRP3 | SEQ ID NO. 1612 | 11.138 | 14.401 | 1.293 | STAT_IFNg |
| 3939 | BIRC5 | SEQ ID NO. 1613 | 27.11 | 26.928 | 0.993 | STAT_IFNa |
| 3940 | BIRC5 | SEQ ID NO. 1613 | 27.11 | 22.908 | 0.845 | STAT_IFNg |
| 3941 | MAP3K11 | SEQ ID NO. 1614 | 1.963 | 2.403 | 1.224 | STAT_IFNa |
| 3942 | MAP3K11 | SEQ ID NO. 1614 | 1.963 | 1.913 | 0.975 | STAT_IFNg |
| 3943 | SGOL2 | SEQ ID NO. 1615 | 92.537 | 97.813 | 1.057 | STAT_IFNa |
| 3944 | SGOL2 | SEQ ID NO. 1615 | 92.537 | 78.898 | 0.853 | STAT_IFNg |
| 3945 | A2M | SEQ ID NO. 1616 | 2.138 | 2.335 | 1.097 | STAT_IFNa |
| 3946 | A2M | SEQ ID NO. 1616 | 2.138 | 18.147 | 8.528 | STAT_IFNg |
| 3947 | CASC4 | SEQ ID NO. 1617 | 11.467 | 13.129 | 1.145 | STAT_IFNa |
| 3948 | CASC4 | SEQ ID NO. 1617 | 11.467 | 8.78 | 0.766 | STAT_IFNg |
| 3949 | FOSB | SEQ ID NO. 1617 | 16.953 | 20.023 | 1.181 | STAT_IFNa |
| 3950 | FOSB | SEQ ID NO. 1617 | 16.953 | 27.679 | 1.633 | STAT_IFNg |
| 3951 | CCL2 | SEQ ID NO. 1617 | 0.864 | 0.997 | 1.154 | STAT_IFNa |
| 3952 | CCL2 | SEQ ID NO. 1617 | 0.864 | 1.054 | 1.22 | STAT_IFNg |
| 3953 | KIF2A | SEQ ID NO. 1617 | 185.168 | 170.879 | 0.923 | STAT_IFNa |
| 3954 | KIF2A | SEQ ID NO. 1617 | 185.168 | 486.4 | 2.627 | STAT_IFNg |
| 3955 | CDKN1A | SEQ ID NO. 1617 | 59.575 | 51.054 | 0.857 | STAT_IFNa |
| 3956 | CDKN1A | SEQ ID NO. 1617 | 59.575 | 55.446 | 0.931 | STAT_IFNg |
| 3957 | PAK3 | SEQ ID NO. 1617 | 5.133 | 5.697 | 1.11 | STAT_IFNa |
| 3958 | PAK3 | SEQ ID NO. 1617 | 5.133 | 5.403 | 1.053 | STAT_IFNg |
| 3959 | IFI16 | SEQ ID NO. 1617 | 3.288 | 3.023 | 0.92 | STAT_IFNa |
| 3960 | IFI16 | SEQ ID NO. 1617 | 3.288 | 3.568 | 1.085 | STAT_IFNg |
| 3961 | MR3C1 | SEQ ID NO. 1617 | 16 | 11.943 | 0.746 | STAT_IFNa |
| 3962 | MR3C1 | SEQ ID NO. 1617 | 16 | 13.622 | 0.851 | STAT_IFNg |
| 3963 | IRF9 | SEQ ID NO. 1617 | 2.862 | 2.679 | 0.936 | STAT_IFNa |
| 3964 | IRF9 | SEQ ID NO. 1617 | 2.862 | 2.839 | 0.992 | STAT_IFNg |
| 3965 | SEPP1 | SEQ ID NO. 1617 | 0.381 | 0.269 | 0.706 | STAT_IFNa |
| 3966 | SEPP1 | SEQ ID NO. 1617 | 0.381 | 0.466 | 1.222 | STAT_IFNg |
| 3967 | CSF1 | SEQ ID NO. 1617 | 2.387 | 25.943 | 10.868 | STAT_IFNa |
| 3968 | CSF1 | SEQ ID NO. 1617 | 2.387 | 96.942 | 40.61 | STAT_IFNg |
| 3969 | TAP1 | SEQ ID NO. 1617 | 71.874 | 114.576 | 1.594 | STAT_IFNa |
| 3970 | TAP1 | SEQ ID NO. 1617 | 71.874 | 142.121 | 1.977 | STAT_IFNg |
| 3971 | PSME9 | SEQ ID NO. 1617 | 1.685 | 27.734 | 16.462 | STAT_IFNa |
| 3972 | PSMB9 | SEQ ID NO. 1617 | 1.685 | 115.419 | 68.511 | STAT_IFNg |
| 3973 | FASN | SEQ ID NO. 1617 | 764.113 | 734.447 | 0.961 | STAT_IFNa |
| 3974 | FASN | SEQ ID NO. 1617 | 764.113 | 772.704 | 1.011 | STAT_IFNg |
| 3975 | MYC | SEQ ID NO. 1618 | 4.439 | 3.229 | 0.727 | STAT_IFNa |
| 3976 | MYC | SEQ ID NO. 1618 | 4.439 | 3.489 | 0.786 | STAT_IFNg |
| 3977 | BCL2L1 | SEQ ID NO. 1619 | 5.597 | 4.771 | 0.852 | STAT_IFNa |
| 3978 | BCL2L1 | SEQ ID NO. 1619 | 5.597 | 7.567 | 1.352 | STAT_IFNg |

TRANSCRIPTION BIOMARKERS OF BIOLOGICAL RESPONSES AND METHODS

A CD containing a formal Sequence Listing is filed with this application and the contents of the CD are expressly incorporated herein in their entirety by reference.

BACKGROUND OF THE INVENTION

Reporter constructs including an expression control sequence operably linked with a reporter sequence are widely used in biology to test for the activity of the expression control sequence under selected conditions. Typically, such constructs are used to test for the expression of the gene normally under transcriptional control of the control sequence. Such constructs have many uses. They can be used, for example, to monitor gene expression during cellular responses to signaling cascades. They also are useful in drug development assays. In drug development, the induction or suppression of expression of a gene by a drug candidate may be a desired or undesired event. In such assays, a cell that contains an expression construct comprising a control sequence for the gene of interest is contacted with a drug candidate and the expression of the reporter is monitored. Compositions that elicit an undesirable result may be eliminated from further testing. Alternatively, compositions that elicit a desired result may be subject to further testing.

In this age of systems biology, investigators may wish to study the activity of many genes in a biological response or pathway, or to identify compositions that modulate the activity of a biological response. Biological responses are characterized by the induction or suppression of many genes. Biological responses of interest include, for example, (1) the hypoxia response, (2) the response to estrogens; (3) the response to androgens; (4) the response mediated by the p53 protein; (5) the response to inhibitors or activators of cholesterol biosynthesis; (6) the interferon-mediated response; (7) the CREB-mediated response; (8) the response to glucocorticoids; (9) the PPAR-mediated response; (10) the RAR-mediated response; (11) the inflammation response induced by TNFa; (12) the heat shock response; and (13) the serum response.

Trinklein et al. have described a library that contains transcription regulatory sequences for thousands of genes in the genome and that are associated with various pathways. See, e.g., U.S. patent publications 2007-0161031 and 2009-0018031.

SUMMARY OF THE INVENTION

In one aspect this invention provides an expression construct comprising a transcriptional regulatory sequence operatively linked with a heterologous sequence encoding a reporter, wherein the transcription regulatory sequence is one of a gene of Table 1. In one aspect this invention provides a collection comprising a plurality of expression constructs, each expression construct comprising a transcriptional regulatory sequence operatively linked with a heterologous sequence encoding a reporter, wherein at least 20% of the expression constructs in the collection each comprise a transcription regulatory sequence of a different gene of Table 1. In certain embodiments, the transcription regulatory sequences include at least a fragment of a sequence selected from SEQ ID NO: 1 to SEQ ID NO. 174. In other embodiments, the transcription regulatory sequences include at least a fragment of a sequence selected from SEQ ID NO: 175 to SEQ ID NO. 1619. In one embodiment at least 20% of the expression constructs comprise transcription regulatory sequences differently selected from the group consisting of (i) any of SEQ ID NO: 1 to SEQ ID NO: 174; (ii) a sequence of at least 50 nucleotides having at least 90% sequence identity to a sequence of (i); and (iii) a fragment of a sequence of (i). In another embodiment the transcription regulatory sequences of the different genes of Table 1 are biomarkers of the same biological response. In another embodiment the transcription regulatory sequences of the different genes of Table 1 comprise biomarkers of different biological responses. For example, the plurality of different biological response could be 2, at least 2, 3, at least 3, no more than 3, 4, at least 4, no more than 4, 5, at least 5, no more than 5, 6, at least 6, no more than 6, 7, at least 7, no more than 7, 8, at least 8, no more than 8, 9, at least 9, no more than 9, 10, at least 10, no more than 10, 11, at least 11, no more than 11, 12, at least 12 no more than 12, or 13 different biological responses selected from (1) the hypoxia response, (2) the response to estrogens; (3) the response to androgens; (4) the response mediated by the p53 protein; (5) the response to inhibitors or activators of cholesterol biosynthesis; (6) the interferon-mediated response; (7) the CREB-mediated response; (8) the response to glucocorticoids; (9) the PPAR-mediated response; (10) the RAR-mediated response; (11) the inflammation response induced by TNFa; (12) the heat shock response; and (13) the serum response In another embodiment the transcription regulatory sequences of the different genes of Table 1 comprise at least three biomarkers of each of a plurality different biological responses. In another embodiment the expression construct is comprised in a plasmid, a virus, or a transposon vector. In another embodiment the expression construct is integrated into a chromosome in a cell or maintained as a stable episomal vector. In another embodiment the reporter is a light-emitting reporter, a fluorescent reporter or a colorimetric reporter. In another embodiment the heterologous sequence encoding the reporter comprises a luciferase gene. In another embodiment the collection comprises at least 10 and no more than 1000 different expression constructs. In another embodiment the collection comprises at least 10 and no more than 100 different expression constructs. In another embodiment the collection comprises at least 10 and no more than 50 different expression constructs. In another embodiment the collection comprises at least 50 and no more than 100 different expression constructs. In another embodiment each expression construct is comprised in a different molecule. In another embodiment each recombinant nucleic acid molecule is comprised in different well of at least one microtiter plate. In another embodiment the transcription regulatory sequences of the collection consist of or consist essentially of transcription regulatory sequences of genes of Table 1, or those comprising all or part of the sequences in the sequence listing, including those in Part I and/or Part II.

In one aspect this invention provides a cell comprising an expression construct comprising a transcriptional regulatory sequence operatively linked with a heterologous sequence encoding a reporter, wherein the transcription regulatory sequence is one of a gene of Table 1. In another aspect this invention provides a collection of a plurality of cells comprising expression constructs, each expression construct comprising a transcriptional regulatory sequence operatively linked with a heterologous sequence encoding a reporter, wherein at least 20% of the expression constructs each comprise a transcription regulatory sequence of a different gene of Table 1. In one embodiment each cell is comprised in different well of at least one microtiter plate. In another embodiment the cells are human cells. In another embodiment the cells are mammalian cells. In another embodiment at least one expression construct is stably integrated into a chromosome wherein the expression construct comprises a transcriptional regulatory sequence operatively linked with a heterologous sequence encoding a reporter, wherein the expression construct comprises a transcription regulatory sequence of a gene of Table 1. In another embodiment the cells comprise a plurality of different expression constructs, each comprising a transcription regulatory sequence of a different gene of Table 1. In another embodiment each different expression construct is comprised in a different cell of the cell line. In another embodiment the transcription regulatory sequences of the collection consist of or consist essentially of transcription regulatory sequences of genes of Table 1, or those comprising all or part of the sequences in the sequence listing, including those in Part I and/or Part II.

In another aspect this invention provides a multicellular organism that contains at least one expression construct comprising a transcriptional regulatory sequence operatively linked with a heterologous sequence encoding a reporter, wherein the expression construct comprises a transcription regulatory sequence of a gene of Table 1. In one embodiment the multicellular organism is selected from a plant, a vertebrate and an invertebrate.

In another aspect this invention provides a device comprising a plurality of receptacles, wherein each receptacle comprises an expression construct comprising a transcriptional regulatory sequence operatively linked with a heterologous sequence encoding a reporter, wherein at least 20% of the expression constructs each comprise a transcription regulatory sequence of a different gene of Table 1. In one embodiment the device comprises at least one microtiter plate.

In another aspect this invention provides a device comprising a plurality of receptacles, wherein each receptacle contains at least one cell comprising an expression construct, each expression construct comprising a transcriptional regulatory sequence operatively linked with a heterologous sequence encoding a reporter, wherein at least 20% of the expression constructs each comprise a transcription regulatory sequence of a different gene of Table 1. In one embodiment the device comprises at least one microtiter plate.

In another aspect this invention provides a method comprising: a) exposing at least one cell to a test condition, wherein the at least one cell comprises at least one expression construct comprising a transcriptional regulatory sequence operatively linked with a heterologous sequence encoding a reporter, wherein the transcription regulatory sequence is a transcription regulatory sequence of a gene of Table 1; b) measuring expression of the reporter; and c) correlating the measurement with a biological response for which the transcription regulatory sequence is a biomarker. In one embodiment the method further comprises i) measuring the activity of the reporter in the absence of the test condition; ii) measuring the activity of the reporter in the presence of the test condition; iii) measuring the difference or ratio of reporter activity between the cells exposed to the test condition and cells that were not; and iv) correlating the difference or ratio between treated and untreated measurements with a biological response. In one embodiment the transcription regulatory sequence comprises a sequence selected from the group consisting of: (i) any of SEQ ID NO:1 to SEQ ID NO: 174; (ii) a sequence of at least 50 nucleotides having at least 95% sequence identity to a sequence of (i); and (iii) a fragment of a sequence of (i). In another embodiment the test condition is selected from the group consisting of contacting the cell with a test compound, exposing the cell to an environmental condition and inducing or repressing expression of one or more genes in the cell. In another embodiment the test condition comprises removing a compound from the culture media in which the cell grown. In another embodiment the test condition comprises contacting the cell with a test compound selected from: (1) a small organic molecule; (2) a nucleic acid derivative (e.g., a small interfering RNA, micro RNA mimic or micro RNA inhibitor); and (3) an expression construct that contains an open reading frame of a gene. In another embodiment the test condition comprises exposing the cell to an environmental condition selected from hyperthermia, hypothermia, hypoxia, osmotic stress, oxidative stress, radiation, or changes in atmospheric conditions. In another embodiment each expression construct is comprised in a different cell. In another embodiment the at least one cell comprises a plurality of the expression constructs, wherein each expression construct comprises a transcription regulatory sequence of a different gene of Table 1, wherein the transcription regulatory sequences of the different genes are biomarkers of the same biological response. In another embodiment the at least one cell comprises a plurality of the expression constructs, wherein each expression construct comprises a transcription regulatory sequence of a different gene of Table 1, wherein the transcription regulatory sequences of the different genes are biomarkers of different biological responses. In another embodiment the at least one cell comprises a plurality of the expression constructs, wherein each expression construct comprises a transcription regulatory sequence of a different gene of Table 1, wherein the transcription regulatory sequences of the different genes comprise at least three different biomarkers of each of a plurality different biological responses. In another embodiment the biological responses are responses selected from (1) the hypoxia response, (2) the response to estrogens; (3) the response to androgens; (4) the response mediated by the p53 protein; (5) the response to inhibitors or activators of cholesterol biosynthesis; (6) the interferon-mediated response; (7) the CREB-mediated response; (8) the response to glucocorticoids; (9) the PPAR-mediated response; (10) the RAR-mediated response; (11) the inflammation response induced by TNFa; (12) the heat shock response; and (13) the serum response. In another embodiment the method comprises contacting the test compound with a plurality of sets of different cell types, wherein each expression construct is comprised in each of the cell types. In another embodiment the method further comprises exposing a control cell to the test condition, wherein the control cell comprises an expression construct comprising a control transcriptional regulatory sequence operatively linked with a heterologous sequence encoding a reporter, wherein the control transcriptional regulatory sequence is a transcriptional regulatory sequence of a gene whose activity is not correlated with a biological response correlated with the activity of transcriptional control sequence of the gene of Table 1. In another embodiment the expression construct is comprised in a plasmid, a virus, or an artificial chromosome vector or a transposon vector. In another embodiment the expression construct is integrated into a chromosome in the cell or maintained as a stable episomal vector. In another embodiment the reporter is a light-emitting reporter, a fluorescent reporter or a colorimetric reporter. In another embodiment the reporter comprises luciferase. In another embodiment the method further comprises exposing the cell to a condition that induces the biological response for which the transcription regulatory sequence is a biomarker. In another embodiment correlating comprises correlating a change in biomarker activity with induction of the biological response. In another embodiment correlating comprises correlating a change in biomarker activity with inhibition of the biological response. In another embodiment the method further comprises inducing the biological response and wherein correlating comprises correlating inhibition of the biomarker with inhibition of the biological response. In another embodiment the method further comprises inhibiting the biological response and wherein correlating comprises correlating inhibition of the biomarker with induction of the biological response.

In another aspect this invention provides a method comprising: a) exposing at least one cell to a test condition, wherein the at least one cell comprises at least one expression construct comprising a transcriptional regulatory sequence operatively linked with a heterologous sequence encoding a reporter, wherein the transcription regulatory sequence is a transcription regulatory sequence of a gene of Table 1; b) measuring expression of the reporter; and if the measurement is at a target level; c) exposing at least one second cell to the test condition, wherein the at least one second cell comprises at least one expression construct comprising a transcriptional regulatory sequence operatively linked with a heterologous sequence encoding a reporter, wherein the transcription regulatory sequence is a transcription regulatory sequence of a different gene of the same biological response of Table 1; and; d) measuring expression of the reporter sequence in the at least one second cell. In one embodiment the method further comprises: e) correlating the measurement with the biological response.

In another aspect this invention provides a method of determining whether a test condition modulates a biological response. In one embodiment the method comprises exposing a cell comprising an expression construct of this invention to the test condition and determining whether test condition modulates the activity of the biomarker promoter, wherein modulation of the activity of the biomarker promoter indicates that that the test condition modulates the biological response for which the biomarker promoter is a biomarker. In another embodiment this method comprises exposing a cell comprising an expression construct of this invention to conditions that induce or repress the biological response for which the biomarker promoter is a biomarker; exposing the cell to the test condition and determining whether the test condition modulates the activity of the biomarker promoter, wherein modulation of the activity indicates that the test condition modulates the activity of the biological response. The activity of the biomarker promoter can be positively or negative correlated with the activity of the biological response. In the case of positive correlation, induction of the biomarker promoter is correlated with induction of the response and/or repression of the biomarker promoter is correlated with repression of the biological response. In the case of negative correlation, repression of activity of the promoter is correlated with induction of the biological response and induction of activity of the promoter is correlated with repression of the biological response.

INCORPORATION BY REFERENCE

All publications and patent applications mentioned in this specification are herein incorporated by reference to the same extent as if each individual publication or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 1 presents Table 1 showing biomarkers for various biological responses. The table is divided into Part I and Part II. Each Part is divided into sections. Each major section (e.g., Section 1, Section 2, etc.) relates to a particular biological response. Part B of Table 1 presents other biomarkers of biological responses, again divided into sub-sections grouped as "Section 1a", "Section 2a", etc. In certain embodiments, biomarkers for a biological response in Part I are preferred to those in Part II, e.g., biomarkers in Part I, Section 1 may be preferred to those in Part II, section 1a.

DETAILED DESCRIPTION OF THE INVENTION

1. Biomarkers

This invention provides nucleic acid molecules comprising transcription regulatory sequences for genes useful as biomarkers of a variety of biological responses or biological pathways. The genes and the biological responses/pathways are identified in Table 1. Certain transcription regulatory sequences of these genes also are identified in Table 1 and provided in the sequence listing. This invention also provides expression constructs comprising biomarker transcription control sequences, devices including them and methods of use. The biomarker transcription expression control sequences are useful, among other things, for identifying test conditions that modulate activity of the biological response or pathway. Modulation includes changing the activity of a pathway, including increasing and decreasing activity.

Biomarkers exhibit different activity or expression under different conditions or states. A biomarker is differentially active or present between states if the mean or median activity or expression level of the biomarker in the different states is calculated to be statistically significant. Common tests for statistical significance include, among others, t-test, ANOVA, Kruskal-Wallis, Wilcoxon, Mann-Whitney and odds ratio. As such, the activity of a biomarker is correlated with a state and the biomarker is useful in classification algorithms to classify an entity as belonging to one or another category. In the present context, activity of a biomarker expression control sequence in a cell indicates whether a biological response or pathway is active in the cell. Cells that contain expression constructs comprising a biomarker expression control sequence operatively linked to a reporter sequence can be subject to a test condition. Activity of the biomarker expression control sequence provides an indication of whether the test condition elicits activity of the biological response or pathway for which the transcription regulatory sequence is a biomarker. For example, a cell comprising an expression construct of this invention can be exposed to a drug candidate to determine whether the drug candidate elicits or inhibits a desired or undesired response, or to an environmental stimulus or condition to determine whether the stimulus or condition elicits or inhibits the response.

2. Biological Responses and Pathways

Biological responses are often characterized by the change in expression of sets of genes. A set of genes whose expression is activated (or turned off) as part of the biological response is referred to as a "pathway." One goal is to identify compounds that modulate or mimic a biological response, or activate or inhibit activity of genes in a pathway. A number of genes have been identified that have promoters whose activity is highly correlated with particular biological responses. Therefore, promoters of these genes function as biomarkers of the biological response. The genes are identified in Table 1, along with specific transcriptional regulatory sequences that were determined to function as biomarkers of the response. In general, a transcriptional regulatory sequence functions as a biomarker if the induction ratio Biomarkers have been identified for the following biological responses: (1) the hypoxia response, (2) the response to estrogens; (3) the response to androgens; (4) the response mediated by the p53 protein; (5) the response to inhibitors or(the ratio between activity with induction of the response and the activity without induction of the response) is at least 2, at least 4, at least 10, at least 25 or at least 50.

Biomarkers have been identified for the following biological response: (1) the hypoxia response, (2) the response to estrogens; (3) the response to androgens; (4) the response mediated by the p53 protein; (5) the response to inhibitors or activators of cholesterol biosynthesis; (6) the interferon-mediated response; (7) the CREB-mediated response; (8) the response to glucocorticoids; (9) the PPAR-mediated response; (10) the RAR-mediated response; (11) the inflammation response induced by TNFa; (12) the heat shock response; and (13) the serum response.

This invention provides collections of these biomarker promoters, expression constructs in which they are operably linked with sequences encoding reporters, cells that contain these expression constructs, devices that contain the expression constructs and methods of using expression constructs, in particular to determine whether any test condition can modulate the activity of particular biological responses, based on its ability to regulate the activity of the biomarker expression control sequences.

A biological response biomarker is positively correlated with the biological response if its activity is induced or activated when a biological response is active, or if its activity is repressed when the biological response is repressed. A biological response biomarker is negatively correlated with the biological response if its activity is repressed when a biological response is active, or if its activity is induced or activated when the biological response is repressed.

Identifying test conditions that induce or repress the activity of biomarker promoters is useful to evaluate test conditions, such as test compositions, for the ability to induce or inhibit the biological response with which the biomarker activity is correlated. A test condition that induces activity of a biological response biomarker promoter positively correlated with the response is presumed to induce the biological response in full or in part, e.g., to cause a response that mimics the biological response, and its action is correlated positively with the biological response. A test condition that inhibits activity of a biological response biomarker promoter positively correlated with the response when cells are exposed to conditions that induce the biological response is presumed to inhibit the biological response, e.g., to inhibit events correlated with the biological response, and its action is correlated negatively with the biological response.

Alternatively, a test condition that inhibits activity of a biological response biomarker promoter negatively correlated with the response is presumed to induce the biological response in full or in part, e.g., to cause a response that mimics the biological response, and its action is correlated positively with the biological response. A test condition that induces activity of a biological response biomarker promoter negatively correlated with the response when cells are exposed to conditions that induce the biological response is presumed to inhibit the biological response, e.g., to inhibit events correlated with the biological response, and its action is correlated negatively with the biological response.

A method for identifying a test condition that elicits a biological response can comprise providing a cell comprising an expression construct comprising a biological response biomarker promoter operably linked to a reporter gene and exposing the cell to a test condition. The activity of a biological response biomarker promoter in response to the test condition can be measured. The measurement can be correlated with the biological response. Conditions resulting in activity of a desired correlation (e.g., induction of activity of a positively correlated biomarker, or inhibition of the activity a negatively correlated biomarker) can be identified as conditions that elicit the biological response.

A method for identifying a test condition that inhibits a biological response can comprise providing a cell comprising an expression construct comprising a biological response biomarker promoter operably linked to a reporter gene, exposing the cell to a condition that elicits a biological response (or to a condition that induces expression of a biological response biomarker promoter) and exposing the cell to a test condition. The activity of a biological response biomarker promoter in response to the test condition can be measured. The measurement can be correlated with the biological response. Conditions resulting in activity of a desired correlation (e.g., inhibition of the inducible activity of a positively correlated biomarker, or induction of activity of a negatively correlated biomarker) can be identified as conditions that inhibit the biological response.

In each situation, the test condition can be tested further. For example, the ability of the test condition to modulate activity of at least one or a plurality of different biomarkers for the biological response can be tested. The activity of these promoters can be correlated with the biological response. The test condition also can be tested for the ability to modulate a different biological response than the one originally tested.

2.1 Biological Response to Hypoxia

Several promoters have been identified, the activity of each of which is positively correlated with the biological response to hypoxia ("hypoxia response biomarker promoter"). These hypoxia response biomarker promoters are identified in Table 1, section 1 and section 1a. Hypoxia response biomarker promoters generally have inducible activities ranging from 2 to 10-fold typically in this assay. The conditions used to induce the biological response to hypoxia included exposing cells to a 1% oxygen environment and 100 micromolar deferoxamine (DFO) for 24 hrs. The experimental conditions are set forth more completely in Example 1.

More specifically, transcription regulatory sequences have been found that are induced when exposed to low oxygen conditions. Low oxygen conditions induce the hypoxia response. One can use such a promoter in an assay to determine whether a test compound induces the hypoxia response. This is done, for example, by exposing a cell containing an expression construct comprising the transcription regulatory sequence operatively linked with a reporter sequence to a test compound. If the compound induces activity of the promoter, this means the compound induces the hypoxia response. Also, one can use the promoter in an assay to determine whether a test compound inhibits the hypoxia response. This is done, for example, by exposing a cell containing the expression construct to a condition that induces the hypoxia response (for example, exposing the cell to low oxygen conditions) and exposing the cell to the test compound. If the compound inhibits the inducible activity of the promoter, this means the compound inhibits the hypoxia response.

The biological response to hypoxia (or, "hypoxia response") involves a number of events at the phenotypic, cellular and molecular level. These events include increasing the expression of genes involved in cellular respiration and promotion of vascularization and oxygen uptake. The activity of hypoxia response biomarker promoters is, in turn, also correlated with these events.

In certain situations it may be useful to induce a hypoxia response. For example, hypoxia occurs under ischemic conditions, e.g., heart disease, transient ischemic attack, cerebrovascular accident, ruptured arteriovenous malformation and peripheral artery occlusive disease. Under such conditions, cells and tissue can be damaged. For example, a subject can experience cell death in the ischemic area. Pharmaceutical drugs that induce hypoxia may provide protection in situations of ischemia-induced hypoxia.

In certain situations it may be useful to inhibit a hypoxia response. For example, tumor growth results in hypoxic conditions. Under such conditions, it may be beneficial to block the hypoxia response in order to slow or stop tumor growth. Pharmaceutical drugs that inhibit or prevent the results of tumor-induced hypoxia are useful in treating such conditions.

Conditions can be tested for their ability to induce or inhibit the hypoxia response, as discussed above. Hypoxia conditions to which cells can be exposed for these tests include, for example, exposure of cells to an environment in which oxygen is present at no more than about 10%, no more than about 5%, no more than about 3%, no more than about 2%, no more than about 1% or below about 1%. Furthermore, small molecule inhibitors of the cells ability to make or use ATP also elicit the hypoxia response, e.g., or treating with deferoxamine (DFO) for 24 hrs. DFO is a known inhibitor of mitochondria and inducer of hypoxia. Also, cells can be exposed to any condition that induces expression of a hypoxia response biomarker promoter.

2.2 Biological Response to Estrogen (e.g., β-estradiol)

Several promoters have been identified, the activity of each of which is positively correlated with the biological response to estrogen ("estrogen response biomarker promoter"). These estrogen response biomarker promoters are identified in Table 1, section 2 and section 2a. The condition used to induce the biological response to estrogen was exposing cells to a 10 nanomolar environment β-estradiol for 24 hrs. The experimental conditions are set forth more completely in Example 2.

More specifically, transcription regulatory sequences have been found that are induced when exposed to estrogens. β-estradiol induces the estrogen receptor protein that regulates the estrogen response. One can use such a promoter in an assay to determine whether a test compound induces the estrogen response. This is done, for example, by exposing a cell containing an expression construct comprising the transcription regulatory sequence operatively linked with a reporter sequence to a test compound. If the compound induces activity of the promoter, this means the compound induces the estrogen response. Also, one can use the promoter in an assay to determine whether a test compound inhibits the estrogen response. This is done, for example, by exposing a cell containing the expression construct to a condition that induces the estrogen response and exposing the cell to the test compound. If the compound inhibits the inducible activity of the promoter, this means the compound inhibits the estrogen response.

The biological response to estrogen (or, "estrogen response") involves a number of events at the cellular and molecular level. These events include cell proliferation and lipid metabolism. The activity of estrogen response biomarker promoters is, in turn, also correlated with these events.

In certain situations it is useful to elicit an estrogen response. For example, estrogens are administered as drugs in a variety of situations. In a form of hormone replacement therapy, estrogen is administered to peri-menopausal and post-menopausal women to counter the effects of diminished estrogen levels, such as osteoporosis. The estrogen response biomarker promoters of this invention are useful in discovering and evaluating pharmaceutical drugs and other conditions for the ability to elicit an estrogen response.

Also, in certain situations it is desirable to inhibit an estrogen response. For example, certain cancers, e.g., certain breast cancers, are hormone receptor positive. That is, cancer cells grow faster in the presence of estrogen. Drugs that lower the amount of estrogen, or that inhibit the activity of estrogen, such as tamoxifen, are used to treat such cancers. The estrogen response biomarker promoters of this invention are useful in discovering and evaluating pharmaceutical drugs and other conditions for the ability to inhibit an estrogen response.

Furthermore, it is known than many environmental toxins and other small molecules can act as estrogen mimics. Therefore, an estrogen response biomarker promoter can serve as a useful tool for establishing which toxins or other small molecules can serve as estrogen mimics by, for example, exposing a recombinant cell of this invention to the compound and determining whether it induces activity of an estrogen biomarker promoter.

Conditions can be tested for their ability to induce or inhibit the estrogen response, as discussed above. Estrogen conditions to which cells can be exposed for these tests include, for example, exposure of cells to an environment comprising an estrogen at a concentration of least 100 picomolar, at least 1 nM or at least 10 nM or at least 1 uM. Any estrogen can be used to induce this response. Also, cells can be exposed to any condition that induces expression of an estrogen response biomarker promoter.

2.3 Biological Response to Androgen (e.g., Methyltrienolone)

Several promoters have been identified, the activity of each of which is positively correlated with the biological response to androgen ("androgen response biomarker promoter"). These androgen response biomarker promoters are identified in Table 1, section 3 and section 3a. The condition used to induce the biological response to androgen was exposing cells to a 10 nanomolar environment of methyltrienolone (R1881) for 24 hrs. The experimental conditions are set forth more completely in Example 3.

More specifically, transcription regulatory sequences have been found that are induced when exposed to androgens. Methyltrienolone induces the androgen receptor protein that regulates the androgen response. One can use such a promoter in an assay to determine whether a test compound induces the androgen response. This is done, for example, by exposing a cell containing an expression construct comprising the transcription regulatory sequence operatively linked with a reporter sequence to a test compound. If the compound induces activity of the promoter, this means the compound induces the androgen response. Also, one can use the promoter in an assay to determine whether a test compound inhibits the androgen response. This is done, for example, by exposing a cell containing the expression construct to a condition that induces the androgen response and exposing the cell to the test compound. If the compound inhibits the inducible activity of the promoter, this means the compound inhibits the androgen response.

The biological response to androgen (or, "androgen response") involves a number of events at the cellular and molecular level. These events include regulating gene expression patterns that result in the formation of male secondary sex characteristics in vertebrates. The activity of androgen response biomarker promoters is, in turn, also correlated with these events.

In certain situations it is useful to elicit an androgen response. For example, in a form of hormone replacement therapy, androgen is administered to older men to counter the effects of diminished androgen levels. The androgen response biomarker promoters of this invention are useful in discovering and evaluating pharmaceutical drugs and other conditions for the ability to elicit an androgen response.

Also, in certain situations it is desirable to inhibit an androgen response. For example, androgen ablation can be used as an effective therapy in prostate cancer. The androgen response biomarker promoters of this invention are useful in discovering and evaluating pharmaceutical drugs and other conditions for the ability to inhibit an androgen response.

Furthermore, it is known than many environmental toxins and other small molecules can act as androgen mimics. Therefore, an androgen response biomarker promoter can serve as a useful tool for establishing which toxins or other small molecules can serve as androgen mimics.

Androgen conditions to which cells can be exposed for these tests include, for example, exposure of cells to an environment comprising an androgen at a concentration of least 100 picomolar, at least 1 nM or at least 10 nM. Androgens include natural and artificial androgens, such as testosterones, methyltrienolone, and others. Also, cells can be exposed to any condition that induces expression of an androgen response biomarker promoter.

2.4 Biological Response to p53 Activation

Several promoters have been identified, the activity of each of which is positively correlated with the biological response to the activation of the p53 tumor suppressor protein ("p53 response biomarker promoter"). These p53 biomarker promoters are identified in Table 1, section 4 and section 4a. The conditions used to induce the biological response to p53 was exposing cells to a 10 micromolar environment of nutlin for 24 hrs or treatment with doxorubicin at 200 ng/mL final concentration. The experimental conditions are set forth more completely in Example 4.

More specifically, transcription regulatory sequences have been found that are induced when exposed to activators of p53. Nutlin induces the p53 protein by inhibiting the MDM2 protein that is responsible for the degradation of the p53 protein. Doxorubicin is an antibiotic that interacts with DNA by intercalation. This in turn activates p53. One can use such a promoter in an assay to determine whether a test compound induces the p53 response. This is done, for example, by exposing a cell containing an expression construct comprising the transcription regulatory sequence operatively linked with a reporter sequence to a test compound. If the compound induces activity of the promoter, this means the compound induces the p53 response. Also, one can use the promoter in an assay to determine whether a test compound inhibits the p53 response. This is done, for example, by exposing a cell containing the expression construct to a condition that induces the p53 response and exposing the cell to the test compound. If the compound inhibits the inducible activity of the promoter, this means the compound inhibits the p53 response.

p53 is a master tumor suppressor gene that controls a number of critical events at the cellular and molecular level. The p53 protein is a transcription factor that directly binds to DNA and regulates the expression of genes involved in the cell cycle, the DNA repair pathway, and can initiate apoptosis if DNA damage is irreparable. The activity of p53-responsive biomarker promoters, in turn, also correlate with these events.

p53 is critical to proper functioning of cells. A large number of cancers develop from cells that have inactivated the p53 protein. The p53 response biomarker promoters of this invention are useful in discovering and evaluating pharmaceutical drugs and other conditions for the ability to activate the p53 response. Test conditions that stimulate the p53 response may be useful in treating cancer.

Conditions can be tested for their ability to induce or inhibit the p53 response, as discussed above. Conditions to which cells can be exposed for these tests include, for example, exposure of cells to an environment that induces DNA damage, apoptosis, or other disruptions to the cell cycle. Also, cells can be exposed to any condition that induces expression of an p53 response biomarker promoter.

2.5 Biological Response to Cholesterol and other Molecules that Modulate the Cholesterol Biosynthesis Pathway Several promoters have been identified, the activity of which are positively or negatively correlated with the biological response to the activity of the cholesterol biosynthesis pathway ("cholesterol biomarker promoter"). These cholesterol response biomarker promoters are identified in Table 1, section 5 and section 5a. The conditions used to induce the cholesterol response were exposing cells to a 1 micromolar environment of lovastatin for 24 hrs (negatively correlated with activation of the pathway or positively correlated with inhibition of the pathway), U18666A at 1 micromolar for 24 hrs (negatively correlated with activation of the pathway or positively correlated with inhibition of the pathway), or synthecol at 5 ug/mL for 24 hrs (positively correlated with activation of the pathway). The experimental conditions are set forth more completely in Example 5.

More specifically, transcription regulatory sequences have been found that are induced or repressed when the cholesterol biosynthesis is either inhibited or induced. Lovastatin is a known inhibitor of the HMG-coA reductase protein that is a critical enzyme in the synthesis of cholesterol. U18666A is a known inhibitor of intracellular cholesterol transport. Synthecol is a synthetic form of cholesterol. One can use such a promoter in an assay to determine whether a test compound affects the cholesterol response. This is done, for example, by exposing a cell containing an expression construct comprising the transcription regulatory sequence operatively linked with a reporter sequence to a test compound. If the compound induces activity of biomarker promoters positively correlated with inhibition of cholesterol biosynthesis (negatively correlated with cholesterol biosynthesis), this means the compound inhibits activity of the cholesterol biosynthesis pathway. If the compound induces activity of biomarker promoters positively correlated with cholesterol biosynthesis this means it induces activity of the cholesterol biosynthesis pathway. Similarly, one can induce or repress the cholesterol synthesis response and determine whether a test condition has the opposite effect, e.g., repressing activity of a biomarker positively correlated with the response or inducing activity of a biomarker negatively correlated with the response.

The cholesterol biosynthesis pathway includes a number of events at the cellular and molecular level. These events include the sensing of intracellular cholesterol in the endoplasmic reticulum by the SREBP protein. SREBP is a transcription factor that directly binds DNA and regulates the transcription of the HMG-CoA reductase and LDL receptor genes. The activity of cholesterol biomarker promoters is, in turn, also correlated with these events.

In certain situations it is useful to inhibit cholesterol biosynthesis as high levels of cholesterol are strongly associated with cardiovascular disease. For example, statins are some of the most widely prescribed drugs that inhibit the activity of HMG-CoA reductase, a key enzyme in the cholesterol biosynthesis pathway. The cholesterol biomarker promoters of this invention are useful in discovering and evaluating pharmaceutical drugs and other conditions for the ability to inhibit cholesterol biosynthesis.

Also, in certain situations it may be desirable to activate the cholesterol biosynthesis pathway. There are rare cases of individuals that suffer from hypocholesterolemia, or abnormally low levels of cholesterol. The cholesterol biomarker promoters of this invention are useful in discovering and evaluating pharmaceutical drugs and other conditions for the ability to activate cholesterol biosynthesis.

Conditions can be tested for their ability to induce or inhibit the cholesterol biosynthesis pathway, as discussed above. Conditions to which cells can be exposed for these tests include, for example, exposure of cells to any condition that inhibits the production of cholesterol or the uptake of cholesterol. Statins are examples of cholesterol synthesis inhibitors. Also, cells can be exposed to any condition that induces expression of a cholesterol response biomarker promoter.

2.6 Biological Response to Interferons

Several promoters have been identified, the activity of each of which is positively correlated with the biological response to interferons ("interferon biomarker promoter"). These interferon response biomarker promoters are identified in Table 1, section 6 and section 6a. The conditions used to induce the interferon response were exposing cells to 500 units/mL of interferon alpha for 8 hrs, or interferon gamma at 100 ng/mL for 8 hrs. The experimental conditions are set forth more completely in Example 6. Certain of these biomarkers are correlated with the alpha and/or gamma interferon responses.

More specifically, transcription regulatory sequences have been found that are induced when exposed to interferons, e.g., interferon alpha or interferon gamma. Interferon alpha and gamma induce an interferon-mediated response. One can use such a promoter in an assay to determine whether a test compound induces the interferon-mediated response. This is done, for example, by exposing a cell containing an expression construct comprising the transcription regulatory sequence operatively linked with a reporter sequence to a test compound. If the compound induces activity of the promoter, this means the compound induces the interferon-mediated response. Also, one can use the promoter in an assay to determine whether a test compound inhibits the interferon-mediated response. This is done, for example, by exposing a cell containing the expression construct to a condition that induces the interferon-mediated response (for example, exposing the cell to interferon alpha) and exposing the cell to the test compound. If the compound inhibits the inducible activity of the promoter, this means the compound inhibits the interferon-mediated response.

The biological response to interferons includes a number of events at the cellular and molecular level. Interferons are produced by a wide variety of cells and are key signaling molecules in the inflammation response and in response to the presence of double-stranded RNA viruses. Interferons assist the immune response by inhibiting viral replication within host cells, activating natural killer cells and macrophages, increasing antigen presentation to lymphocytes, and inducing the resistance of host cells to viral infection. The STAT family of transcription factors directly bind DNA and regulate the transcription of target genes in response to interferon signaling. The activity of interferon biomarker promoters is, in turn, also correlated with these events.

In certain situations it is useful to inhibit interferon activity. For example, inhibiting interferon activity may help in cases of acute or chronic inflammation. The interferon biomarker promoters of this invention are useful in discovering and evaluating pharmaceutical drugs and other conditions for the ability to inhibit interferon activity.

Also, in certain situations it may be desirable to activate interferon activity. For example, interferons have antiviral and antioncogenic properties and are used to treat viral infection and cancer. The interferon biomarker promoters of this invention are useful in discovering and evaluating pharmaceutical drugs and other conditions for the ability to activate interferon activity.

Conditions can be tested for their ability to induce or inhibit interferon activity, as discussed above. Conditions to which cells can be exposed for these tests include, for example, exposure of cells to interferon alpha or interferon gamma, or any condition that inhibits or activates the production of interferon proteins, such as a viral infection. Also, cells can be exposed to any condition that induces expression of an interferon biomarker promoter.

2.7. CREB-mediated Response and Cyclic AMP Signaling

Several promoters have been identified, the activity of each of which is positively correlated with the biological response to cAMP or CREB signaling ("CREB biomarker promoter"). These CREB response biomarker promoters are identified in Table 1, section 7 and section 7a. The conditions used to induce the cholesterol response were exposing cells to 20 micromolar of forskolin for 4 hrs, or phorbol 12-myristate 13-acetate (PMA) at 100 nanomolar for 4 hrs. The experimental conditions are set forth more completely in Example 7.

More specifically, transcription regulatory sequences have been found that are induced when exposed to conditions that activate the CREB signaling cascade. Forskolin is a known activator of protein kinase A that raises cellular cyclic AMP (cAMP) levels. The CREB protein is a transcription factor that is activated by protein kinase A and directly binds DNA to activate target genes. PMA is a known activator of protein kinase C that also activates the CREB signaling cascade. One can use such a promoter in an assay to determine whether a test compound induces a CREB-mediated response. This is done, for example, by exposing a cell containing an expression construct comprising the transcription regulatory sequence operatively linked with a reporter sequence to a test compound. If the compound induces activity of the promoter, this means the compound induces a CREB-mediated response. Also, one can use the promoter in an assay to determine whether a test compound inhibits a CREB-mediated response. This is done, for example, by exposing a cell containing the expression construct to a condition that induces a CREB-mediated response (for example, exposing the cell to forskolin) and exposing the cell to the test compound. If the compound inhibits the inducible activity of the promoter, this means the compound inhibits the CREB-mediated response.

The biological response to CREB-mediated cyclic AMP signaling includes a number of events at the cellular and molecular level. cAMP is a secondary messenger used for intracellular signaling that ultimately activates the CREB transcription factor. CREB-mediated cyclic AMP signaling is involved in many biological functions including regulating the effects of glucagons and adrenaline. The activity of CREB biomarker promoters is, in turn, also correlated with these events.

In certain situations it may be useful to inhibit certain aspects of CREB activity. For example, inhibiting CREB activity may help in cases of metabolic disorders or signaling through certain G-protein coupled receptor (GPCR) pathways. The CREB biomarker promoters of this invention are useful in discovering and evaluating pharmaceutical drugs and other conditions for the ability to inhibit CREB activity.

Also, in certain situations it may be desirable to activate CREB activity. For example, activating CREB activity may help in cases of metabolic disorders or signaling through certain GPCR pathways. The CREB biomarker promoters of this invention are useful in discovering and evaluating pharmaceutical drugs and other conditions for the ability to activate CREB activity.

Conditions can be tested for their ability to induce or inhibit CREB activity, as discussed above. Conditions to which cells can be exposed for these tests include, for example, exposure of cells to any conditions that change cAMP levels within the cell, the stimulation of any GPCR protein, or other ways of activating the CREB protein e.g., exposing cells to biogenic amines, chemokines, or peptide hormones. Also, cells can be exposed to any condition that induces expression of a CREB biomarker promoter.

2.8 Glucocorticoid Response

Several promoters have been identified, the activity of each of which is positively correlated with the biological response to glucocorticoid receptor (GR) signaling ("GR biomarker promoter"). These GR response biomarker promoters are identified in Table 1, section 8 and section 8a. The conditions used to induce the GR response were exposing cells to 100 nanomolar dexamethasone, 1 micromolar prednisone, and 1 micromolar cortisone, each for 4 hrs. The experimental conditions are set forth more completely in Example 8.

More specifically, transcription regulatory sequences have been found that are induced when exposed to conditions that induce the GR-mediated response. Dexamethasone, prednisone, and cortisone are known ligands and activators of the GR protein. GR is a ligand-mediated transcription factor that binds directly to the DNA of target genes in the genome when it is bound to an activating ligand. Dexamethasone and prednisone are also potent anti-inflammatory therapeutic compounds. Activating GR with synthetic ligands is known to inhibit the inflammatory response, and is therefore, GR is an important drug target. One can use such a promoter in an assay to determine whether a test compound induces a GR-mediated response. This is done, for example, by exposing a cell containing an expression construct comprising the transcription regulatory sequence operatively linked with a reporter sequence to a test compound. If the compound induces activity of the promoter, this means the compound induces a GR-mediated response. Also, one can use the promoter in an assay to determine whether a test compound inhibits a GR-mediated response. This is done, for example, by exposing a cell containing the expression construct to a condition that induces a GR-mediated response (for example, exposing the cell to dexamethasone) and exposing the cell to the test compound. If the compound inhibits the inducible activity of the promoter, this means the compound inhibits the GR-mediated response.

The biological response to ligands for GR (or, "GR response") involves a number of events at the cellular and molecular level. These events include GR-mediated expression of genes controlling development, metabolism, and the immune response. The activity of GR response biomarker promoters is, in turn, also correlated with these events.

In certain situations it is useful to activate a GR response. Activating GR activity is known to have potent anti-inflammatory effects. The GR response biomarker promoters of this invention are useful in discovering and evaluating pharmaceutical drugs and other conditions for the ability to elicit a GR response.

Also, in certain situations it is desirable to inhibit a GR response. For example, inhibiting GR may help in cases of metabolic disorders. The GR response biomarker promoters of this invention are useful in discovering and evaluating pharmaceutical drugs and other conditions for the ability to inhibit a GR response.

Furthermore, it is known than many environmental toxins and other small molecules can act as synthetic mimics of GR ligands. Therefore, an GR response biomarker promoter can serve as a useful tool for establishing which toxins or other small molecules can serve as GR ligand mimics by, for example, exposing a recombinant cell of this invention to the compound and determining whether it induces activity of an GR biomarker promoter.

Conditions can be tested for their ability to induce or inhibit the GR response, as discussed above. GR activating conditions to which cells can be exposed for these tests include, for example, any compound or condition that simulates GR binding to its natural ligands.

2.9. PPAR-mediated Response

Several promoters have been identified, the activity of each of which is positively correlated with the biological response to peroxisome proliferator-activated receptor (PPAR) signaling ("PPAR biomarker promoter"). These PPAR response biomarker promoters are identified in Table 1, section 9 and section 9a. The conditions used to induce the PPAR response were exposing cells to PPAR alpha and 75 micromolar of WY14643, PPAR gamma and 10 micromolar of ciglitazone, or PPAR delta and 100 nanomolar of GW501516 for 24 hrs. The experimental conditions are set forth more completely in Example 9.

More specifically, transcription regulatory sequences have been found that are induced when the PPAR-mediated response is activated. WY14643, ciglitazone and GW501516 are known ligands and activators of the PPAR alpha, gamma, and delta proteins, respectively. The PPAR family of transcription factors is a family of ligand-mediated transcription factors that binds directly to the DNA of target genes in the genome when it is bound to an activating ligand. One can use such a promoter in an assay to determine whether a test compound induces a PPAR-mediated response. This is done, for example, by exposing a cell containing an expression construct comprising the transcription regulatory sequence operatively linked with a reporter sequence to a test compound. If the compound induces activity of the promoter, this means the compound induces a PPAR-mediated response. Also, one can use the promoter in an assay to determine whether a test compound inhibits a PPAR-mediated response. This is done, for example, by exposing a cell containing the expression construct to a condition that induces a PPAR-mediated response (for example, exposing the cell to ciglitazone) and exposing the cell to the test compound. If the compound inhibits the inducible activity of the promoter, this means the compound inhibits the PPAR-mediated response.

The biological response to ligands binding to and activating PPAR (or "PPAR response") involves a number of events at the cellular and molecular level. These events include PPAR-mediated expression of genes that play essential roles in the regulation of cellular differentiation, development, lipid metabolism, and tumorigenesis in higher organisms. The activity of PPAR response biomarker promoters is, in turn, also correlated with these events.

In certain situations it is useful to activate a PPAR response. Activating PPAR activity is known to have anti-diabetic effects. The PPAR response biomarker promoters of this invention are useful in discovering and evaluating pharmaceutical drugs and other conditions for the ability to elicit a PPAR response.

Also, in certain situations it is desirable to inhibit a PPAR response. For example, inhibiting PPAR may help in cases of metabolic disorders. The PPAR response biomarker promoters of this invention are useful in discovering and evaluating pharmaceutical drugs and other conditions for the ability to inhibit a PPAR response.

Furthermore, it is known than many environmental toxins and other small molecules can act as synthetic mimics of PPAR ligands. Therefore, a PPAR response biomarker promoter can serve as a useful tool for establishing which toxins or other small molecules can serve as PPAR ligand mimics by, for example, exposing a recombinant cell of this invention to the compound and determining whether it induces activity of an PPAR biomarker promoter.

Conditions can be tested for their ability to induce or inhibit the PPAR response, as discussed above. PPAR activating conditions to which cells can be exposed for these tests include, for example, any compound or condition that simulates PPAR binding to its ligand binding domain.

2.10 RAR-mediated Response

Several promoters have been identified, the activity of each of which is positively correlated with the biological response to retinoic acid receptor (RAR) signaling ("RAR biomarker promoter"). These RAR response biomarker promoters are identified in Table 1, section 10 and section 10a. The conditions used to induce the RAR response was exposing cells to the RAR beta protein and 100 nanomolar of adapalene for 24 hrs. The experimental conditions are set forth more completely in Example 10.

More specifically, transcription regulatory sequences have been found that are induced when upon activation of the RAR-mediated response. Adapalene is a known ligand and activator of the RAR beta protein. RAR is a ligand-mediated transcription factor that binds directly to the DNA of target genes in the genome when it is bound to an activating ligand. One can use such a promoter in an assay to determine whether a test compound induces a RAR-mediated response. This is done, for example, by exposing a cell containing an expression construct comprising the transcription regulatory sequence operatively linked with a reporter sequence to a test compound. If the compound induces activity of the promoter, this means the compound induces a RAR-mediated response. Also, one can use the promoter in an assay to determine whether a test compound inhibits a RAR-mediated response. This is done, for example, by exposing a cell containing the expression construct to a condition that induces a RAR-mediated response (for example, exposing the cell to adapalene) and exposing the cell to the test compound. If the compound inhibits the inducible activity of the promoter, this means the compound inhibits the RAR-mediated response.

The biological response to ligands binding to and activatin RAR (or, "RAR response") involves a number of events at the cellular and molecular level. These events include RAR-mediated expression of genes that play essential roles in the regulation of cellular differentiation and development. The activity of RAR response biomarker promoters is, in turn, also correlated with these events.

In certain situations it is useful to activate a RAR response. Activating RAR activity through various retinoids is known to play roles in vision, cell proliferation, bone growth, and immune function. The RAR response biomarker promoters of this invention are useful in discovering and evaluating pharmaceutical drugs and other conditions for the ability to elicit a RAR response.

Also, in certain situations it is desirable to inhibit a RAR response. For example, inhibiting RAR may help in cases of carcinogenesis or tumor growth. The RAR response biomarker promoters of this invention are useful in discovering and evaluating pharmaceutical drugs and other conditions for the ability to inhibit a RAR response.

Furthermore, it is known than many environmental toxins and other small molecules can act as synthetic mimics of retinoids or other RAR ligands. Therefore, a RAR response biomarker promoter can serve as a useful tool for establishing which toxins or other small molecules can serve as RAR ligand mimics by, for example, exposing a recombinant cell of this invention to the compound and determining whether it induces activity of an RAR biomarker promoter.

Conditions can be tested for their ability to induce or inhibit the RAR response, as discussed above. RAR activating conditions to which cells can be exposed for these tests include, for example, any compound or condition that simulates RAR binding to its ligand binding domain.

2.11. Biological Response to TNFa and NFkB Activation

Several promoters have been identified, the activity of each of which is positively correlated with the biological response to tumor necrosis factor, alpha (TNFa) that is mediated by nuclear factor kappa-light-chain-enhancer of activated B cells (NFkB) ("NFkB biomarker promoter"). These NFkB biomarker promoters are identified in Table 1, section 11 and section 11a. The conditions used to induce the NFkB response was exposing cells to 20 ng/mL of TNFa for 8 hrs. The experimental conditions are set forth more completely in Example 11.

More specifically, transcription regulatory sequences have been found that are induced when exposed to TNFa. TNFa is a cytokine involved in systemic inflammation and is a member of a group of cytokines that stimulate the acute phase reaction. NFkB is a heterodimeric transcription factor that translocates to the nucleus and mediates the transcription of a vast array of proteins involved in cell survival and proliferation, inflammatory response, and anti-apoptotic factors and is activated by TNFa. One can use such a promoter in an assay to determine whether a test compound induces a NFkB-mediated response. This is done, for example, by exposing a cell containing an expression construct comprising the transcription regulatory sequence operatively linked with a reporter sequence to a test compound. If the compound induces activity of the promoter, this means the compound induces a NFkB-mediated response. Also, one can use the promoter in an assay to determine whether a test compound inhibits a NFkB-mediated response. This is done, for example, by exposing a cell containing the expression construct to a condition that induces a NFkB-mediated response (for example, exposing the cell to TNFa) and exposing the cell to the test compound. If the compound inhibits the inducible activity of the promoter, this means the compound inhibits the NFkB-mediated response.

The biological response to TNFa the "inflammation response induced by TNFa" involves a number of events at the cellular and molecular level. These events include NFkB-mediated expression of genes controlling systemic inflammation. The activity of NFkB response biomarker promoters is, in turn, also correlated with these events.

In certain situations it is useful to activate an NFkB response. Activating NFkB activity is known to stimulate the immune system. The NFkB response biomarker promoters of this invention are useful in discovering and evaluating pharmaceutical drugs and other conditions for the ability to elicit an NFkB response.

Also, in certain situations it is desirable to inhibit a NFkB response. For example, inhibiting NFkB may inhibit the effects of chronic inflammation. The NFkB response biomarker promoters of this invention are useful in discovering and evaluating pharmaceutical drugs and other conditions for the ability to inhibit a NFkB response.

Conditions can be tested for their ability to induce or inhibit the NFkB response, as discussed above. NFkB activating conditions to which cells can be exposed for these tests include, for example, any compound or condition that simulates NFkB binding to genomic targets and affecting transcription of those target genes.

2.12. Heat Shock Response

Several promoters have been identified, the activity of each of which is positively correlated with the biological response to hyperthermia or heat shock signaling ("heat shock biomarker promoter"). These heat shock response biomarker promoters are identified in Table 1, section 12 and section 12a. The conditions used to induce the heat shock response was exposing cells to 43 degrees Celsius for 8 hrs. The experimental conditions are set forth more completely in Example 12.

More specifically, transcription regulatory sequences have been found that are induced when exposed to heat shock. When cells are exposed to elevated temperatures or other conditions that result in misfolded proteins, they respond by increasing the expression of chaperone proteins that help to stabilize proteins at higher temperatures. This response is mediated by the family of heat shock transcription factors. One can use such a promoter in an assay to determine whether a test compound induces the heat shock response. This is done, for example, by exposing a cell containing an expression construct comprising the transcription regulatory sequence operatively linked with a reporter sequence to a test compound. If the compound induces activity of the promoter, this means the compound induces a heat shock response. Also, one can use the promoter in an assay to determine whether a test compound inhibits a heat shock response. This is done, for example, by exposing a cell containing the expression construct to a condition that induces a heat shock response (for example, exposing the cell to 43 degrees C.) and exposing the cell to the test compound. If the compound inhibits the inducible activity of the promoter, this means the compound inhibits the heat shock response.

The biological response to heat shock ("heat shock response") involves a number of events at the cellular and molecular level. These events include heat shock transcription factor-mediated expression of genes encoding molecular chaperones. The activity of heat shock response biomarker promoters is, in turn, also correlated with these events.

In certain situations it is useful to activate the heat shock response. Activating chaperone proteins may serve as a protection in conditions that may otherwise denature proteins. The heat shock response biomarker promoters of this invention are useful in discovering and evaluating pharmaceutical drugs and other conditions for the ability to elicit a heat shock response.

Also, in certain situations it is desirable to inhibit the heat shock response. For example, inhibiting heat shock may inhibit the effects of chronic inflammation. The heat shock response biomarker promoters of this invention are useful in discovering and evaluating pharmaceutical drugs and other conditions for the ability to inhibit a heat shock response.

Conditions can be tested for their ability to induce or inhibit the heat shock response, as discussed above. Heat shock activating conditions to which cells can be exposed for these tests include, for example, any compound or condition that denatures or otherwise affects native protein folding.

2.13. Serum Response

Several promoters have been identified, the activity of each of which is correlated with the biological response to serum ("serum response biomarker promoter"). These serum response biomarker promoters are identified in Table 1, section 13 and section 13a. The conditions used to induce the serum response was exposing cells to 20% fetal bovine serum for 8 hrs. The experimental conditions are set forth more completely in Example 13.

More specifically, transcription regulatory sequences have been found that are induced when exposed to serum. When cells are exposed to serum, they activate the serum response transcription factor that directly regulates a set of target genes. One can use such a promoter in an assay to determine whether a test compound induces the serum response. This is done, for example, by exposing a cell containing an expression construct comprising the transcription regulatory sequence operatively linked with a reporter sequence to a test compound. If the compound induces activity of the promoter, this means the compound induces a serum response. Also, one can use the promoter in an assay to determine whether a test compound inhibits a serum response. This is done, for example, by exposing a cell containing the expression construct to a condition that induces a serum response (for example, exposing the cell to fetal bovine serum) and exposing the cell to the test compound. If the compound inhibits the inducible activity of the promoter, this means the compound inhibits the serum response.

The biological response to serum involves a number of events at the cellular and molecular level. These events include serum response transcription factor-mediated expression of genes involved in cell-cycle regulation, development, and muscle growth. The activity of serum response biomarker promoters is, in turn, also correlated with these events.

In certain situations it is useful to activate the serum response. The serum response in some cases may stimulate muscle growth when needed. The serum response biomarker promoters of this invention are useful in discovering and evaluating pharmaceutical drugs and other conditions for the ability to elicit a serum response.

Also, in certain situations it is desirable to inhibit the serum response. For example, inhibiting serum may inhibit tumorigenesis or unregulated cell division. The serum response biomarker promoters of this invention are useful in discovering and evaluating pharmaceutical drugs and other conditions for the ability to inhibit a serum response.

Conditions can be tested for their ability to induce or inhibit the serum response, as discussed above. Serum response activating conditions to which cells can be exposed for these tests include, for example, any compound or condition that simulates the signaling molecules found in serum.

3. Expression Constructs

An expression construct is a recombinant nucleic acid molecule comprising at least one expression control sequence operatively linked with another nucleotide sequence. A recombinant nucleic acid molecule is a nucleic acid molecule comprising two sequences that are not naturally attached to one another, for example, sequences from different species. Two sequences are operably linked when they are placed in a functional relationship with each other so that activity of a first sequence results in an action on the other part. An expression control sequence is operatively linked with a nucleotide sequence when expression of the nucleotide sequence is regulated by the action of the expression control sequence. Expression control sequences include those that regulate transcription of a nucleotide sequence, stability of the transcript or translation of the transcript.

This invention provides expression constructs comprising a biomarker transcription regulatory sequence operatively linked with a reporter sequence. The expression constructs of this invention can be incorporated into a vector or integrated, stably or transiently, into a host cell chromosome.

3.1. Transcription Regulatory Sequences

Transcription regulatory sequences are nucleotide sequences that up- or down-regulate transcription of another nucleotide sequence to which they are operatively linked, e.g., a gene.

3.1.1. Promoters

Promoters are the best-characterized transcriptional regulatory sequences because of their predictable location immediately upstream of transcription start sites. Promoters include sequences that modulate the recognition, binding and transcription initiation activity of the RNA polymerase. These sequences can be cis acting or can be responsive to trans acting factors. Promoters, depending upon the nature of the regulation, can be constitutive or regulated. They are often described as having two separate segments: core and extended promoter regions.

The core promoter includes sequences that are sufficient for RNA polymerase recognition, binding and transcription initiation. The core promoter includes the transcriptional start site, an RNA polymerase binding site and other general transcription binding sites and is where the pre-initiation complex forms and the general transcription machinery assembles. It is generally within 50 nucleotides (nt) of the transcription start site (TSS).

The extended promoter region includes the so-called proximal promoter, which extends to about 250 nucleotides upstream of the transcriptional start site (i.e., −250 nt). It includes primary regulatory elements such as specific transcription factor binding sites. It has been found that many genes have transcription regulatory elements located further up-stream. In particular, a fragment that includes most of the transcription regulatory elements of a gene can extend up to 700 nt or more up-stream of the transcription start site. (See, e.g., U.S. 2007-0161031.) In certain genes, transcription regulatory sequences have been found thousands of nucleotides upstream of the transcriptional start site.

3.1.2. Other Transcription Regulatory Sequences

Transcription regulatory sequences include nucleotide sequences that confer inducible expression of a gene (i.e., that require a substance or stimulus for increased transcription). When an inducer is present, or present at increased concentration, gene expression increases. Regulatory regions also include sequences that confer repression of gene expression (i.e., a substance or stimulus decreases transcription). When a repressor is present or at increased concentration, gene expression decreases. Regulatory regions typically bind one or more trans-acting or cis-acting proteins. Enhancers are known to influence gene expression when positioned 5' or 3' of the gene, or when positioned in or a part of an exon or an intron. Enhancers also can function at a significant distance from the gene, for example, at a distance from about 3 Kb, 5 Kb, 7 Kb, 10 Kb, 15 Kb or more.

Regulatory regions also include, in addition to transcription regulatory sequences, sequences in DNA or RNA molecules that regulate transcript stability, transcript localization, facilitate translation, splicing signals for introns, maintenance of the correct reading frame of the gene to permit in-frame translation of mRNA and, stop codons, leader sequences and fusion partner sequences, internal ribosome binding sites (IRES) elements for the creation of multigene, or polycistronic, messages, polyadenylation signals to provide proper polyadenylation of the transcript of a gene of interest and stop codons and can be optionally included in an expression vector.

3.1.3. Biomarker Transcription Regulatory Sequences

This invention provides isolated nucleic acid sequences that function as biomarker transcriptional regulatory sequences. As is well understood, DNA can be double stranded. The sequences of both strands, that is, one strand and its complement, are considered sequences useful in this invention.

Expression constructs comprising the sequences of the SEQ ID NOs of Table 1 operatively linked with a reporter sequence (e.g., a sequence encoding luciferase) were found to have activity correlated with the biological response indicated. Thus, transcription regulatory sequences that regulate transcription of genes identified in Table 1 are useful as biomarker transcription regulatory sequences for those responses or pathways.

The sequences of Table 1 were selected from transcription regulatory sequences derived from an analysis of the human genome. The analysis is based, in part, on work described in Cooper et al., Trinklein et al., US 2007-0161031 and US 2009-0018031. In short, full-length cDNAs from the Mammalian Gene Collection were aligned against the human genome. Sequences with less than 95% sequence identity, those with more than 200 bases at the 5' end of the cDNA that do not align with the genome, those that align to random sequence not assembled into reference chromosome sequences and those that represent alignment artifacts were filtered out. Alignment artifacts are identified as intronless (ungapped) alignments represented by a small number of independent cDNAs from existing cDNA libraries, as pseudogenes and as single exon genes. More specifically, a library of genetic sequences, such as GenBank, contains a number of molecules reported as cDNAs. When these sequences are aligned against the sequence of the genome, certain locations of the genome are mapped by many reported cDNAs, so that the alignment cannot be considered random: One can be highly confident that these locations represent biologically relevant cDNAs and that the up-stream sequences are active transcription regulatory sequences. Other locations in the genome are mapped by few reported cDNAs or none. If the cDNA sequences are unspliced (that is they contain no introns) and the number of cDNAs mapping to a location in the genome is no more than what one would expect under a random model, then these alignments are considered artifacts. Sequences upstream of the 5' end of these cDNAs (the transcription start site) were selected as transcription regulatory sequence.

Individual genes can have more than one transcriptional start site, and in turn multiple promoters containing different transcriptional regulatory sequences. Therefore in many cases we experimentally tested multiple promoters for each gene to identify the precise promoter that regulates the biological response of interest.

Each sequence identified in Table 1 by SEQ ID NO is useful as biomarker regulatory sequence of this invention. For example, the transcription regulatory sequence can be the entire sequence of the given SEQ ID NO. Alternatively, transcription regulatory sequence can be comprised within a longer sequence from the genome from which the sequence of the SEQ ID NO is taken. For example, this sequence can be upstream of the 5' end indicated in the SEQ ID NO. The sequences of Table 1 are human sequences. In other embodiments, the transcription regulatory sequence can comprise a fragment of a sequence of Table 1. Such fragments can comprise at least 25 nt, at least 50 nt, at least 100 nt, at least 250 nt, at least 500 nt, at least 600 nt, at least 700 nt or at least 900 nt of the sequence of the provided SEQ ID NO.

Any transcription regulatory sequence of a biomarker gene of Table 1 can be used in the expression constructs of this invention. This includes, for example, the transcription start site, the core promoter, the extended promoter, an enhancer region, an inducer region, a repressor region, insulators, suppressors or transcription factor binding site. For example, the transcription regulatory sequence can comprise a sequence sufficient to initiate transcription of a second sequence to which it is operatively linked.

In certain embodiments, the sequence includes a sequence extending at least 250 nucleotides up-stream of the transcription start site. However, closer fidelity of activity to the natural environment can be achieved by including transcription regulatory sequences that are further up-stream of the transcription start site, e.g., those that exist in the extended promoter region. For example, the sequence can extend at least or no more than any of −300 nt, −400 nt, −500 nt, −600 nt, −700 nt, −800 nt, −900 nt, −1000 nt, −1200 nt, −1500 nt, −1800 nt, −2000 nt or −3000 nt from a transcription start site. Also, the sequence can comprise sequence downstream of the transcription start site. For example, up to +10 nt, +20 nt, up to +50 nt, up to +100 nt or more than +100 nt. All combinations of these ranges are contemplated. So, for example, the transcription regulatory sequence can include, consist essentially of, or consist of a sequence that spans a range from about +100 to about −3000, about +50 to about −2000, about +20 to about −1800, about +20 to about −1500, about +10 to about −1500, about +10 to about −1200, about +20 to about −1000, about +20 to about −900, about +20 to about −800, about +20 to about −700, about +20 to about −600, about +20 to about −500, about +20 to about −400, or about +20 to about −300, relative to a transcription start site.

The transcription regulatory sequence can be any polymorphic form of a sequence of Table 1. A polymorphic form is one of two or more genetically determined alternative sequences or alleles in a population. The site of the alternative form is referred to as the locus. Polymorphic forms can occur at any frequency in a population. Alleles are those polymorphic forms that occur with a frequency of preferably greater than 1%, greater than 10% or greater than 20% of a population. A polymorphism may comprise one or more base changes, an insertion, a repeat, or a deletion. A polymorphic locus may be as small as one base pair. Polymorphic forms can include single nucleotide polymorphisms (SNPs), insertions, deletions and repeated sequences. For example, polymorphisms include variable number of tandem repeats (VNTR's), hypervariable regions, minisatellites, dinucleotide repeats, trinucleotide repeats, tetranucleotide repeats, simple sequence repeats, and insertion elements such as Alu. The allelic form occurring most frequently in a selected population is sometimes referred to as the wildtype form. It is estimated that there are as many as $3 \times 10^6$ SNPs in the human genome. Diploid organisms may be homozygous or heterozygous for allelic forms. A diallelic polymorphism has two forms. A triallelic polymorphism has three forms. A polymorphism between two nucleic acids can occur naturally, or be caused by exposure to or contact with chemicals, enzymes, or other agents, or exposure to agents that cause damage to nucleic acids, for example, ultraviolet radiation, mutagens or carcinogens.

Polymorphic forms typically will share at least 95% sequence identity, at least 96% sequence identity, at least 97% sequence identity, at least 98% sequence identity, at least 99% sequence identity, at least 99.5% sequence identity, at least 99.75% sequence identity, at least 99.9% sequence identity over a comparison window of at least 200 nucleotides with a sequence of any the SEQ ID NOs given here. Alternatively, the sequence can hybridize under stringent conditions with a sequence of any SEQ ID NO given here. Such a sequence can be at least 200 nt, at least 500 nt, at least 600 nt, at least 700 nt, at least 800 nt, etc.

3.1.4 Sequence Identity and Hybridization

Terms used to describe sequence relationships between two or more nucleotide sequences or amino acid sequences include "reference sequence," "selected from," "comparison window," "identical," "percentage of sequence identity," "substantially identical," "complementary," and "substantially complementary."

A "reference sequence" is a defined sequence used as a basis for a sequence comparison and may be a subset of a larger sequence, e.g., a complete cDNA, protein, or gene sequence.

Because two polynucleotides or polypeptides each may comprise (1) a sequence (i.e., only a portion of the complete polynucleotide or polypeptide sequence) that is similar between the two polynucleotides, or (2) a sequence that is divergent between the two polynucleotides, sequence comparisons between two (or more) polynucleotides or polypeptides are typically performed by comparing sequences of the two polynucleotides over a "comparison window" to identify and compare local regions of sequence similarity.

A "comparison window" refers to a conceptual segment of typically at least 12 consecutive nucleotides or 4 consecutive amino acid residues that is compared to a reference sequence. The comparison window frequently has a length of at least 15 or at least 25 nucleotides or at least 5 or at least 8 amino acids. The comparison window may comprise additions or deletions (i.e., gaps) of about 20 percent or less as compared to the reference sequence (which does not comprise additions or deletions) for optimal alignment of the two sequences. Optimal alignment of sequences for aligning a comparison window may be conducted by computerized implementations of algorithms (GAP, BESTFIT, FASTA, and TFASTA in the Wisconsin Genetics Software Package Release 7.0, Genetics Computer Group, 575 Science Dr., Madison, Wis.) or by inspection, and the best alignment (i.e., resulting in the highest percentage of homology over the comparison window) generated by any of the various methods is selected.

A subject nucleotide sequence or amino acid sequence is "identical" to a reference sequence if the two sequences are the same when aligned for maximum correspondence over the length of the nucleotide or amino acid sequence.

The "percentage of sequence identity" between two sequences is calculated by comparing two optimally aligned sequences over a comparison window, determining the number of positions at which the identical nucleotide or amino acid occurs in both sequences to yield the number of matched positions, dividing the number of matched positions by the total number of positions in the window of comparison (i.e., the window size), and multiplying the result by 100 to yield the percentage of sequence identity.

Unless otherwise specified, the comparison window used to compare two sequences is the length of the shorter sequence.

Methods are described further in Natl. Acad. Sci. USA 85:2444; Higgins & Sharp (1988) Gene 73:237-244; Higgins & Sharp, CABIOS 5:151-153 (1989); Corpet et al. (1988)

Nucleic Acids Research 16:10881-90; Huang et al. (1992) Computer Applications in the Biosciences 8:155-65; and Pearson et al. (1994) Methods in Molecular Biology 24:307-31. Alignment is also often performed by inspection and manual alignment.

A subject nucleotide sequence or amino acid sequence is "substantially identical" to a reference sequence if the subject amino acid sequence or nucleotide sequence has at least 80% sequence identity over a comparison window. Thus, sequences that have at least 85% sequence identity, at least 90% sequence identity, at least 95% sequence identity, at least 98% sequence identity or at least 99% sequence identity with the reference sequence are also "substantially identical. Two sequences that are identical to each other are, of course, also "substantially identical".

"Hybridizing specifically to" or "specific hybridization" or "selectively hybridize to", refers to the binding, duplexing, or hybridizing of a nucleic acid molecule preferentially to a particular nucleotide sequence under stringent conditions when that sequence is present in a complex mixture (e.g., total cellular) DNA or RNA.

The term "stringent conditions" refers to conditions under which a probe will hybridize preferentially to its target subsequence, and to a lesser extent to, or not at all to, other sequences. "Stringent hybridization" and "stringent hybridization wash conditions" in the context of nucleic acid hybridization experiments such as Southern and northern hybridizations are sequence dependent, and are different under different environmental parameters. An extensive guide to the hybridization of nucleic acids is found in Tijssen (1993) Laboratory Techniques in Biochemistry and Molecular Biology—Hybridization with Nucleic Acid Probes part I chapter 2 "Overview of principles of hybridization and the strategy of nucleic acid probe assays", Elsevier, N.Y.

Generally, highly stringent hybridization and wash conditions are selected to be about 5° C. lower than the thermal melting point (Tm) for the specific sequence at a defined ionic strength and pH. The Tm is the temperature (under defined ionic strength and pH) at which 50% of the target sequence hybridizes to a perfectly matched probe. Very stringent conditions are selected to be equal to the Tm for a particular probe.

An example of stringent hybridization conditions for hybridization of complementary nucleic acids which have more than 100 complementary residues on a filter in a Southern or northern blot is 50% formalin with 1 mg of heparin at 42° C., with the hybridization being carried out overnight. An example of highly stringent wash conditions is 0.15 M NaCl at 72° C. for about 15 minutes. An example of stringent wash conditions is a 0.2×SSC wash at 65° C. for 15 minutes (see, Sambrook et al. for a description of SSC buffer). Often, a high stringency wash is preceded by a low stringency wash to remove background probe signal. An example medium stringency wash for a duplex of, e.g., more than 100 nucleotides, is 1×SSC at 45° C. for 15 minutes. An example low stringency wash for a duplex of, e.g., more than 100 nucleotides, is 4-6×SSC at 40° C. for 15 minutes. In general, a signal to noise ratio of 2×(or higher) than that observed for an unrelated probe in the particular hybridization assay indicates detection of a specific hybridization.

3.1.5 Collections

In certain embodiments, this invention provides collections that comprise the biomarker transcription regulatory sequences of this invention. The collections include isolated nucleic acids, that is, nucleic acids isolated away from their natural environment or existing in a composition in which the nucleic acid is the predominant species of organic or non-solvent molecule. The collections also include expression constructs of this invention and cells comprising the expression constructs of this invention.

In certain embodiments, the transcription regulatory sequences of the collection consist of or consist essentially of the biomarker transcription regulatory sequences of this invention. In other embodiments, at least 20%, at least 30%, at least 40%, at least 50%, at least 60%, at least 70%, at least 90%, at least 95%, at least 97% or at least 99% of the transcription regulatory sequences of the collection are transcription regulatory sequences of this invention. So, for example, at least 20% of the transcription regulatory sequences of the collection can be biomarkers selected from a selected from a section of Table 1, which are biomarkers for the same biological response. Alternatively, the at least 20% can be selected from biomarker transcription regulatory sequences of at least 2, at least 3, at least 4, at least 5, at least 6, at least 7, at least 8, at least 9, at least 10, at least 11, at least 12 or at least 13 different biological responses, e.g., different sections of Table 1, in which case, biomarkers for a plurality of different biological responses will be represented. The collections can comprise no more than 2, no more than 5, no more than 10, no more than 50, no more than 100, no more than 500, no more than 1000 or no more than 5000 transcription regulatory sequences.

3.2. Reporters

In certain embodiments, a transcription regulatory sequence is operatively linked with a heterologous reporter sequence. A reporter sequence is heterologous if it is not naturally under transcriptional regulatory control of the transcription regulatory sequence. For example the transcription regulatory sequence and the reporter can be from different species or the reporter can be an artificially constructed sequence.

A reporter sequence can be any sequence that allows for the detection of a molecule of interest, such as a protein expressed by a cell, or a biological particle. Typical reporter sequences include, include, for example, those encoding light emitting proteins (e.g., luciferase (see, e.g., U.S. Pat. No. 5,292,658), fluorescent proteins (e.g., red, blue and green fluorescent proteins (see, e.g., U.S. Pat. No. 6,232,107, which provides GFPs from *Renilla* species and other species and U.S. Pat. No. 5,625,048), lacZ (e.g., from *E. coli*), alkaline phosphatase, secreted embryonic alkaline phosphatase (SEAP), chloramphenicol acetyl transferase (CAT), hormones and cytokines and other such well-known proteins. For expression in cells, a nucleic acid encoding the reporter sequence can be expressed as a fusion protein with a protein of interest or under to the control of a promoter of interest. The expression of these reporter genes can also be monitored by measuring levels of mRNA transcribed from these genes or from detection of the translated polypeptide.

In collections using proteins that emit a detectable signal it may be useful, but not essential, for all of the reporter proteins to emit the same signal. This simplifies detection during high-throughput methods.

Alternatively, the expression constructs in the collection can contain different reporter sequences that emit different detectable signals. For example, each reporter sequence can be a light emitting reporter that emits light of a different, distinguishable color. Alternatively, the reporter sequence in each of the constructs can be a unique, pre-determined nucleotide barcode. This allows assaying a large number of the nucleic acid segments in the same batch or receptacle of cells. In an embodiment, in each construct a unique promoter sequence is cloned upstream of a unique barcode reporter sequence yielding a unique promoter/barcode reporter combination. The active promoter can drive the production of a transcript containing the unique barcode sequence. Thus, in a collection of expression constructs, each promoter's activity produces a unique transcript whose level can be measured. Since each reporter is unique, the library of expression constructs can be transfected into one large pool of cells (as opposed to separate wells) and all of the RNAs may be harvested as a pool. The levels of each of the barcoded transcripts can be detected using a microarray with the complementary barcode sequences. So the amount of fluorescence on each array spot corresponds to the strength of the promoter that drove the nucleotide barcode's transcription.

In certain embodiments of this invention, a cell or collection of cells can comprise a plurality of expression constructs of this invention which include biomarker expression control sequences of a plurality of different biological responses. In this case, it may be useful to use reporters for each expression control sequence that can be distinguished from each other, e.g., by emitting a different color or having a different bar code.

Optionally, an expression construct can contain both a first reporter sequence and a second reporter sequence. The first reporter sequence and a second reporter sequence are preferred to be different. For example, the first reporter sequence may encode the same reporter protein (e.g., luciferase or GFP), and the second reporter sequence may be a unique nucleotide barcode. In this way, transcription can yield a hybrid transcript of a reporter protein coding region and a unique barcode sequence. Such a construct could be used either in a receptacle-by-receptacle approach for reading out the signal emitted by the reporter protein (e.g., luminescence) and/or in a pooled approach by reading out the barcodes.

By using the unique, molecular barcode for each member of the collection, a large collection can be assayed in a single receptacle (such as a vial or a well in a plate) rather than in thousands of individual receptacles. This approach is more efficient and economic as it can reduce costs at all levels: reagents, plasticware, and labor.

3.3 Vectors and Chromosomes

The recombinant nucleic acid molecule can be further comprised within a vector that can be used to either infect or transiently or stably transfect cells and that may be capable of replicating inside a cell. Expression constructs can be made part of vectors, such as plasmids, cosmids, viral genomes, bacterial artificial chromosomes and the like. They also can be integrated stably into a chromosome of a host cell.

Any suitable vector can be used. There are many known in the art. Examples of vectors that can be used include, for example, plasmids or modified viruses. The vector is typically compatible with a given host cell into which the vector is introduced to facilitate replication of the vector and expression of the encoded reporter. Examples of specific vectors that may be useful in the practice of the present invention include, but are not limited to, *E. coli* bacteriophages, for example, lambda derivatives, or plasmids, for example, pBR322 derivatives or pUC plasmid derivatives; phage DNAs, e.g., the numerous derivatives of phage 1, e.g., NM989, and other phage DNA, e.g., M13 and filamentous single stranded phage DNA; yeast vectors such as the 2 mu plasmid or derivatives thereof; vectors useful in eukaryotic cells, for example, vectors useful in insect cells, such as baculovirus vectors, vectors useful in mammalian cells such as retroviral vectors, adenoviral vectors, adenovirus viral vectors, adeno-associated viral vectors, SV40 viral vectors, herpes simplex viral vectors and vaccinia viral vectors; vectors derived from combinations of plasmids and phage DNAs, plasmids that have been modified to employ phage DNA or other expression control sequences; and the like.

4. Cells Containing Expression Constructs

In another aspect this invention provides recombinant cells comprising the expression constructs of this invention. Two different embodiments are contemplated in particular.

In a first embodiment each cell or group of cells comprises a different member of the expression library. Such a library of cells is particularly useful with the arrays of this invention. Typically, the library is indexed. For example, each different cell harboring a different expression vector can be maintained in a separate container that indicates the identity of the genomic segment within. The index also can indicate the particular gene or genes that is/are under the transcriptional regulatory control of the sequences naturally in the genome.

In a second embodiment, a culture of cells is transfected with a library of expression constructs so that all of the members of the library exist in at least one cell and each cell has at least one member of the expression library. In this embodiment, a cell can comprise more than one different expression constructs (e.g., having transcription regulatory sequences of different genes). The second embodiment is particularly useful with libraries in which the reporter sequences are unique sequences that can be detected independently.

As used herein the term cells and grammatical equivalents herein in meant any cell, preferably any prokaryotic or eukaryotic cell.

Suitable prokaryotic cells include, but are not limited to, bacteria such as *E. coli*, various *Bacillus* species, and the extremophile bacteria such as thermopiles, etc.

Suitable eukaryotic cells include, but are not limited to, fungi such as yeast and filamentous fungi, including species of *Aspergillus, Trichoderma,* and *Neurospora*; plant cells including those of corn, sorghum, tobacco, canola, soybean, cotton, tomato, potato, alfalfa, sunflower, etc.; and animal cells, including fish, birds and mammals. Suitable fish cells include, but are not limited to, those from species of salmon, trout, tulapia, tuna, carp, flounder, halibut, swordfish, cod and zebrafish. Suitable bird cells include, but are not limited to, those of chickens, ducks, quail, pheasants and turkeys, and other jungle foul or game birds. Suitable mammalian cells include, but are not limited to, cells from horses, cows, buffalo, deer, sheep, rabbits, rodents such as mice, rats, hamsters and guinea pigs, goats, pigs, primates, marine mammals including dolphins and whales, as well as cell lines, such as human cell lines of any tissue or stem cell type, and stem cells, including pluripotent and non-pluripotent, and non-human zygotes.

Useful cell types include primary and transformed mammalian cell lines. Suitable cells also include those cell types implicated in a wide variety of disease conditions, even while in a non-diseased state. Accordingly, suitable cell types include, but are not limited to, tumor cells of all types (e.g. melanoma, myeloid leukemia, carcinomas of the lung, breast, ovaries, colon, kidney, prostate, pancreas and testes), cardiomyocytes, dendritic cells, endothelial cells, epithelial cells, lymphocytes (T-cell and B cell), mast cells, eosinophils, vascular intimal cells, macrophages, natural killer cells, erythrocytes, hepatocytes, leukocytes including mononuclear leukocytes, stem cells such as haemopoetic, neural, skin, lung, kidney, liver and myocyte stem cells (for use in screening for differentiation and de-differentiation factors), osteoclasts, chondrocytes and other connective tissue cells, keratinocytes, melanocytes, liver cells, kidney cells, and adipocytes. In some embodiments, the cells used with the methods described herein are primary disease state cells, such as primary tumor cells. Suitable cells also include known research cell lines, including, but not limited to, Jurkat T cells, NIH3T3 cells, CHO, COS, HT1080 human fibrosarcoma cells, HepG2 hepatocarcinoma cells, HeLa cells, etc. See the ATCC cell line catalog, hereby expressly incorporated by reference.

In some embodiments the cells used in the present invention are taken from an individual. In some embodiments the individual is a mammal, and in other embodiments the individual is human.

Exogenous DNA may be introduced to cells by lipofection, electroporation, or infection. Libraries in such cells may be maintained in growing cultures in appropriate growth media or as frozen cultures supplemented with Dimethyl Sulfoxide and stored in liquid nitrogen.

4.1. Transient Expression

In certain embodiments this invention provides transiently transformed cells. In this embodiment, vector DNA is delivered to living cells using a transfection reagent such as a lipofection compound. The cells express the content of this vector construct but the cell does not incorporate the vector sequence in its genome. A typical transient transfection experiment involves seeding cells in a plate or dish, then 24 hours later transfecting the vector DNA, then 12-24 hrs later applying a stimulus of interest, and then recording the reporter signal.

4.2. Stably Transformed Cells

In other embodiments, this invention provides stably transformed cells. In this embodiment, the vector DNA contains a gene for a mammalian selectable marker such as hygromycin. The vector is delivered to living cells using a transfection reagent such as a lipofection compound or in the form of a virus, and the cells are grown in the presence of the selecting antibiotic. Over the course of 5-20 or more cell passages, only cells that have integrated the vector DNA into their genome are selected for.

5. Devices and Kits

This invention provides kits and devices. The kits can include all reagents necessary to transiently transfect, infect, or transduce cells and perform assays. For example, the kits can include one or more containers comprising one or more expression constructs of this invention. They also can contain a container comprising a substrate for a reporter molecule made by the expression construct. The kit also can contain containers comprising appropriate solutions for carrying out the assay, such as appropriate buffers. The kit also can contain instructions on how to carry out the assay. The kit can also contain a container comprising cells to be transfected by the expression construct. In certain embodiments, the cells will be stably transformed to contain the expression construct. In certain embodiments, the kit contains microtiter plates, such as those having wells in multiples of 96, which are typically used in research.

6. Methods 6.1 Test Conditions

Certain methods of this invention involve exposing cells to test conditions. A test condition can be any condition different than a control condition to which a cell is exposed. Test conditions include, for example, contacting the cell with a test composition, exposing the cell to a test environmental condition, over-expressing or knocking down expression of a particular gene of interest in the cell, or combinations of these.

Test compositions include individual compounds and mixtures of compounds, e.g., a library of compounds. A compound can be any element or molecule, for example, small organic molecules and biopolymers. Drug candidates useful as test compositions in this invention include small organic molecules and biological molecules, e.g., biologics. Organic molecules used as pharmaceuticals generally are small organic molecules typically having a size up to about 5000 Da, up to about 2000 Da, or up to about 1000 Da. Certain hormones are small organic molecules. Organic biopolymers also are used as test compositions. These include, for example, polypeptides (e.g., peptides and proteins), polynucleotides (e.g., oligonucleotides or nucleic acids (e.g., inhibitory polynucleotides, such as ribozymes, antisense molecules or interfering RNA molecules), carbohydrates, lipids and molecules that combine these, for example glycoproteins, glycolipids and lipoproteins. Certain hormones are biopolymers. Antibodies find increasing use as biological pharmaceuticals. U.S. publication 2009-0035216 provides a list of antibody drugs. This list includes, for example herceptin, bevacizumab, avastin, erbitux and synagis (cell adhesion molecules).

6.2 Assays

This invention provides assays for determining whether and to what extent a test condition modulates a biological response. In certain embodiments, the methods involve exposing a recombinant cell of this invention to a test condition and measuring the amount of activity of a biological response biomarker promoter of this invention. In certain embodiments, the cells tested do not exhibit the biological response, and the methods involve exposing the cells to a test condition and determining whether the response is invoked. In other embodiments, the cells are exhibiting the biological response, e.g., by exposing the cells to conditions that elicit the response and then exposing the cells to the test condition. The expression of the reporter indicates the activity of the biomarker expression control sequence. The activity of the biomarker, in turn, indicates the activity of the biological response for which it is a biomarker.

Measuring a response includes quantitative and qualitative determinations. Qualitative measurement includes measuring a response or lack of response, regardless of intensity. A quantitative response generally involves measuring the intensity of a response.

The assays rely in part on the correlation between the activity of biomarker promoters and the activity of biological responses. This correlation can be positive (e.g., stimulation of biomarker activity correlates with activation of the response, or inhibition of the biomarker correlates with inhibition of the response) or the correlation can be negative (e.g., stimulating activity of the biomarker correlates with inhibition of the response, or inhibition of biomarker activity correlates with activation of the biological response). Thus, biomarker activity (its induction or inhibition of induction) functions as a proxy for the activity of the biological response. This, in turn, allows one to determine whether a test condition modulates (e.g., activates or inhibits) a biological response, based on the ability of the test condition to modulate activity of the biomarker promoter and the correlation of activity of the biomarker promoter with the activity of the biological response. A test condition that modulates or alters activity of a biomarker transcription regulatory sequence, by extension, modulates or alters activity of the biological response for which the transcription regulatory sequence is a biomarker.

This invention contemplates a number of different types of assays. In one assay, a cell comprising an expression construct of this invention is exposed to a test condition and the activity of the biomarker expression control sequence is determined based on expression of the reporter sequence. In another assay, a biomarker expression control sequence for a single biological response is exposed to a plurality of different test conditions, e.g., a plurality of different test compositions, and the effect of each test condition on the activity of the biomarker is determined. This can be, for example, a high throughput assay in which tens, hundreds or thousands of conditions are tested. In another embodiment, a single test condition is tested for the ability to modulate activity of one or more biomarkers for a plurality of different biological responses. For example, one can test biomarkers for at least 2, at least 5, at least 10 or at least 13 different biological responses.

A container (e.g., a multiwell plate array) containing cells harboring an expression construct of this invention is useful for high-throughput screening of promoter activity. A cell comprising an expression construct that comprises a biological response biomarker promoter operably linked with a reporter gene is exposed to a test condition under conditions chosen by the operator. Cells in which the promoters are "turned on" will express the reporter sequences under their transcriptional control. The investigator then checks each well of the device to measure the amount of reporter transcribed. Generally, this involves measuring the signal produced by a reporter protein encoded by the reporter sequence. For example, if the reporter protein is a light emitting reporter, then the amount of light produced in each cell is measured. In the case of a fluorescent protein, light can be directed to each well to induce fluorescence. The amount of signal measured is a function of the expression of the reporter sequence which, in turn, is a function of the activity of the transcriptional regulatory sequences. In certain methods, the assay is multiplexed. A number of compounds, e.g., a library of compounds can be tested. This can involve testing each compound against a recombinant cell of this invention.

The choice of a proper detection system for a particular application is well within the abilities of one of skill in the art. Exemplary detection means include, but are not limited to, detection by unaided eye, light microscopy using the eye or an optical sensor as the detector, confocal microscopy, laser scanning confocal microscopy, imaging using quantum dot color, fluorescence spectrum or other quantum dot property and wide-field imaging with a 2D CCD camera. In an exemplary embodiment, the device is a fluorescent plate reader. For example, the assay can be performed in a multiwell plate, e.g., a plate with multiples of 96 wells (e.g., 96-well plate, 384-well plate, 1536-well plate). In assays in which the reporter is luminescent or fluorescent molecule, the reporter may have to be induced to produce light. For example, in assays involving luciferase, a substrate for the enzyme is provided. In the case of fluorescent proteins, light of an exciting wavelength is provided. Commercially available microplate luminometers can be used to detect the signal. These are available from, for example, Tecan, Molecular Devices and Berthold.

Assays can involve creation of a standard curve against which measurements are compared to quantify the amount of expression.

It also can be useful to identify differences in transcription regulatory sequence activity in two cell types. For example gene expression differs when cells transform from normal to cancerous. Promoters that are overactive in cancer cells may be targets of pharmacological intervention. The arrays of this invention are useful to identify such transcription regulatory sequences. Accordingly, the investigator provides two sets of arrays comprising expression constructs in the wells. Once cell type is used for transformation in a first device and a second cell type, for transformation in a second device. The expression of reporter sequences between the two devices is compared to identify those expressed differently in the two cell types.

Using expression constructs in which the transcription regulatory sequences are operably linked to unique reporter sequences opens the possibility of performing tests without the use of multiwell plates. In such situations a single culture of cells contains the entire expression library distributed among the cells. The culture can be incubated under conditions chosen by the investigator. Then the expression products are isolated. Reporters that emit different colors can be used. As described, if the reporter is a barcode, because each expression vector has a unique nucleotide sequence tag or barcode associated with its partner nucleic acid segment, the amount of each of the reporter sequences can be measured by measuring the amount of transcript comprising each unique sequence. For example, the molecules can be detected on a DNA array that contains probes complementary to the unique sequences. The amount of hybridization to each probe indicates the amount of the reporter sequence expressed, which, in turn, reflects the activity of the transcription regulatory sequences.

EXAMPLES

1. Biological Responses
1.1 Biological Response to Hypoxia

Transient transfection assays were conducted in HT1080 human fibrosarcoma cells (ATCC, Manassas, Va.) in 96-well white plates. After 5,000 cells per well were seeded in culture medium for 24 hr, 50 ng of plasmid DNA per well was transfected with Fugene-6 transfection reagent (Roche Diagnostics, Indianapolis, Ind.) according to Fugene standard protocols. After 16 hrs, the transfection medium was removed and fresh culture medium was added into each well, and 3 replicates of each construct were moved into a chamber containing 1% oxygen, 5% $CO_2$, and 94% nitrogen. Cells were kept in the low oxygen condition for 24 hrs. In addition, 3 replicates of each construct were treated with 100 uM DFO for 24 hrs. Furthermore, 3 replicates of each construct remained in normal oxygen conditions and were not treated with DFO to serve as untreated control replicates. After induction, 100 uL of Steady-Glo (Promega) was added into each well, incubated at room temperature for 30 min, and then read in a standard plate luminometer (Molecular Devices, Sunnyvale, Calif.). Each treatment was assayed in triplicate, and the average of the 3 replicates without hypoxia induction and the average of the 3 replicates with hypoxia induction were recorded.

Transcription regulatory sequences, the activity of which is highly correlated with the hypoxia response in this assay, and that can be used as biomarkers for the hypoxia response, are identified in Table 1, section 1 and section 1a.

1.2. Biological Response to Estrogen (β-estradiol)

Transient transfection assays were conducted in HT1080 human fibrosarcoma cells (ATCC, Manassas, Va.) in 96-well white plates. First, 10,000 cells per well were seeded in charcoal stripped culture medium for 24 hr. Next, 50 ng of reporter plasmid DNA and 10 ng of an ER cDNA expression plasmid (Origene) per well were transfected with Fugene-6 transfection reagent (Roche Diagnostics, Indianapolis, Ind.) according to Fugene standard protocols. After 16 hrs, the transfection medium was removed and fresh culture medium with or without the addition of an inducing compound was added to each well. For the no treatment control, only fresh media was added to the wells. β-estradiol (Sigma) was added to the media of the treated samples at a final concentration of 10 nM. Cells were incubated for 24 hrs after induction. After 24 hrs, 100 uL of Steady-Glo (Promega) was added into each well, incubated at room temperature for 30 min, and then read in a standard plate luminometer (Molecular Devices, Sunnyvale, Calif.). Each treatment for each reporter construct was assayed in triplicate, and the average of the 3 replicates without treatment and the average of the 3 replicates with treatment were recorded.

Transcription regulatory sequences, the activity of which is highly correlated with the estrogen response in this assay, and that can be used as biomarkers for the estrogen response, are identified in Table 1, section 2 and section 2a.

1.3. Biological Response to Artificial Androgen (Methyltrienolone)

Transient transfection assays were conducted in HT1080 human fibrosarcoma cells (ATCC, Manassas, Va.) in 96-well white plates. First, 10,000 cells per well were seeded in charcoal stripped culture medium for 24 hr. Next, 50 ng of reporter plasmid DNA and 10 ng of an AR cDNA expression plasmid (Origene) per well were transfected with Fugene-6 transfection reagent (Roche Diagnostics, Indianapolis, Ind.) according to Fugene standard protocols. After 16 hrs, the transfection medium was removed and fresh culture medium with or without the addition of an inducing compound was added to each well. For the no treatment control, only fresh media was added to the wells. Methyltrienolone (R1881) was added to the media of the treated samples at a final concentration of 10 nM. Cells were incubated for 24 hrs after induction. After 24 hrs, 100 uL of Steady-Glo (Promega) was added into each well, incubated at room temperature for 30 min, and then read in a standard plate luminometer (Molecular Devices, Sunnyvale, Calif.). Each treatment for each reporter construct was assayed in triplicate, and the average of the 3 replicates without treatment and the average of the 3 replicates with treatment were recorded.

Transcription regulatory sequences, the activity of which is highly correlated with the androgen response in this assay, and that can be used as biomarkers for the androgen response, are identified in Table 1, section 3 and section 3a.

1.4 Biological Response Mediated by p53

Transient transfection assays were conducted in HT1080 human fibrosarcoma cells (ATCC, Manassas, Va.) in 96-well white plates. First, 5,000 cells per well were seeded in standard culture medium for 24 hr. Next, 50 ng of reporter plasmid DNA per well was transfected with Fugene-6 transfection reagent (Roche Diagnostics, Indianapolis, Ind.) according to Fugene standard protocols. After 16 hrs, the transfection medium was removed and fresh culture medium with or without the addition of an inducing compound was added to each well. For the no treatment control, only fresh media was added to the wells. The p53 protein was induced by two separate treatments: nutlin (Sigma) was added to the media at a final concentration of 10 uM, and doxorubicin (Calbiochem) was added to the media at a final concentration of 200 ng/ml. Cells were incubated for 24 hrs after induction. After 24 hrs, 100 uL of Steady-Glo (Promega) was added into each well, incubated at room temperature for 30 min, and then read in a standard plate luminometer (Molecular Devices, Sunnyvale, Calif.). Each treatment for each reporter construct was assayed in triplicate, and the average of the 3 replicates without treatment and the average of the 3 replicates with treatments were recorded.

Transcription regulatory sequences, the activity of which is highly correlated with the p53 activation response in this assay, and that can be used as biomarkers for the p53 activation response, are identified in Table 1, section 4 and section 4a.

1.5 Biological Response to Inhibitors or Activators of Cholesterol Biosynthesis

Transient transfection assays were conducted in HepG2 hepatocarcinoma cells (ATCC, Manassas, Va.) in 96-well white plates. First, 10,000 cells per well were seeded in delipidated culture medium for 24 hr. Next, 100 ng of reporter plasmid DNA per well was transfected with Fugene-6 transfection reagent (Roche Diagnostics, Indianapolis, Ind.) according to Fugene standard protocols. After 16 hrs, the transfection medium was removed and fresh culture medium with or without the addition of an inducing compound was added to each well. For the no treatment control, only fresh media was added to the wells. Inductions were done by three separate treatments: lovastatin (Sigma) (HMG-CoA reductase inhibitor) was added to the media at a final concentration of 1 uM, synthechol (Sigma) (activator of cholesterol utilization pathway) was added to the media at a final concentration of 5 ug/ml, and U1866A (Sigma) (inhibitor of intracellular cholesterol transport) was added to the media at a final concentration of 1 uM. Cells were incubated for 24 hrs after induction. After 24 hrs, 100 uL of Steady-Glo (Promega) was added into each well, incubated at room temperature for 30 min, and then read in a standard plate luminometer (Molecular Devices, Sunnyvale, Calif.). Each treatment for each reporter construct was assayed in triplicate, and the average of the 3 replicates without treatment and the average of the 3 replicates with treatments were recorded.

Transcription regulatory sequences, the activity of which is highly correlated with the cholesterol response in this assay, and that can be used as biomarkers for the cholesterol response, are identified in Table 1, section 5 and section 5a.

1.6 Biological Response to Interferons

Transient transfection assays were conducted in Hela cells (ATCC, Manassas, Va.) in 96-well white plates. First, 10,000 cells per well were seeded in a starvation medium (phenol-free Opti-MEM) for 24 hr. Next, 100 ng of reporter plasmid DNA per well was transfected with Fugene-6 transfection reagent (Roche Diagnostics, Indianapolis, Ind.) according to Fugene standard protocols. After 16 hrs, the transfection medium was removed and fresh culture medium with or without the addition of an inducing compound was added to each well. For the no treatment control, only fresh media was added to the wells. Inductions were done by two separate treatments: interferon alpha (Calbiochem) was added to the media at a final concentration of 500 U/ml, and interferon gamma (Sigma) was added to the media at a final concentration of 100 ng/ml. Cells were incubated for 8 hrs after induction. After 8 hrs, 100 uL of Steady-Glo (Promega) was added into each well, incubated at room temperature for 30 min, and then read in a standard plate luminometer (Molecular Devices, Sunnyvale, Calif.). Each treatment for each reporter construct was assayed in triplicate, and the average of the 3 replicates without treatment and the average of the 3 replicates with treatments were recorded.

Transcription regulatory sequences, the activity of which is highly correlated with the interferon response in this assay, and that can be used as biomarkers for the interferon response, are identified in Table 1, section 6 and section 6a.

1.7 Biological Response to CREB Activation

Transient transfection assays were conducted in Hela cells (ATCC, Manassas, Va.) in 384-well white plates. First, 4,000 cells per well were seeded in standard culture medium for 24 hr. Next, 50 ng of reporter plasmid DNA per well was transfected with Fugene-6 transfection reagent (Roche Diagnostics, Indianapolis, Ind.) according to Fugene standard protocols. After 16 hrs, the transfection medium was removed and fresh culture medium with or without the addition of an inducing compound was added to each well. For the no treatment control, only fresh media was added to the wells. Inductions were done by two separate treatments: forskolin (Sigma) (protein kinase A activator) was added to the media at a final concentration of 20 uM, and phorbol 12-myristate 13-acetate (Promega) (protein kinase C activator) was added to the media at a final concentration of 100 nM. Cells were incubated for 4 hrs after induction. After 4 hrs, 100 uL of Steady-Glo (Promega) was added into each well, incubated at room temperature for 30 min, and then read in a standard plate luminometer (Molecular Devices, Sunnyvale, Calif.). Each treatment for each reporter construct was assayed in triplicate, and the average of the 3 replicates without treatment and the average of the 3 replicates with treatments were recorded.

Transcription regulatory sequences, the activity of which is highly correlated with the CREB activation response in this assay, and that can be used as biomarkers for the CREB activation response, are identified in Table 1, section 7 and section 7a.

1.8 Biological Response to Glucocorticoid Receptor Ligands

Transient transfection assays were conducted in HT1080 cells (ATCC, Manassas, Va.) in 96-well white plates. First, 5,000 cells per well were seeded in standard culture medium for 24 hr. Next, 50 ng of reporter plasmid DNA was transfected with Fugene-6 transfection reagent (Roche Diagnostics, Indianapolis, Ind.) according to Fugene standard protocols. After 16 hrs, the transfection medium was removed and fresh culture medium with or without the addition of an inducing compound was added to each well. For the no treatment control, only fresh media was added to the wells. Inductions were done by three separate treatments: dexamethasone (Sigma) was added to the media of the treated samples at a final concentration of 100 nM, prednisone (Sigma) was added to the media of the treated samples at a final concentration of 1 uM, and cortisone (Sigma) was added to the media of the treated samples at a final concentration of 1 uM. Cells were incubated for 4 hrs after induction. After 4 hrs, 100 uL of Steady-Glo (Promega) was added into each well, incubated at room temperature for 30 min, and then read in a standard plate luminometer (Molecular Devices, Sunnyvale, Calif.). Each treatment for each reporter construct was assayed in triplicate, and the average of the 3 replicates without treatment and the average of the 3 replicates with treatment were recorded.

Transcription regulatory sequences, the activity of which is highly correlated with the glucocorticoid-mediated response in this assay, and that can be used as biomarkers for the glucocorticoid-mediated response, are identified in Table 1, section 8 and section 8a.

1.9 Biological Response to PPAR Ligands

Transient transfection assays were conducted in HepG2 cells (ATCC, Manassas, Va.) in 96-well white plates. First, 10,000 cells per well were seeded in charcoal stripped culture medium for 24 hr. Next, 100 ng of reporter plasmid DNA and 20 ng of a PPAR cDNA expression plasmid (Origene) per well were transfected with Fugene-6 transfection reagent (Roche Diagnostics, Indianapolis, Ind.) according to Fugene standard protocols. After 16 hrs, the transfection medium was removed and fresh culture medium with or without the addition of an inducing compound was added to each well. For the no treatment control, only fresh media was added to the wells. Inductions were done by three separate treatments: WY14643 (Cayman) was added to the media of the treated samples at a final concentration of 75 uM to induce PPAR alpha, ciglitazone (Biomol) was added to the media of the treated samples at a final concentration of 10 uM to induce PPAR gamma, and GW501516 (Alexis) was added to the media of the treated samples at a final concentration of 100 nM to induce PPAR delta. Cells were incubated for 24 hrs after induction. After 24 hrs, 100 uL of Steady-Glo (Promega) was added into each well, incubated at room temperature for 30 min, and then read in a standard plate luminometer (Molecular Devices, Sunnyvale, Calif.). Each treatment for each reporter construct was assayed in triplicate, and the average of the 3 replicates without treatment and the average of the 3 replicates with treatment were recorded.

Transcription regulatory sequences, the activity of which is highly correlated with the PPAR-mediated response in this assay, and that can be used as biomarkers for the PPAR-mediated response, are identified in Table 1, section 9 and section 9a.

1.10 Biological Response to RAR Ligands

Transient transfection assays were conducted in HepG2 cells (ATCC, Manassas, Va.) in 96-well white plates. First, 10,000 cells per well were seeded in charcoal stripped culture medium for 24 hr. Next, 100 ng of reporter plasmid DNA and 20 ng of a RAR cDNA expression plasmid (Origene) per well were transfected with Fugene-6 transfection reagent (Roche Diagnostics, Indianapolis, Ind.) according to Fugene standard protocols. After 16 hrs, the transfection medium was removed and fresh culture medium with or without the addition of an inducing compound was added to each well. For the no treatment control, only fresh media was added to the wells. Inductions were done by two separate treatments: AM-580 (Biomol) was added to the media of the treated samples at a final concentration of 100 nM for RAR alpha and adapalene (Biomol) was added to the media of the treated samples at a final concentration of 100 nM for RAR beta. Cells were incubated for 24 hrs after induction. After 24 hrs, 100 uL of Steady-Glo (Promega) was added into each well, incubated at room temperature for 30 min, and then read in a standard plate luminometer (Molecular Devices, Sunnyvale, Calif.). Each treatment for each reporter construct was assayed in triplicate, and the average of the 3 replicates without treatment and the average of the 3 replicates with treatment were recorded.

Transcription regulatory sequences, the activity of which is highly correlated with the RAR-mediated response in this assay, and that can be used as biomarkers for the RAR-mediated response, are identified in Table 1, section 10 and section 10a.

1.11 Biological Response to TNFa and NFkB Activation

Transient transfection assays were conducted in HT1080 cells (ATCC, Manassas, Va.) in 96-well white plates. First, 5,000 cells per well were seeded in standard culture medium for 24 hr. Next, 50 ng of reporter plasmid DNA was transfected with Fugene-6 transfection reagent (Roche Diagnostics, Indianapolis, Ind.) according to Fugene standard protocols. After 16 hrs, the transfection medium was removed and fresh culture medium with or without the addition of an inducing compound was added to each well. For the no treatment control, only fresh media was added to the wells. TNFa (Abcam) was added to the media of the treated samples at a final concentration of 20 ng/ml. Cells were incubated for 8 hrs after induction. After 8 hrs, 100 uL of Steady-Glo (Promega) was added into each well, incubated at room temperature for 30 min, and then read in a standard plate luminometer (Molecular Devices, Sunnyvale, Calif.). Each treatment for each reporter construct was assayed in triplicate, and the average of the 3 replicates without treatment and the average of the 3 replicates with treatment were recorded.

Transcription regulatory sequences, the activity of which is highly correlated with the TNFα-mediated response in this assay, and that can be used as biomarkers for the TNFα-mediated response, are identified in Table 1, section 11 and section 11a.

1.12 Biological Response to Heat Shock

Transient transfection assays were conducted in HT1080 cells (ATCC, Manassas, Va.) in 96-well white plates. First, 5,000 cells per well were seeded in standard culture medium for 24 hr. Next, 50 ng of reporter plasmid DNA was transfected with Fugene-6 transfection reagent (Roche Diagnostics, Indianapolis, Ind.) according to Fugene standard protocols. After 16 hrs, three replicates of each transfected construct was moved to 43 degrees C., and three replicates were kept at 37 degrees C. Cells were incubated for 8 hrs at their respective temperatures. After 8 hrs, 100 uL of Steady-Glo (Promega) was added into each well, incubated at room temperature for 30 min, and then read in a standard plate luminometer (Molecular Devices, Sunnyvale, Calif.). Each treatment for each reporter construct was assayed in triplicate, and the average of the 3 replicates without treatment and the average of the 3 replicates with treatment were recorded.

Transcription regulatory sequences, the activity of which is highly correlated with the heat shock response in this assay, and that can be used as biomarkers for the heat shock response, are identified in Table 1, section 12 and section 12a.

1.13 Biological Response to Serum

Transient transfection assays were conducted in HT1080 cells (ATCC, Manassas, Va.) in 96-well white plates. First, 7,500 cells per well were seeded in a starvation medium (phenol-free Opti-MEM) for 24 hr. Next, 50 ng of reporter plasmid DNA per well was transfected with Fugene-6 transfection reagent (Roche Diagnostics, Indianapolis, Ind.) according to Fugene standard protocols. After 16 hrs, the transfection medium was removed and fresh culture medium with or without the addition of fetal bovine serum was added to each well. For the no treatment control, only fresh media was added to the wells. Inductions were done by adding fetal bovine serum to the media at a final concentration of 20%. Cells were incubated for 8 hrs after induction. After 8 hrs, 100 uL of Steady-Glo (Promega) was added into each well, incubated at room temperature for 30 min, and then read in a standard plate luminometer (Molecular Devices, Sunnyvale, Calif.). Each treatment for each reporter construct was assayed in triplicate, and the average of the 3 replicates without treatment and the average of the 3 replicates with treatments were recorded.

Transcription regulatory sequences, the activity of which is highly correlated with the serum response in this assay, and that can be used as biomarkers for the serum response, are identified in Table 1, section 13 and section 13a.

References

U.S. 2007-0161031, Jul. 12, 2007, TRINKLEIN, N. D. et al.

U.S. 2009-0018031, Jan. 15, 2009, TRINKLEIN, N. D. et al.

COOPER, S. J. et al., Genome Res., 2006, 16:1-10

GUILLEM, K. et al., Cell, 1997 89:9-12

TRINKLEIN, N. D. et al., Genome Res., 2003, 13:308-312

TRINKLEIN, N. D. et al., Genome Res., 2004, 14:62-66

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (1619 sequences)

SEQ ID NO: 1 - DNA, 935 bp, Homo sapiens
ccaaaatttcttcatggggttttgaactcggcgggatttcaaaggttttaaaaatgagtttttgattttttttaaaaccctcaaatttcattacctttaaactaggtcgaaacggggcgcaagagattggattaacaccatagtaatacttattttgttcttaaccatttcagggcttcttgaaatagaggctgtatggtgtaatggaaaaaacagccttggaatctgggagcctgattcctggattcagtcccagttttgcgtgaccttgggcaagttactttacttctctgaatttccgtttcctcctctgcaaaatgaggatcgcaatagccaccttgcaaccttgactggagcgagcctcgcacaccccgcgccggcctggaggaagagcagccatgattacgccgccttcgctccgctacccgcttgcggctggcgccctcctccagcaggtgtaggcgctgccgcgctgccccacgcctttccgccgctcgcgggcctgcgcctcggcgtccccgaggaggccgctgcgggctgaggtagcgcaccggcctctcggcgtcccagtccggtcccgggcggagggaaagcgggcgacccacctccgaggcagaagccgaggcccggccccgccgagtgcggaggagcgcaggcagcccccgcccctcggccctccccccggccctcccggccctccctccgccccctccgccctcgcgcgccgcccgcccgggtcgccgcggggccgtggtgtacgtgcagagcgcgcagagcgagtggcgcccgtatgccctgcgctcctccacagcctgggccgggccgcccgggacgctgaggcggcggcggcggccgagggggccggtcttgcgctccccaggcccgcgcgcctgagcccaggttgccattcgccgcacaggccctattctctcagc

SEQ ID NO: 2 - DNA, 832 bp, Homo sapiens
gggtatggttgagactcgagatgagatgccagtggggtgggcagtagaaagtgcagaataaaatgtacatttgaactgagtcaccctgcaaggcctgagaggccaaggcttcactgtgagtgggagctggtaggcttagcagcagagggaaaagcagcgtcgagttttggaggtcactcgacttaggtaagaacagactgactgactgctaggcattttcttcctttcgttcaacaaatatttgtggagtgcctattacgtgccagaagctgttctggacactgagaaacagggatgaagaagaaacagatccaagccttcctgagagtaacctccccaggtttcatggatgaggaaactgaaggtcgtcctgactcaggctcatggctccgaccccggcttctgtggttggagggcagcaccttacttagactcccagcgcacgtggagcagtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccggtacggtagggccctgcgcgcacggcgccagagggatgggcgggtagagccaactgcctctggttctgctggcctccgctgctcgcgaagggattcctgctcccgggaggtgtaggagccgctttccagaag

SEQ ID NO: 3 - DNA, 1063 bp, Homo sapiens
gggattgtctgccctaattatcaggtccaggctacagggctgcaggacatcgtgaccttccgtgcagaaacctccccctccccctcaagccgcctcccgagcctccttcctctccaggcccccagtgcccagtgcccagtgcccagcccaggcctcggtcccagagatgccaggagccaggagatggggagggggaagtgggggctgggaaggaaccacgggcccccgcccgaggcccatgggcccctcctaggcctttgcctgagcagtccggtgtcactaccgcagagcctcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccaggtgaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtcggccggggccactaggcgctcactgttctctcc

SEQ ID NO: 4 - DNA, 996 bp, Homo sapiens
cttttggagaaggaagtcaggctcaaggaagacgtttggcaggaactgtgaccccgcatgccagaggccgagcagcggccggtgcatagccgcgcattctggttttctgtggcgcagaggactaccagcctggctgcggcggcccggcggagagcgcgcacgcatgcgcgacccagcccggcctgccagcctggaactcggatggggaggtctcgcctccgcgcgccgctagttccgccgccttctcgcgctccctgcgtgtcctctcgatgccctttcctccgcctcccttacgcctgggccagtgacagggtgtcggctccgcgccgattcagcccgcgggcgaggcaggctaacgcacgactgcgcgatgtggcccctatggtgacacgcgctgcagccgcgaagaccggaagctggggcggccccgggccgcgcgcgctgggcctgggaggcgaaactcagcttccttcgtttccgacttttccatccgcgtcctccacttccccgttccgccctcccccattgccaacattctggctgagtcacggcgccccagagcgcgccaggctgggggaaaggagcagaagggagggccctagcgacccgcgggatgtggtccgagtcacgtccgaggggggtggggagggatcgtgttctcggcgcccgccccttcctagcgcggcctctgggctgcgcctctcgggggcggcccgtagcccagtccgtcgcctgccattggacgccgcccgctcctcgtaaaggaaaaagctcggcggagggcggagtggtgcctttaaaaggccgggcgccgccttccgcctgcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggtga

SEQ ID NO: 5 - DNA, 1002 bp, Homo sapiens
gctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaatttctccaagcttacggaatcttactttttgggtgagagggggcggatgatgaagtcagggaagaagcagcttgggcctcctgcctgggcaccctccatagatccctctccacctcctgctgcatccaaagccaaggctgcctgcccttcctcccttcctctgctttcaccaaaactctgggcactggactgcttgttccctggctcaccgcctggaggaaacagaaaggcttcattctcttactttccccagccccctcgggggtataccctggcaaatatgggggtgaggacagagaagctcagttcattacttcctgccctgaacttgggcaccttgaagatgcttctgccccacctactcaacctgttgttactgttctggtgcctcctcttcaccagactaagcttaatccccagcatccagcaagtgcccggcacgtggtaaagggattgtggcagaaatgaacgcaaggtcatggccaggctccccgaggtgggagggcagtccctaacagccacggatgcctggcggggcgctcactccacctcgccgccccgcctctgagggcgtggtcttgccccggacaccagtcctggggagggggtgtggtcagggcggggcatgcaggccacgcccccggaggagtcacgtagctctgcgacatccgcagcctcatttaccagagggagccagggctgcagcctcatctgtttgcggatcagaacccgagctgtgcttgtggctgcggctgctaactggctgcgcacaggtaaggccaggcaaggcgggagccactcaacatctcc

SEQ ID NO: 6 - DNA, 1199 bp, Homo sapiens
gagctgcagagatgctctttttctacctcctacttctctggctcttagagaggcagcatgggataatggggcaagcgaatagggccttaaagtagagggacaagggttctcttccctatctgccacttattagctatgtgacctcgtgtaagtctcttttctttttgagacagggtctccctctgtcacctaggctggagtacagtggtatgatcatagctcactgcagcctcgaactcctgggctcaagctatccttccaccttagccttctgagcagcagggactacaggcacatgccaccatgtccggctgatttatttatttttatttgggaagatgggggtctcactatgtcgcccaggctggtcatgaactcctggtctcaagcaaccctccaaccttggactcccaaagtgctgggattacaggtgtgagccctggccttgcctcaatttcctcatctgtaaaacggggttagtgaaactcacatcctatcagtggttttgaggatgggccgactcttgtattgcctgctctagtacaatcagcagctaaggcggctcactttccggccgtgctacaataggtaagaactaggatgctttagacgtgtgactgggcagtgggagcccctcacatgatcccgagatgccagacagtgtctctccgcacagggcgtgtgctggtccagaggcccgtttttccagtcgccccacaccccgggtccgcgatcacgctccccccacccatagccgagcctgacgcggcggtggctcatgcgcctttccgtcccagcctttagccacggaccacacgtcccatctcaggcgccccgcccctcccccgccccccgcccccggcgcgcctccccaggctgccggctccggtgtctgagcggccgcgcccgcgagccgtgagcgatgattggctgcgccacggcggcgggcggtccgtgggcgcacacaccctccccgcgcagccaatgggcgtgcgcacgtcactgatccggaggcccgcgggccggcagcccctcaataagccacattgttgcatgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttg

SEQ ID NO: 7 - DNA, 943 bp, Homo sapiens
ttgcttcttaaagggctgttctgtgtccctacgggcctgaaggtcagtttatgtgcaatgctttttaaggtatgggttgctttcttgcattgtagctactacctccctggcctgctggttactgaccagagggagggagagggtgtgattgtttggaaagagtttaaacagtgacaagaattgaattttatttatttgttattcattgcacaatccaataacagcgatggcaatgaaaacgaaagttaatctacaatcctatcaccctattaagtcacttgtttctattttcccttttattccctcatgcattaaacattacgcaaagcactccgctagtcttggttaaagtgcagcttgtatacattctgaataaaaatttgcattttgcttttcttttcctttttgtatttctgaggctgcaaaatacatcttcacaagagtggctttaatagttacctaacattccatcctgcacgtacatttcaaggcactgccgcagtgcaatatccaacatttaagcgtcaacgccaacagattggacctagcactgcagggactggaggttggtcaaggtcaggcggaggctgccaggctaccagggtggaggaaggcgccgaggcagaggccagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaacta

SEQ ID NO: 8 - DNA, 921 bp, Homo sapiens
agcatttcagggagcaagaactagattaacaaaggtggtaaaaggtttggagaaaaaaataatagtttaatttggctagagtatgagggagagtagtaggagacaagatggaaaggtctcttgggcaaggttttgaaggaagttggaagtcagaagtacacaatgtgcatatcgtggcaggcagtggggagccaatgaaggcttttgagcaggagagtaatgtgttgaaaaataaatataggttaaacctatcagagcccctctgacacatacacttgcttttcattcaagctcaagtttgtctcccacatacccattacttaactcaccctcgggctcccctagcagcctgccctacctctttacctgcttcctggtggagtcagggatgtatacatgagctgctttccctctcagccagaggacatgggggccccagctcccctgcctttccccttctgtgcctggagctgggaagcaggccagggttagctgaggctggctggcaagcagctgggtggtgccagggagagcctgcatagtgccaggtggtgccttgggttccaagctgagtccatggccccgataaccttctgcctgtgcacacacctgcccctcactccacccccatcctagctttggtatgggggagagggcacagggccagacaaacctgtgagactttggctccatctctgcaaaagggcgctctgtgagtcagcctgctcccctccaggcttgctcctcccccacccagctctcgtttccaatgcacgtacagcccgtacacaccgtgtgctgggacaccccacagtcagccgcatggctcccctgtgccccagcccctggctccctctgttgatcccggcccctgctccaggcctcactgtgcaactgctgctgtcactgctgcttctggtg

SEQ ID NO: 9 - DNA, 904 bp, Homo sapiens
gtgtttgccattagcatcaatcatgccataaccagaaaaattacattgcattttttattttaaaaaaggtgggggccagagtggacctgggcctcttccaacttctgagaggtctctattactaagtaagccttaagaagcagaattccatgaagggagctaggaaaccaggattttccaaaaggaggtggcatttgcattgatcctggtagggcagcctcgaattccacggggttggggttgcgccttttccaaggcagccctgggtttgcgcagggacgcggctgctctgggcgtggttccgggaaacgcagcggcgccgaccctgggtctcgcacattcttcacgtccgttcgcagcgtcacccggatcttcgccgctacccttgtgggccccccggcgacgcttcctgctccgcccctaagtcgggaaggttccttgcggttcgcggcgtgccggacgtgacaaacggaagccgcacgtctcactagtaccctcgcagacggacagcgccagggagcaatggcagcgcgccgaccgcgatgggctgtggccaatagcggctgctcagcagggcgcgccgagagcagcggccgggaaggggcggtgcgggaggcggggtgtggggcggtagtgtgggccctgttcctgcccgcgcggtgttccgcattctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgaggtaattctgcacgtttgcccgcgtgctctctgtgctctgtcgcaaacctctttggccggagccgacttgttctctcgtctgctct

SEQ ID NO: 10 - DNA, 909 bp, Homo sapiens
cgcctggtccctatttacttctgtcttctacctccaggagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgatgctcctgtgtctgaccgggtttgtgagacattgaggctgtcttgggcttcactggcagtgtgggccttcgtacccgggctacaggggtgcggctctgcctgttactgtcgagtgggtcgggccgtgggtatgagcgcttgtgtgcgctggggccaggtcgtgggtgcccccacccttcccccatcctcctcccttccccactccaccctcgtcggtcccccacccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgaggtgaagcccccgccaggcccagagcccctgtggccccctcccttcgccgcggcgcccctgcctcctttacccggtgccgctgcgcacctctccgcatctctgg

SEQ ID NO: 11 - DNA, 1100 bp, Homo sapiens
taaaatgtgcttcagggaaaacgcagattggtggttctgataaaatcttaataatgaaataattttaaaaagcaataatggtaaaaataaatcccatttattatctggtatgtccccggcattgtgctaacacagatagctctactacccatgtcacagcaactgaaacagataatatgctcctttttcaggtaaagagacggaggctcagagaggttaaacagctcactcaaaggcacagagccagtacatggcagtacatctcttctcccggggccgccgtcgcggtgatactatttagggccacacgtcccagtgttcagctttcgtatttacgtactactgtttggcaagcggggactcctgaagctctctgaccctggaaaatgcgtggcttgcgtcacagaggagcgtttctggaacgcgctcgcagcacgacaccgcggtgtgtgcaagcggaacgccgccctgtccttgagccttttggctgagattgggagggcagaggaagcaggaaggtgggatttgtttcaaaagggtgcgggaaggggacgctccataccgcctcgcctcttagtgtccccagtcccatcacccgacgtgtacggggacggccgacacgctcaccccacacctcgccggctggggcgggatctgggcggcggctgcggcctggcgcgcgctccgcatctccttcctcgggaggctgggcgggactccggcgagggggcgggccccgcaagcgcccgccccttttctctccccgcctccttcccgctccgcgtcccgcccagcggcgcagggggccgggctccggctaggagggtgggggccgcgccggtgacagccgatccccgcccctgctgcccgccacgtccctcacgtaccactcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgc

SEQ ID NO: 12 - DNA, 1041 bp, Homo sapiens
cctatcagagaccaaggacaggacctccctggaaatctctgaggacctggcctgtgatccagttgctgccttgtcctcttcctgctatgtcatggcttatcttctttcacccattcattcattcattcattcagcagtattagtcaatgtctcttgtatgcctggcacctgctagatggtccccgagtttaccattagtggaaaagacatttaagaaattcaccaagggctctatgagaggccatacacggtggacctgactagggtgtggcttccctgaggagctgaagttgcccagaggcccagagaaggggagctgagcacgtttgaaccactgaacctgctctggacctcgcctccttcccttcggtgcctcccagcatcctatcctctttaaagagcaggggttcagggaagttccctggatggtgattcgcaggggcagctcccctctcacctgccgcgatgactaccccgccccatctcaaacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaa

SEQ ID NO: 13 - DNA, 1035 bp, Homo sapiens
tctttagttcaagccgaaagcacccttaaaaatcatctagcggccgggcgcggtggctcacgcctgtagccccagcactttgggaggcagaggtgggaggatggcttgagatcaggagttcgagaccagcctgggcaacatagcgagactgtctctatttaaaaaaaaaaaagaagaagaagaagaaaaatcatctagtggccaatgtcttcattacagatgagaaaaccgaggcccatttaaataccaagtgacttgcccatatgcagttaggatcccacaccagggccaggagtatttcacgttttctgaagcgacacgacaaactctcatagaaagcagagcttgcagagcttaatatgttgcacaagggcctcaccattccagagataccgatggcaactgaaactcgggatttggaatcttggtacagctatgaagtgaaacaaaaccagctcttcagtccttgaaatgaagaaaataacgagtggggtaggggtctggtgccctctgacaatttagtgcacccgaaatctctggggaagaacccacccttcacggcggggcttcacggacacgaaggccatcggtgtttttcacctactggggagaagggatatgtgctctctgactccttcaaatgttttctacagcagagatggcagtcgagattaatacacacgcctcgtctcactccagaacacaatgactcaaaaccgcacgacgtgtacttttggaaacagctccgcgggagagcacccgggacaatccccaaaccccgttgcccgcggggtggggccgcggacgtgcgccacgtcgtgtgcgtcccgggcgtgcgtgcggcctccagtgcgcgtgcgcgtaccctcctggggcgtgctcgcggctataaggggcggaggctgggcggcgttgctctgcgctctgcggctgacggcgcttttgtctccggtgagttttgtggcgggaagcttctgcgctggtgcttagtaaccgactttcctccggactcctgcacgacctgctcctacagcc

SEQ ID NO: 14 - DNA, 1014 bp, Homo sapiens
atccttctggaaagacgcttagggagagtctagggagcagctctgacgtcagtagctgccatcggaagtcaggtcatgttctacaaaaagcagtgacgcacgcccgacagcacccgcggggccggacagcggcttcaccagccccgcgggtccgaatcgcacgcggccgggtccgctctcccgggaggagagcccggcgtggaccagcgtgacgaccccagcgtgctgcggcctctccccgagggcccctccacaagggtccctgcgcgggccgggctcggccgttgccactcgggacagccatcccctcgagttcgcgctcgccgtccccgccttcacctcccgggttgggaggcgggcgactgcgcgcgaggtaaaggaacttgcgttccccggcgccgaggcggcagcagcgcagtgcacagcggcttctgaaggcggcgtcgacggggagctgcgcgtggctcccagtttcctggttacgtgcgcgccggcagagccaaaacctgcagccgaaactcccgcttctccgtaaggattaaagggcgggcgcactaccgggagacgtgtcaaactcagcgcgcctcatggcggccgcggagccccacccgctcctactccagtcctctcacgcccactgacttaccctgcgcacgcgcgctgaggctccgtggggccgccgcgggccccgccccgaggtgggagggcctgacgcatccacagctggccaatcggcggatggcctcgcgcgcccgccccctccccctgcccccggcgccgggctccacgtgccagtgtttgtgtacgtgcggccgtggcggggctggacagggtccgggtcgttgaggattaggctgctcgggcgtaaccggagctggggcgcggctgccaagggccggcccggaagtcccagcggtctttaaattctcccgtgctagggccagcctgcgcattcttacctgtcggggtgcggcgagtgtctcacctctctgcacttccaaggactcttgtcat

SEQ ID NO: 15 - DNA, 929 bp, Homo sapiens
gaaccaggtgtccactctttttggcccatggcataaagaagggtttgggcaacccagtgtgccccaggttgttaccgcccccccgcctccgcccccacccagcctttgatgggcccccttctcatcaatccatcacccctgcacatgccaccaggactgcctggaccagagcccgggactctctgaaacccactgagagctcggccctgggaatgggcctcccaatctcggtctccagggggtgggccccaggtccctagtcttcctcagggtcttctccactgttctgcctcctctcctgatacccagttcctagccggggtgaccccagcctcccgtaacagcctccttgtggtggtgctgggaagaaggggcccgtgtacccggcagggccccccaggcaatgggcatgagcgcaggcagggaaatccgtcagcctccagggacgctctccctacagccccggcgaggggatcgggtcgtggcgacctctccagacgcccaggggctgggcaggagggcgggccaaggcccgcaggtgggggcgccaaagccaggcgggcgcggagtacgtgcggtgggctgcgggcggcatgaagggcgcgggcggccagctccggctccggctccggctccggctcccgcgaggccgggtagcctgggcgttcccaggggtcgcagaggacggcgaaccccggcggagccaccggagctggggaccaggacgcaggcaggcgtgtggagcgtgaggtggggacgtggcggcggctcaagtgggcggagccccggcagcggcccgaggcggagtcgccaagggaggaggcgccgagctgaccgggcgacgccgcgggaggttctggaaacgccgggagctgcgagtgtccaggtgagcgccccgcccgctcagccgccagatcaaccttagcgct

SEQ ID NO: 16 - DNA, 1087 bp, Homo sapiens
tgaacttcctaaacccaccactcagctccagtagtaaatcgttatacagtgagaagggattgaaggggaacagaagttccccaagaccagttgggaggctattcatagtcttgggcagagagattacagggtcttgggtagggtggtagagttacaacgaaagagaatgttggcctcaagtgatatttaggtggaaaactggacttggattgtcactagctagtgtgactgagataagtctcaagccttccctgcctcagtttcttcatctgtaaaatgggctagaaataactactgttattttgtatacccagcacttagcacatgggttggcacaaagatggcacacacaaacatcatagtcactattgtgattaatagggaagctcatacacgccggcagaatgaatattctgtcaaacttggggttgaaattcgccatcttctggggcaggaaagtgatggacgactgtgcctttgcaagaatcgacgcccacactgcccaggaagtgccctcgcgggccggggtcccagcccggaccagccccgccccgccccgccccgccctcatccctgggagctccgccccgaggccgcgcgcgccgccgcgcgcgccccgacgcgcccagctgctgacgtgcggggcggaacgcgccgggcgggctccaccgcgccgtgtgcttccgcaggttgcgggggtcgctggggccttgtggcggggcagctccgcggggcttcgcccgctctctcacctcgccgtgctctctcgcggcggccggcggggcccgcgctgcagccggagacccggagaaagggtgagtgttggcgggcgcaggaagggaccggccgggagcgcgccccgctctccggggcattgtttgggcgggggcggcgcgggcacgtgcgcgcccctcccccatcggcaggcagcgcggcagcgggacccggtgaggccccggggccgaggggagggcagggaggatcccaggtgcgggccggggagccgcagaagcgggagcctggaattggaacgtgagttgggggcttcctcttcagcggggcgctgcgctgaggggatacgggaccc

SEQ ID NO: 17 - DNA, 1079 bp, Homo sapiens
tctagggagtcctcccatcctacgtaacttcctctgggaaagtagaaaacacggcacctgggaaggggcgctgaaccgtgccccaagtcccagtgggcctggatgcccaagagcaagaggaggcccagaggatggggacaggccacgacctgtggcccaagtcccgcccagagggagtgcgccctgagggagagccaccggagctggtgactcgggggcgggtgctctggggtgtcgctttgggttcagcaatacaaatctgccagctggagattaggcggggcacgccggggagaggtgatgcactgccgctgaagacccaggtaggccggtgcgttcggcctgggtgaggaaggcgcgggacccgggtgcgaggactgcgtagcgtccccggctcccgcttccgcccgctttccacgcccacttctgcaagtcccctccggcacctcggcgtccaccggactcctaggggcgagccctcatttccgaggaatgggaccgccttcgtgcccccggggctgccagtccctagactagccctaggggcttctcgtcccggcggagccgggcggtgcctcctgcctgcgcctcgcacctccccgcctggcacggcccacccgggcacggcgccgccacgcgtgaaggcccgcatcggctccctacgtgggggacgtgcaggatgatgcggggtcgggggggatttcgctgcgtcgcccgccccctttccggcgcaggagggagcggccgccgcgtccccgctccccggccgggacgccaccgccgggcgttgcagaggcgcgccgcaaccaatgggcgtggaggaggtgggtcggctggcggctgtcaccctccaggggacgggagcgcggagaccgggagcgcgcgagctgtcgccgcgccccgggccgagggggaggagccgggggaggaggaggaggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaa

SEQ ID NO: 18 - DNA, 1066 bp, Homo sapiens
ggtctgtgtgaaattccagttccaaataattcacatgaatggttcacaagaatccaggtaggtttgatctagttccctagatgggaatgagagggatgtaaaatttgagaggcaacatgacatggactagagagagaatgaattaacactggggaagcacgtgggggcgcgccggacacctagaaggcactcaaaaagtatgaggtagaattaaaggaaagtgaaccttcctttggctgtctcggcctgattctcaccgcagcaaggagaaagggacagggtcaccttggcgggtgccaggcggagcccggccagacgggcgcggctggagggcagcgcgcaggcgcaggcggcgcacgtggccccggacacgcagcgctgcggcggggccagcgccccaaccccggagtggggccgaggcgcgcagcctctcaacgactcgacgccaacggggtctctcggatcgcggcgcgaggcaggaggggcggggcaggagggccgcggcaggcccgggccgccaaagttgtcagcaaggtcgagggccggacgtggggccccagagcgacgctgagtgcgtgcgggactcggagtacgtgacggagccccgagctctcatgcccgccacgccgccccgggccatcccccggagccccggctccgcacaccccagttcggctcaccggtcctatctggggccagagtttcgcccgcaccactacagggccgctggggagtcggggccccccagatctgcccgcctcaagtccgcgggacgtcacccccctttccacgctactgcagccgtcgcagtcccacccctttccgggaggtgagggaatgagtgacggctctcccgacgaatggcgaggcggagctgagggggcgtgccccggaggcgggaagtgggtggggctcgccttagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctaggtaat

SEQ ID NO: 19 - DNA, 2929 bp, Homo sapiens
tgaattcatgacaagctggactccagggtcaggtgacggtgacacattctccaccccagaacctgcccagtgacacacaaaggacagaggccctacctggggctcttccagggcatgacctacacccacatcctgccgaggccaggctcctctcgcctgtgatgactcagcccaggaggtttgctctgttgggaattcccctgcttggggcccgaggggaaatggggcctccagccttgattggcgagagcacgaaacccagccaggggccctggctccccagccagccctgagactcacgactcagtaactctgagcggtcgccttgcccagttgccagccccaaagccagtggatgcactcggatctcagtgctcccagaatgagcccttctgccccgatctcagcccgtcctctgtgactctgtggctgtgtgtggccttgtctccctctctgctgacttccaaatatcctcaggatccacaaaaagataaattttaatgagctgcatcaccacccagagtgggcctgggactgagccagagctgggaactctttgttgaatggaactcagtctgtctgtttcctcatctgcaaaatgggaacagcacacccgctgcttccatcaatggtggcaggagaatggaaatgaggagaggctcggcatgactttgtgaacatttgccctgcacagttgttagaaactgtcatcatcaccagctccctccacctccatcaacctcaacatcccggccaccattgctgctgccattactatgcagagacaggtcctcgtttagatggtgcagtgggctttttcccagtgctttattatcctgctaaaaacattctaacaatggcaggtaactggaggccacacatgcactaagtatgagggtggccgtgacccaaggatcctgggaggtggaagcccagggcctcatcaagacgacagggctggagacagctgaggtgagcctggccccaggctgcctccacctgccggctgtctctccttctcaggaccaggcactaatgcaaaggacactgaacccagcagctgtcagggctgaggaggggccttggctctgggatctgttggacactgaatctctccacagctacagaaacagtgtggacatccccagtctggtcctggtcccacttctccattttgcaaataaggaaactgaggcacagagcggggatggggcttgtccaaagtcacagggacagtcagtgtggaggtcggagagctggagagaggacgaaaaggcaggaagaggccaggccttcagaggacagggtggcatcaggagctgggcggacagtggtagtctgaacctctgctccactcgctgtcatgctgaaggtgaccctgcacagttaagtcccctctcacagcctccctgtcctcatctgtaaaaggcacccccatctacggttgatggatgtggataaatgaggacacatgcaggcggtgtcctgcccaccccagtgcgggtcagtagaaggccagaagcaggggatgggagaaggcaggtgggagggcgtgacagcggcgaggatgaggaaggcagccaggcctgcaggcagccctgagagcatgaagcagaggggtgagcaggttcccctcctcctgccacccttgctcctctctaccaggctctggccttgctggggtgtacccacagaatctgtaggctctggcctagccagaaagagtgtgggtgcttctcagggtcataattaccccatgccccacagggtgtgagtcactggtagcagagtcctccccaatcccccccagaagagtgtggtgaaaggcccgggccactggggtgtcgagagtgccaggcctgacctactgggggtggtgtcagtaggggccatataccctgttctcacgacaaccccaggccaactcagatttgtggagcggccatcccacctccttccggctcttccaccctcacaggagcctggtgggtcgggaaaactgaggcctagagaggcaaaatgatgataaaatgaagagtgagtacatgtggaacaccctctgtgcctcacactccactaagctcctcacaccattcacttactcaggcctcaccggccctcgagcacaggctgttttcatgccaccttgcaggagcggggactaaggcacagaaaaggtcaacctgtctcacgtcacacagccaaggagtgccagagcccagatgtgaacctgtgtctgtctgactgcagccctggttccgacgcccttcctcatgcatcctataataacactatagaggttactatagtgtctgctcctacccctgggacaagatcccctaatgagctggcaggtgggcgtggggggcacaggtacagcttggcttctcagctttgctcccctatcctctgctttgccatgaatctctcatccagccccgcagggatctgcctggccagcagtgagcctgagcccctttcatcctgggacctgccgaccacggctcacatcctcctgggtgaagaatgtcaccttgcttcctatctgcctctttcgtggttggctggggagggggaccggggggtggggtgaggttaacctcattgttgtcttatatggtcatttaaatctcccagggcttcctccaagggccaaaaataatccggagacacagcagctgtgtccagcacacagaggacccggccatctgctttggttcagagccctgtgtctgtcagtcagtctctccctggctctccctccatcctcattcctgcctgaagccatgacccgcttctcctatgcagagtacttttccctctttcactcctgctctgcaccctccaggtccactgcacctcctgagagttcgccggcccgggccccaatgggcttgttccaaggggtcatgcagaaatacagcagcag

SEQ ID NO: 20 - DNA, 1859 bp, Homo sapiens
cccaggcttaagtaccatgtgtcatgggggattcagagggttcaacaggtggggggcacgctgtcgtggcaccctggtgacaacaggagaccaaggaggggcaggtcacctggccctgggcatgagggagggggctgcacaggcactcaggtccccaagctgtgtctcccaggcactctcaggcgtggggtgtaaagatgctgatgccagggttccccatgaacacagacccccctaaacaaggtaaatggggtccacacaaaagttgtgggggatcaggcccctgccatgaggtccccaaggcccttgggagatgaggtcaatgcggggaggaccgggagaacccccgtcctctgacatggtggctgcagtaccagccatttgaggagtgggttacatgcccccagacttccaggtgacgggggtggccacccagacacttcaagacatggggttttcatcaccaaaatccagatgcagattctcagaggataggaactgagcccatggaatcagcaccagccatgttcagagggtgcagacccccatgcccaagacggagcagagcctcccagaggctcggtgatggggtgcagcctccacggaggctcgatgatggggtgcagcctctctggaggctcaggtcatggggtacagcctccccggaggctcaggtcatgggatgcagcctcccagaggctcggtgatggggtgcagcctccccagaggctcaggtcatggggtgcagcctcctcccagaggctcggtgatggggtgcagcctccccagaggctcaggtcatggggtgcagcctccccagatgcctggttgatggggtacagcctcccgggatgaagaggcacagacagtatgcatgaaaggtgagtgtggcacacacaagctaagacacagagaatgggcatagggcatcccaaagcacagagaactgtggcaagctgagttcccccatccccggccatcccgggccccagctgatgagggtgccccagccctgcagggctcagcagctggggtcagagtgggtggggcaaacacgcgctcacccagcacacttttctttgtgtgccagtgactcctggctccccagagccagcgcttgctttgcagtccaacctcaagcattccccaggcgacctcagaggaagcgtccccatccaggagccccaccagggtctccatgaggctgctggctgccaagccaccgtctcggggcctcgggactggcctcgggctccagctctgtttggttttctccttcctgccctggaacctcagacgccagtctggctgtgaaggcgcccatatactggggaaagtacaaagcccctacacagctggctgcagagaaccgcgcgcagggcacgtagctcagctgtaccctggggccagcgtcgagccaccccctgcatgtgtccccttgcttgcctaaaagccccactagggcagcctctggcccttctcatcccagattgagtcagactaggagacagacccataccctgtgcaaacaccagaaggacgtacaagtccccacacgcccagggccgcgtgtgaccggacgggcccagacgtgcacatgcatgcccacacgtcctcctgctgtggcccgaaagcatcctcggagcctgggctatgtcctccacacttgctgcctgaccagccccgtggggccggccccgctgggacaggttttcccgttaagcattaaccaccagcagataagggctctgagggaacgccctgacctgggatggctgctcctcggtaggcccaagtcatggatctgactagagtgaccagaccagactaactggcagagcagagggagaggagcttag

SEQ ID NO: 21 - DNA, 1652 bp, Homo sapiens
gaatggaggaccttctatcctggcctcacagatgccatctgaggtccttttctcccagcctgaatggggaagctccctctggcagggttcttacatagtccctgagtttctcagccacatctcaggatcctaagctgagaccctggccctgggtcctgtgtcacatcctcttatgtggcctcttggctgggacagacctcatatgactggcgtactagaaaggaccctgctcacattattacagggccgtcttcctggatgtgactgtgccctaaagcagtcagcgtaatggagtgattcaacccgagggccagactgacccaggcatctcaacctcaacactattgatattttgggtctgataattctttgctgtggggacagtcctgcaccttataggatgtttagcagcatacctggtgtttagctatcagtagtgcccccaagttgtgacaaccaaaatgttcctagacattgtcaaacgtcccctggagagcaaagcagcctctagctgaggacctctgaacttgtctatggggacagaagttggaagagtggttacaccaggggtgtggagtcaggtaattgactgggaaaaggtacaaggacctttatggaatgctgggaatgtcctgggtggtgtttacacaggtcgtgcatacccatgcgtgacatcaagctggacacgtgatctatacattttactgtatgaaaaatgtacctaaaaaatgcaccttagcgtcagacagaaccagacttggatttcagtcctgattctgcccttaaggttcattttcctcatgtgtaaatgggggcaatagtaggaccctcctcctgtggctgctgtgaaggttaaatgagatgatgagtgtaaagtaacttcacccagttcctgcctatggtgagggctcggagaatattcgctatgataatggacagggccacttcctctttccatgcctgagtttccacagctgtgtctgatggtccctaagatcccttaaggtctctgtcactgtgactttttctgatggcctcggagctatttctttctcagtctaaatactttcaaggcaggtgattctatcgaaccaagcaaagtttgtcatcagagttgctggggcccctggagtagatgaagtgctaagaaggatccaggacatcccagtcagaagttttaggtatagaaaaaaggaaggtcgagggctacggtgaccttgcaaagcacagagccactctgcacccaccactttcctcgcagaagctcctggcaggcctccgcatctcaggtcccgttctaatactgggtggggctcagagcctgcacagtgaactccttaagtggaggtgaaacagaattcacttgtcaaaagggcagtctcaggcagaatgctgtcccctctgaatcattctttttgttaaggattaaaaaaaaagccacccccaaaaggcacaacccaccctggagagatcagagataactaagcttgtgggaaacagaagtgtagttggcaccaagtcagagggtggggaagggaggagagaagataaccagcccctatggaggtgtataaaaggtgtccactctggggaagagccacagtcctcggcccaggccaagcaagcttctatctgcacctgctctcaatcct

SEQ ID NO: 22 - DNA, 1467 bp, Homo sapiens
gctcatacctatactcccagccctttgagaagacaaggtgggaagattgcttgagactgggagttcgagggcagcctggacaacatagtgagattccatctctacaaaaagtaaaaaaaaaaaaaaaaacatagctgggcatggtgttgtgcacctacaatctcagctacttgggaggctgaggtgggaggacagcttaagcccagaagttcaaggctgcagtgagctatgatagtgccactgcacttcagcctgggcaacagagcaagaccctgtcgtttaaaaaaaaaaatgaggacaaaaattggaagttgaagatattttggccattaatttaatcgtttatttaacctgggagaaaaactgccactgttttattttagagcaatgcttccacatggcaacacgttcaattgcgtttttcccaaaccatgttactttccaaacgattacaagtagtcgcgaagggtggtcacactttacaaaaagtgtaattaaattatagagtcggctacatctcagtcactggcccattcctggtcaactgacaagtagctgtggtggcttctagtagcttgttacaagtcatcaagtcagtatgagtgttgggggatggaagctattgaaaacggtgctgacggcccaaggagtagcaaactgtctcatgaaccgtcctgagccgactcagtaaggactcaatagagaaggacacttcatttacttccctgacaactgcaataaagaggttttagagctcgctgagggatgctgcctgggcaagggaaataaatgtgttgtaacatgaaacggtcccaatcaagcaagtcggggccctctcgctgtcgccgacagtccagagcaaggaagtacacagcagtcctgaacctcagttttctgcaaaccagaggcttgccactgagcctatgtgacccgaaagctgcagaaaggagaggctgtgcccggcacacggaggccgcctcgccagcctgtgctcccgaccctgcgcctgccgccccggactcacctggcccggggccctgcgggtccttcagctgagccttgaaccgcacgcccgtgagctcttctttgcgggcgcgcttggctgcacccgcggaggaagccgcgccgtcctggccgcccgaggccttcctcttggggacccccatggccgagagggcggaagcgcgacggaaacgacacacctgaggggacccggcaggagcactggcacagacagcagacacgcgcttcaggcccacatggcgcaggaagaggcggggctggcggaagaggcggggctggcggaagaggcggggctcggggaaaggccggcggaaggggccgacccgcgcgaggctgggaccggcggaaggggcgtggcctgcagaaggggcggggcgatagggatccagagtcttggggatccagagtcttggggctccatgtgagtttgctgtaccggttgtc

SEQ ID NO: 23 - DNA, 1335 bp, Homo sapiens
ttgtaactggttcttcaaggggagaagcaaatgtgtccctgaaaacttcagctgccgcgtttggcaccaggtttgattgacaaggactggcggagggaaagcgcggaggctgggctgggggccgcaggccgaggcagagacaaagaggtttcgcctgtccccgagagtggaagggcccctgggggtaactagcctttgagctcaaaggggcatttcgtgaggtcgccttttggttcggagagcgcgcggcgatcgggtggagggggcctggcgggaagaaagctggggcggggaaggggcgcgggccgaggtgggagcggagctgcagtcacgtggccgcccgccgccgcggagttggggctgttcttccgggttggaggcgcagcgccgcggggcccaagcccgggtctgccagcgcgacgtcctctcgcggccctcagggcacagcccaaggctgtcagcctcccggcccaggtgagcgcgacggcactggcgggtgcgggcagccggggcgcgcgcctagggcgcagctgggaaaggggctcgggcctttcctgaagaccacggccctcgccgggagagagacctgtcaaagagcaaagcggggcggggtcggcggtgtcccgggcgcagggtgcattggggtgtccgcaggccgcaggcttaggtggggaagaagcaccgtgcctcttggtgtccctttctcgtctcctgctggggcgatgtcgaagggagtgggctggtggatttgggaactgggtccccgaagagggcagggaatgaggcggcagctgtgcaggtgcagatatttgcagctttgggggacagcgagagtcgtacggggtcatttcggccctcaagatcgggggtggtggagagggaggtcatagaggactttcgatgggcggttcatccagagaggtggcagctggatgcccttgaggtatgcttgacccttgagggagttcggagagggtgtccggctggggacataggagattgcgagcacaaattgtgagtgtgagttggggcggtctggcggtggtgggtacaagtttctggggcctaggctggtgaggaggaagagacagcggagagggcgacctgggcagagctagttcaaactcaacagccggaatgactatttgcagccgtggccaatcggcttcctagggaggttataaatagcggtctcgtgcagatgccagcgggtggcagttagttgccgagcaagggacggcaccggtggcagtagccgtgacaccagtggctttgggtgaggtcacggcgcctgccagccgaagctggctcagtagggtattgtgtccttgctgg

SEQ ID NO: 24 - DNA, 1198 bp, Homo sapiens
ccctcaaacactgagaaggtgaccgcggagtggagaggcctggggctacggacccctgccacaggaaggacccacccccatctccggacagggctacctcagccccagctctgtccgggccgaggttctaggaaccctgaaaccctggcccggccgcaggtctcccaaggccggcctgcttttctggccctcaccagtgccagttgttgacgttggtggcgtccgcccgctcctccacgatccagcgtgggtctccctcaccccacttggccatcggctctcctatcgcggcgccaccagctccggagcagccgtagccacagcctcaggaccgcttagtgccagccgcccggcagcgcctggaaactactagaagcggccgcaagcacctcctggcttgcttttccctccaccccctcccctccttaacttccggctcctccccactcccaccggttacttccgtcccaactcgccgcaccgtgggttccgcctgatttagagatccttcagactccatcgggttctccccaaaaagcgtcccgaaacccaactgctcatacaaccattcctcacccataggaaaacaaagaacacgtctcattgcttccctggaccctaaatcgcccttgctgagcctcatgggaattgtagtcttgctacgtgactcgctggataaccgcggaaggtctcgcggaaaggagaggaaatgacctagcacggtgcttggggtttctgggggctgtagtcaagaagccttgtggttcgtcgggacagcgcctgacagcagaggcagaagaaactacgacttccagcatgccctgcggtctcgttattcgtgttttctctccgccctacgattattcccttccgcccccttctctaagctgcacagcctgaatagaagggctggtccagcggcggcggaggctggcgctgtcctgagagggagggctctgtgcggaagaggtgagggtgtcccaagccccttgggtcgcgtatctggctggatccagcctctccgcatcttgatcttttcccctcttctaggaggcatccctacaccctatgactacaggcctgattctcttctttcagtcagggcgacccttgggcgctggagtacgcttgggactggggctgcgagtgagcaccagcgattggttcggaagcggacatttggttcagaacgagcatt

SEQ ID NO: 25 - DNA, 1171 bp, Homo sapiens
ttaaacagctggcagagaaaaggcagccctggaggaaaccaacagacaacagcagatggggagaagaggaaagagtggcgttaccgggagtgaaacgaatagaggagccagggaggatcagagggagggaaaattgtgtggaatgcggtacagaggtcagaaaagagtccatttgatttggcggtaggtaatctttcccagagcagtttcggtgttagtggttcaggcgggaattccaatgcaagaaaccagtgaacgaatgagagagtgagtagggaaagtgaaggtgagtacgttaatgaatgaataaatcaagtctgtaccctctcttgcccgggggatttccagggccaatgtcgcactttggtgaggaggaaaggcctggtcacggcttggggtgacgcctaggaaactgtcagcctcgcaaacccataggcgcagccccaaggtcagggtcacctcgagcctccagacaactcgtcaccttgacgaccaactgaaaaaaccggaagggatggaagcagcggatcatctcgcgatatctggagcgtctgcgcctgccttcctgacctgggacttgtttccagctctcgcgagactttcaggggtcggagcgcgggggccggccgagaggaaagctggaggcgcgggtggggaacatgtctgagtcggagctcggcaggaagtgggaccggtgtctggcggatgcggtcgtgaagataggtaaggggcttttcgccccagcaggcccggccggtgcagagctgctggctccaggctgcgctgcccaggaggaaggaagggaagccccacgggaggtcaggcctctcggccttttccggcccctccggccagggcgagccgcccgggccccggcgggaggtcactcgggcggcgggcacagacccgaggagccggagcagcagcccgggtgcggggtggagttgcagcccggaggaggtggtcggggttggcaggtggcaggagagtcgcagagctcttgagtggaagacagtgtcggggcacaccctcgtgccggagccgcggggttctcctcccgggtggtgcattccccggcacgcggcggggaaccggctcaggaggccacgctgctccccggcggaaaccaaagtgccttctggagaaggtcacctggagcatttcatagaca

SEQ ID NO: 26 - DNA, 1169 bp, Homo sapiens
acctgggtgtctacctctccagtcgagagctctctgcaggctctctcccaacttcctgcacctcctcaccctcaccttacccgtggcgctcgggttttattcctgcccggcgcttctttcccagggcgagtagaggcttctgagtgaccggcccgccagaggcagctgcagagccggcgttccgcagggcagggcagggccgggccgctgggctggtccagtgcgcgcgggttccccctggcctcagccagccgcgggagatgccacttcgggcgacagcggcgagacgccgctgtccgcaactcctgggcgggtaggaccgtctgctgcctctgcggcccttggggcagactccccaggagtcccttcctctctcctcccgcccgggggccgggaccgcgctgtgcccacggagggaactgggcgtctctggcgcactggggctccagctgcatgatcccagctcagaccttaagcctcagtggggtgtaggtgggatgggatgtgtttttaggagatgaggagaccccggttgttgagtcgctccccaaatgcgcagtttcttaactccaggtgacatccgtcttttggaggaacgagtgaaggccgtttaggcgaaagaggggtgggtttcagtatttggatcccttcccccagctctgccaatctcaggtgtgtttacggtggaggtgacagaaggaaggcgcgtcgggggacccaggcctcgcaggtcttcggctgtcaacgaggcaccgcccactgactccgcgcttcgtccctcacagcgtggggctcggcgctgcgccaggcccgggtgcggggcggagctaggctgggactggctgggggccgccccgcccggcgcctgggcctccgcgccggcccccggggaggagttatgataatttccttctcattaaggcgctcgggtcccccggctatcgccaggacacactgttcgggcgcggctttccccgtccgcggagcggtcttgacactcgcggcggcagcatctacgctcgcagagccgccgatgcgtgtccagtgacccggacagcaaggcccgcgcgcggcgggggcggcggcagacgcctggtcaccgtgaccccgattttggatttaccgcttgggggctggggggatcctggatttaactggcgactgttttg

SEQ ID NO: 27 - DNA, 1138 bp, Homo sapiens
agtagctgggaacataggtgtgccaccacaccagattaatttttatttttttttgtggagacggggtctcactgtgtcgcccaggctggtctggaactcctgggatcaagcaatcctcctgcctcggtctgccaaagtgctgggattacaggcatgaaccacgggcccccaccaccacgttttaggaaatgttcacattggagtgtgccctctgtttccagctgggcccccgactggtcattgtggtctaatggagtgtggtgccggcagctgccagcgcctgccctctgagaggggtggcgaggggcacacaggaccagactgcccctactgttggatgactgggtaagtcgctttccttctctgggtctctgttttccaatatttaacatcttgttgtgggctaagtgaagtccaagtcccttccgattctaacatgaggttgtcccggaatatctattttgtgttctgaatttaataaccggctgtggagggcaccacaggcaaatctgtactgtgagtgggttgctgccactcaattatctgacagcagctgcgaacaggtgggcagtgtgttttccataggcagcgacgacttttggaggtggattcagaggcacaactaagccgcgcggcgcatcagggttcaagggcatggggctcccgcagctgtggctggggcagagctggggctggtccctccctccaggagcacagggcgggcggtccagcctcacgtctctcggcctccagccacacccggcccgcgcagtggggggcccaacagacttttccttttcgggcctcagtcttctcgtcagcaagggcggacaaggactcttctcgtcccgccagaggaggcgaccgaggggcctgagctcaggtacaggccggcgggctcaggaggcgcgagcgcggatcgaatccgcgggaggagcaaagatccttgatgcgcggccggagggcggggcggaggacgggacccacgcgattggtatcctgccctccgccccagccaatgagcggcgagggtgtcttgggggcggggcagaatcagcctttaagttgcagtgactctccggcgtcactgttgcgcttcatagacgccgcgtgtacccggttgtcctcaggcgctgtc

SEQ ID NO: 28 - DNA, 2624 bp, Homo sapiens
caacctgttgccaaagttacacatagtacaggtgtgtggttattgcgggaggagaggatgaccactggagtggccctttaaggagctcccacatgggcttcccctgacaaccactctaaagacgatttctttcttagggtggttttcataaattgctaccaatggcagaccccaccccagtcctttgcagcagtcattgctaacaagaccactgcttgagataattatattccatgatgtaagtcatgggtgcaaacagactagcaaagaggaatacatcccagtattacttttgaagaatgctcttcctgtctcggtatcactgccaaattcccagattagacagagcaggcttttcctaaagtcaaagctttaactttctttataacttcagtcttcacttcctcttgtggaagatcaaaactgctggttcccatgtttttgtcatagtctcaaagctatggtttagtttgtgcaacatgggcctgacatcagtctgccacacaactatgtagtgaacatctgtgtactaagcattgaaagatacacaagtgtatggtgactgggccttgctctcaaagggttgaaatctgagacaataaaatattcacatgaaagttaagaatatatgatgaaaagtcagatgggccgggcgtggtggctcacgcctataatcccaacactttgggcggccaaggctggtggaccacctgaggttaggagttcgagaccagcctggccaacatggtgaaaccccatctctactaaaattacaaaaattagccgcacatggtggtgggcacctgtaatcacagctatttgggaggctgaggcaggagaatcacttgaacccgggaggcggaggttgcagtgagccaagatcgcgccattgcactccagcctgggtgacagcaagactccatctcaaaaaaaaaaaagtctgatgaaaaatatagagacaaaagtcacctgtgtcagtgcctgaagtggtatagggggaaaaagtcactgtggaaattcaagaggagaattttataagtaaattatatctcaagttttaaaaactcaggaaaaatggctggttattaaaagccaggatttcagtaagtgagaaggaaggctaacgacagtacaagacagtgaggagttgagctggttttatcatgtcggcctggggagaagggaaagccaaggtggcttccctgggtctaacatgttggtccctctcctctccccatcctcaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaatggggatttaaagtgtgggcgacatggaatgaggggtgggtcagtgatcttgagctcagggcagaagccaggaattaagaagggaaatgtttgtggtggggctgctatgtttcgtgccggtccgccggtccgccgttgcgctgttctgaggtctacgaagcgtttgcagccccgtcgccagggccggccagatctgggtgggcctgggcagcgctcgctgggcggtgccgatttctggcaaggggggcgcagtctggatgtaatgggcgaggcttagcagggcggaatgggcgtggcccgaagaagccccgccccgtcccgcttagacaatgccccggagccgccagaccgtcgcgcccctgccccatcgtagtatatgagctcgcctacacaaggacccgcgctaaaagccagagctcccagtccccgaggcttgaagacggggactcccttctccaccaactctgtcctcggggggtggggccccagccgagatcacagcgcgacaggagtgggggtggccgctggaggtgagtcttgcgtggggggccctgaaccgtgtgggggccggagtttgggggtgccgggcccatgcctgcaccagacagagagtatggggagccggtatttgggcgcggagctaggcggggtggactttgggacatagacggggaaccgggtcctggagccgggagtagtgccagcgccccggaaccacgccccctgttaccccgcccctcgcatttcgttttagacctctcccagtccttcgggactcggtctggtttatactaggtcgcgctaggggcagcgtgaccagccagggcggagagaggatgcttaactccttaggctcgaactcctcccttcctacccacctctctcccttctcgttcgggtattcaggacttccattccccagcccctgcctctccagctttctccttctgtcccata

SEQ ID NO: 29 - DNA, 1199 bp, Homo sapiens
agggatttcgatgggaaactatcaggtatccatcttacattcctgacctggctccttctgacatatttttgttttctaatcgtgaaaaatctgtaaatggcacccatttttcttcagttaataacgtaaaaaagcctgcattttcatgattaaattcccagaaccctcaattctttacagatggactaaagagccggtatcatcacttaccaaactgtctttaacttgatggagcttacgttgaaaaacaaagtttatatttttaaattttatcttttaattccatttcccatgaacttttattcttttaaaaacaaacccaagtattttaattctacttgccttttttacttattacacacttcgggagattttttgccatatggaatcacctcatcccttgtcacgattgcataatattccatagtaggaatgtttcatgatttatttcttcattcccccactgatttcaattttctgcaactgcaagcattgttcataattctgtactgtttgtgagcctatataggagtatccgtgcacaaacctttttatgcattgtgcgagggttactctgagatagacaccaagggaactgctgggtcataaatccaattttttcaaagtaaatccgcttgcgaacccggaaccaagtcgatttttcccgccccgccagttccctgttcaggagagtgcagccgtgattggcgcgttcactcaggccaggggcgccccaggtctcaggtgctaggagcgcggtgacctaccaccctccgggcacgcgttctggccacgcctcgcggcccctttcattgaaagagcccgtagggatcacgtgaaagaacactgcagagtgcgtgacgtcacgacgctcacaccaatgggagcctctgtttatgtcgggagccatcaaatagtcatcttccccctaccatcccccgcccactctccgtcgcgctgcgctgcgtcgctttcagcctctggtgaagggcggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgag

SEQ ID NO: 30 - DNA, 1212 bp, Homo sapiens
ctgaggaggcaagaactgatgttgctgcagacctgtacagattcatcgctggtaactcagatactgagaggtgacagcatgctggcagcccttgcagccctcgctggttcttggcgcctcctcggcctcggcacccactctggccgtgcttgaggagcccttcagccccccgccgcactgtgggagccccttcctgggatgggcgaggccggaggcagctccctcagcctgcggggaggtgtggagggagaggcacgggcgggaaccggggctgcgcgccgcgcttgctggccagctagagttctgggtgggcgtgggcttggcgggcccgcactcggagcagccagccggccccgcaggcccggggcagtgagggtaattaggatccgggccagcagctgcggagggtgcgcggggtcccccaccagtgccggccctgtggcgctacactcgatttctcgccgggccttagccgcctccccacggggcagggctcgggacctgcagcctgggcaccctcccccccacctgtgggctcctgcgcagaccgagcctcccgaccagcgccgccccctgctccacggtgcccagtcccatcaaccgcccaagggctgagaagtgcgggcacacggggcaggactggcaggcggctcccgctgggaccctagtgcgggatccactgggtgaagccagctgggcccctgagtctactggggacttggagaacctttatgtctagctaacggattgtaaatacaccgatcagcactctgtgtctagctcaaggtttgtaaatacaccaatcagcactctgtatctagctaatctagtgaggacatggagaacttttgtgtctagctcagggattgtaaatgcaccaatcagcaccctgtcaaaacagaccaatcaggtctctgtaaaacagaccaatcagctctctgtaaaatgaaccaatcagcaggatgtgggtggggccagataagagaataaaagcaggcttccccagccagcaggggcaataggctcaggttctcttccttgctgtggaagttttgttcttttgctctttgcaaaagctcttgctactgctcattctttgggttcatactgcctttatgagcagtaacactgatcacgaaggtctgtagcttcactgctgaagccagcaagaccacaaacccactgggaggaatgaacaactccagacctgct

SEQ ID NO: 31 - DNA, 904 bp, Homo sapiens
cctttgaaaccctgaaacacaaggcgcctcctgctccccgggaggccgggctgccgagggctgaggccctagacagggcagggtgttcgagcctcagtgtccccgtttgtcaacggcctttcctgcctcttctccatggcggtggggtgagatggtggtgggaggtggggcggcgaaaaagaaaattccaggtctccgcaggggtccagaatggcaggacccccaagcagaccgcgccccttcaccggttgggggtctcggccctcagcggcggggcggggcctggggaggggccaggcggcgtggggcggggcctgtcgggcgggacctgacagcgtgggggcgggacttaccaggaggcgggacgtgcctagggcgcgagcccgtactggggccgggcggcgtggggcggggcctctcgggaggcaaaacctggaggctgggggcggggcctgtccggagtcggggcctgcctggagcgggagcctgtgccggggccaggaggcgtgggaacggggcctatcaggaggcaggacccggcggctgggggcggggcctgtcgggaggtggggcctgcctgggcgggagcctatgccggggctgggaggtgtgaggacggggcctatccggaggcaggacttggcggctgggggcggggcctacaaggaggcggggccggcgggggcggggccgggctcggcttctcttagggacccggcactcgtcgccctcagtccggctcagctggggctgggcgccgtgggtctggcggttccgtagcggtcccagcgtctgtcccgccggccgggcggtcgcggcacagccgcgggaaggtgtcggagggcggttccgccgcgcggcgggcgcgccgcccacatggcggccatcagggcgctgcaacagt

SEQ ID NO: 32 - DNA, 2270 bp, Homo sapiens
ctccttccaaagcaattctcctttcctactgccccgtcaggggccctgtctgtgctggaatcatcattgtcctcaactgcaaaatggaaaataaaatgatagtggttcctccctcccggggttgccaagatgattaaataacataacaactaagatgtatccggccccttctcctctacttgcaaggcatcgatcccttcattcctcgcaatcacaccacgtgaaggtgccatgaagccaccccattttgcagaagaggaaactgaggttggagaggtgaaagcactcagccgaggtcacacagctatgtcccactcatctttgggtgaccctcaggttcggaccctgaggtctgaacactgcattaagctctccagacagaatcaacttcggaactagcgccagagaccactaagtcaatcccaggtgacaccatcagcactcaataaatggtagccactgccggtgtcgcagatggatcaatgggaggtcaagcgttgtgggtaggtttggtttctttaagccactgaattaactggttatttttgcctgctggcagtgcagcctccattgtgtaaatgccatctcacttccaagacaatcaacgtgtgacttctcccagccagactagccaggtctcccgagacttcccggagggcaggggctgtgtctggagtggctgaattccccggctcagggttgcagctcagccagtttgttgattgaatgaatgaagaaatggctgaaagcaggggtggtaatgatgacctccttcaccctaggaagtgaatgggacccaggtcatctccaggcccagccagtatttgcagtggcaccccaagggatgctgggggaccccttagcttttctcttaagttgcagcggccaaactgcagcaatatcttccctgataaaagacacgctggtggtattgccccttcctcaaggcaggggctgagggcgcccagttcacagcagggtgccatctggggtagacgctgggtattgccccactcctgggccggggcctgggtcctgacctagtgctggctgtggctccaagagtgagcttctcctcccaaacagaagacggtcagtgcctctgaacctccctctgggctgggcacgcttggactcctccaaagagcttggaccagcctgagccacatccctgggcttgacttctccagaacaagcctcctggtctttctgggagagctctggcagcatcactgtgcctgtgcagggagagcgggaacccacttcctgcaccggctttctctgagttcttcaggatgaattcgctctggtctaggtaagttctaccccgaggccaccttcacttcccaaattccagcttttccttctctatccaaactgttacaaacacagtaacaataatttttaaaagctttttttttctctgaacacactaagtccctgctaattactgaaactccaggcattacaggaatatgtggacacttaaagaatcaggactacgtgggagagggggaggcagctccccagggtcctgggttggcacacaggctccaccactgtgtgactttcaacaagcgacttccttgaccagctgcccgctctgtaaaatggggagagtaatattcggccacactgagtcggtgtcaggttgagttaatatttggagagtttctggcacaggtaggtgctccttaagtgcctgttaaataagtgaagctttgagaaagtgtctaaaaggcgacacactaaatttttaagaggctggaggtgggccagggaggggaggtctcttatgtaatattttaatatctttttaaacctgaagaatgtgttcttgtagcactcctgtaattaaaacttaatgaactaaaagtacacccctcctgctcataccccttttgaactccgcagccgcgccccccagccggaggccccttgggcagcagacaatgggtgtggattcgccccaggtcccgccggctggggcggcgacaatacaccagtccccgacagctatttacatgacaagggcttccgggcgtgtctacgcgagttcccgtctttcctggtcgtcctccttgggttcgggtgaaagcgcttgggggttcagtgggccatgatccccgagctgctggagaactgaaggcggacagtctcctgcgaaaccaggcaatgggtgatccatcttgggggcttcctccccctttctccaatttctcttccctgagcccccagggaccttgtgctcctcagaagataggctagcc

SEQ ID NO: 33 - DNA, 2229 bp, Homo sapiens
ttttccagtgacttctctttggggaggctccccagccccttttgcaaatagatccttccagataagcccagacatactgaatcccaagtggaggctgctatggctcagggtcagacattgagttcccagtaactatttattagccattcactatgtgctaaacactggggttccaaggatgatggtctcctctcatcatggagctgccttgggaatttagacaagagctctttgagcagtgatggcctttaccccaaggaggggtacctcctgctcaaaggtaataccaaaggtgccaactaatcactgacttggcagagaacctctctcaatataactagaagtttcatcaaagtttcttaagcactccaccattgactgctctccttcaccatcccccaggttcttactcaaccacgtgcctctgtctgcttctttccaacttgtagcagcacctttcctcttctattctttgttcttgtcctggatgtcattccctttctcccctcagaggcagagaggagagggctgctggaggaagaagaaaagtgaaaaagctgtagaaatttgcttccacaataaacaatacccgaaaaacctgtacattcttttcttcaacttaaatgaagaacccaagtgtgcactcatatgaagtaaaaaaggtgcaaataggccgggcacggtggctcacgcctgtaatccgagcactttgggagggcgaggcgggcggatcacctgaggtcgggagttcgagaccagtctgaccaatgtggagaaacctcacctctactaaaaatacaaaattagccaggcatggtggcgggcgcctgtaatcccagctacttgggagcctgaggcaggagaattgcttgaacctgggatgcggaggttgtggtgagcagagatcacaccactgcactccagcccaggcaacaagagcaaaactccgtctcagaataaataaataaaaaaaatacagttcctttttttttttttttaaagaagtacaaatagctttgcatgcaatttatgaattttttcctgattctgatcgctggtgttcagtaggaaagggaatcaaaactccataaagcaaatcagcttatctgtagataaccaaagtcttctcagtggtgtctgtccctcttgtgaaagtacagctgcttgtgggaaaagtgagagacctagaatacagtgtatcttttgggggacatacctctgactgttacagaagcatgtgattaatttggaaggtagaatttcggaacatcatattttaataggaagcttgaaaggtaagtagaggaaaacatcaagcaaagcaaaatacaccatttgcagagttcaatcagatatgactcagcatttcttcattgtgctcatccccagctcctcaagcacatagtgccttgcacacagtaggggctgagggaaatattcgttaatgcattaattttagttaaaactagatacctcctaatctctcagtggcttgaactgggtcaaacagcagaggaatggggtaaataaggaaagacacccggtaaaggtagaacaagaccactgcttaataaatatattcgtttttggggttattattttgctcaaaagtctatgaggtgaccaacccagaatgtggcagttaattctatttacattttcagtgtgggatccaggttttcaagtttgttatgtgattttatgcaaaacaatatgcaaatccagcgcattctaaaaattcagtctgctttccagccgctcccctggtcacaaacaactaaggttggcgccgggctctctgggatccttcgcggaggggcagagcaggcgggggtgactggcagcggggcgggggaaagggcggtcccggaggcggtcccggggcggagcccgtgacgcgcggagtcggccggcttaagggccggacctcagcgtctcccggagtctggccgcagtcgcggcagtggtggcttcccatccccaaaaggcgccctccgactccttgcgccgcactgctcgccgggccagtccggaaacgggtcgtggagctccgcaccactcccgctggttcccgaaggcagatcccttctcccgagagttgcgagaaactttcccttgtccccgacgctgcagcggctcgggtaccgtggcagccgcaggtttctgaaccccgggccacgctccccgcgcctcggcttcgcgctcgtgtagatcgttccctctctggtt

SEQ ID NO: 34 - DNA, 2138 bp, Homo sapiens
tcgcatcatgagacactttgaatccatagaaataaccctgccccacactttgttctgagaaatgttctgtacatctagtagctgtgtttactaaccctaaattctaggctcccctctgcaaacagataggaatctctggagtcagctccccgtttcccccaactctactctctcataaatgtggttggaggccatgggtcctcttcctctatcaggggccatgtagaggcacaatccagattttacaggaagttgtgtcagaagaggatccttgtttgggaataaacctcagtggaggagacgaggctctgtatcagcccaattgttcgaggttcaactcatttcaaaagcagatatagtacttacaaaggggacttgagtgctactcatgacttgaaggagttttgaatagggtacaggagtcaaccagttgaaatagaaagcagaaaataaacaacctaaacggccgaatataggtacaaatgatatagttctggagtaatacattctggctagggaaacttaggagttatttacagaagaatgtaagcatctgagttgagacctggatgatcagataatttcaacagtcagaagaattttaactagtaagtggggtggttgggtaaaggacactgtgagggaaagaatggaataagcatagttactgaagcacccaagcaaaagcaagtgtggctatttggactgggctaggggttactacggggccaaaacagaagagtgatgaggagttagaggccacatttcacctcaaagttaaatgatttgaaatttattctgctagcagtcgtctactgtttgattttcagcagcaaatgatctaagcaagacatttatttttaaaatgttaaaatatatcttattaaatattaccaaaatagtatgggaaatgaagagactgaatgtgttactaatccccaactgagaatggaattgttcatttgtgaagcttgatatttccctgtatttttattactactaagctattattttttacatttgaggtcagagcttgggttggtttatgccaaagtgtcatctcagctatctgtgagaagctccatgtgtggagtgcaacaggagtcccagcctgctctaggatttccacgacctggcactgcactcacatgtcgtagtagccggggcacactgccttctcctgtctgcatgtaggtctttaccgaataccaggtcccatttttaaataagaggctccttctacttgtttgtcccatgcttcccctatttatactgcctgagaaattgttttccatcagtaaagctgattagtcttttctgttttcccttgatctttgttagcatctgggctacagaagttgtcctcctatattaatctgggtatttcggttttgcttttccaaaggacagcaagctcagccaggctgcctctcagttccaagggagtgctcattccctccttccccagcccttgctctttccaaaaggatgatttctgtcgtcccagggcttatcccctcccactccagctcctcccatcatttgagtcaatcccacagcccccactatggctctattatatagttgtcgtcttcccataaccaaaaggttttaacgccagcctggcagcgtctttagactctcgcactcccaaactgtcccctcctccagctcgactcctccgggagcgcgcggccaccgctgcaagcccagaacacaaacgcctagagcttcctccgcttagaaacccggggcgcttggccccgcctcacctgctttcggccccgccccgcccgccgccggcctgctcacggctcctcccgtcctccccgaagccccgcctctgaccccgccctgtcctgtctccgtcccgccccacgcccgccagccagcgtcgctgtctctcgccttccctgaggccccgccttcagccccgccttcaaccccgccccgtcctgcctccgccccgcccccgcttgccggcccgcgtcgccgtctcaccctccccgggctgcgcggccggagctggcacagaggatcctcggccgcggcgacatcaccgcctgggcacgcgggcgctgctctggatacggcgccaccgagagaacccgccgcccgcgggtctctgtcctgcggtc

SEQ ID NO: 35 - DNA, 2132 bp, Homo sapiens
gctgaacaatgagaagacatggacatagggaggggagcaagacacactggggcccgttggggtgaggagggtgggggtatggggagggagcgcatcaggaaaaatagctaatgcatgatgggcttaatacttagatgataggttgataggtgcagcaaaccaccatggcacacattgacctacgtaataaacctgcacatcctacacatgtaccccagggcttaaaataaacagaaacagaaacaaaaaaaaaggaagtaaaaaataagcctaaaaggaaaaagtaaaattttttctatttgccgatgacgtgatcctacatagagaaaactcaaaacacgtcataaaaattgttaaatccagtaaagtagcaggatacagaatcaacatacaaaaatcagttgcatttctttacaccagtaatgatctatctgaaaaagaaatcaggaaaacacaatccatcataatagcatcaaaaagaataaaatagagggtggaacaaggtggccaaatagaaccttccagtactcattcccctgcagggacatcaagttcaacaaatatcctcacgagcccaggcggcacagtgtgaagacagagtctacctccttaggaagtaaaaggaatgttagtgtgggattttgcattggaggctagtgctgaccccactgcagtggaacacagcactgggcagagcctccaaggcccttgattctaggctggaggccacagagggagcatttagacccccgccccgggtcagagggaaatctgctacctcagcaggaggaatccaagttccagtccacttcacaaccacctaactaaagtggccttccgccagaccctaaaacaaagatttgcattcaggtagattatttggaagatgatttaaggacgtaccagtgcaggagttgtcgcgggacagtgagaccagggcagtttgacaatcaataaagggtgcatcattggcaagctacctgtgaacaaagggagcataattccactggacaacaccaggaggcagtgttatacaagcctaagggtaattccacctgaccaggtacagcacaaagatatgtggcctccaactcccaacatcctgggctgaatagtggtcccagacccatagttttcaagtctatctagcctgcctgaggacatgccaagagaaagccttcgcatagagtcccgagttcacgtggcaggacgccagaggcatgttctagaacagtaggtgccgaaggcacagcacaaggaaacactcactggtggaatgttctcaaaacaaagaaatgataaatgtttgaagtgatagatgtgctaattatcatgatttgatcattacacaatgtatgtatgtataagaacaccacattgtaccctgtaaacatgtatattgggtcaataaagaaacaaaaattatgttgtatagagaaaaatgcataagaaacagcaagagttgtagatcaataccatgaatgtaaataaaaaacaccagcataaacaaagccatatgacatatatcaccctcataccacacacatggggctctttcagacacattgcccagtgccttcaggtagagaggccagtgggaatgaggatgatggatgaagggaagaaaaatttttaaaagaagtctaatgggaactgatgaagaaagtataccataaacttggagtgtgattaaagccttccatcttcctcttttgcctcctctaggttaccagttctgcttttcctggacctgttccaagctctcacgttccacatcacacatgggacatctagtgtcaggctcccagagagcaggaaccaggtgaaatataagagcacagtcctcccagccggtggcatggggataatcggacaatacaactctccacccttttttatggtaagatatgaataaggggtccacaggagcaacctgagtccctgcaactacatttcccaggggcccctggggtaaccctaatgtgactctgggggcggggccagttggacatccaatgagagcacttcccctgcagactttggaagtgagagcacttcctcatagaccttggatgtgggaggattgcattcagtctagttcctggttgccggctgaaataacctggtaagtg

SEQ ID NO: 36 - DNA, 1794 bp, Homo sapiens
cagcgtaagctgctctggttttattgaacagatgaaatcacattttttttttcaaaatcaaagaaatcttatagagttaacagtggactcttataataagagttaacaccaggactcttattcttgattcttttctgagacaccaaaatgagatttctcaatgccaccctaattctttttttttttttttttttttttgagacacagtctgggtcttttgctctgtcactcaggctggagcgcagtggtgtgatcatagctcactgaacccttgacctcctggacttaagggatcctcctgcttcagcctcctgagtagatggggctacaggtgcttgccaccacacctggctaattaaattttttttttttttttgtagagaaagggtctcactttgttgccctggctgatcttgaacttctgacttcaagtgattcttcagccttggactcccaaagcactgggattgctggcatgagccactcaccgtgcctggcttgcagcttaatcttggagtgtataaacctggctcctgatagctagacatttcagtgagaaggaggcattggattttgcatgaggacaattctgacctaggagggcaggtcaacaggaatccccgctgtacctgtacgttgtacaggcatggagaatgaggagtgaggagccaccggaaccccatattgtttagtggacattggattttgaaataatagggaacttggtctgggagagtcatatttctggattggacaatatgtggtatcacaaggttttatgatgagggagaaatgtatgtggggaaccattttctgagtgtggaagtgcaagaatcagagagtactgaatgccaacgcttctatttcaggaacatggtaagttggaggtccagcttctgggctcagacgggtatagggaccaggaagtctcacaatccgatcattctgatatttcagggcatattaggtttggggtgcaaaggaagtacttgggacttaggcacatgagactttgtattgaaaatcaatgattggggctggccgtggtggctcacgcctgtaatctcatcactttgggagaccgaagtgggaggatggcttgagcccaggagttggagaccagcctaggcaacatagccagaccctctctctacaaaaaaattaaaaattagctggatgtggtggtgcatgcttgtggtctcagctatcctggaggctgagacaggagaatcggttgagtctgggagttcaaggctacagggagctgcgatcacgccgctgcactccagcctgggaaacagagtgagactgtctcagaatttttttaaaaaagaatcagtgatcatcccaacccctgttgctgttcatcctgagcctgccttctctggctttgttccctagatcacatctccatgatccataggccctgcccaatctgacctcacaccgtgggaatgcctccagactgatctagtatgtgtggaacagcaagtgctggctctccctccccttccacagctctgggtgtgggagggggttgtccagcctccagcagcatggggagggccttggtcagcatctaggtgccaacagggcaagggcggggtcctggagaatgaaggctttatagggctcctcagggaggccccccagccccaaactcaccacctggccgtggacacctgtgtcagcatgtgggacctggttctctccatcgccttgtctgtggggtgcactggtgagattggggggataaaggaaggggggcgggttctgactcttatgctgaagccc

SEQ ID NO: 37 - DNA, 1785 bp, Homo sapiens
ggctccaagaagtatgaaccagaatatggatattttgtaaaaatggaatgtaagttgaggttcctgaacaatgtgatgttaggcagggtgcggtggaattggcctgtagtcccagctacttgggaggctgagatggggaagatcccttgaggaggatctcttgggttcaggagttcgaatccagccttggcagcagaccccatccctgaaaacaataaaaattaaaacaacaacagtgggatactagtcttttaatttgaaaaaaaaaggggtggagaaagggaaaaccagttttcaaaaaaggccaatttcctagacattagtggttgattactaactcatttcattaaactaaattatgaattggcttttctcgtcagtgtcaccactctgatggcgttcttttccattttccatcttcaccctggccgaatgtgggaaatgatctggtttgtgcataatccgcgaggcccagggaggatcttttgcccctattgttttcttgggtgttctcactctgggggcctgacattcctcgcgtgtctaaggcaatgagggagcagtgaagcgcggggaagccgcacaaaagacatccaaaggctatcaatggaaaaagatcaattaggtgcacacaagaaacacccaatatgccagggaagagaaaaatacccttttccagagggtgggaaattgattgagcttctgtgagggtccacaaagaactggacggatgcagtggtggatggcgatctctctggaccactccggacgcgcccagcagacgcagcctacgcctttaggtcctaggaggctgagaagggtggggagaggggggcagcacgatcttgtgtctttcctccccgtgccgcctctaccgaatcgcggatgcttcattaatcttgcaggcgccgcagctcgggtcagtatggaggcggatcggtggcagagcccgggcctctgggctgcgcccgcccgttcagcctggcccgggaggggagcggccgcgcggtgggccaaagacgcccggccttccctccgtctgcttccagcaggcacagccgggaggctgggctcaggggctgacccgaatctcccctagagctgggcccacccggctgccccccgagcagcctcgccgctcccacgccaccgcccaagtgacaggcccgggaaggccggacgggacgcagtcttcccgccggggtcttccctccggctggccggccgctgcagggcgcgcgcgcacacacgtacacacacacacacacctgcccacacacacacacacacacacacacacacactgccgcctccttcccgccccgcagccctagcagcccccaacccgctccccagcgcgctgcgccccggcggcctccgcaggccccgccccggggaggagagccaggcgcgcgcgggagctaggctcggggaggggccggcggtgggggagtgtctgctgcccccgcccctcgagtgagtgactgagcgaggagctcccctccctcgctcgctcctcgcaagctcccgctcgctccctgcccactcccggggggacgttccgtgccgcggccgccgcggccgctgcttctttcacactttagttgggagctgcgcgccgcgctcagttactggagagctggccgcgcgccgccgcctcccgcacgcttgcacgcgggcccggcttcggggttttgggttcttactccaagcggcggggaggagggggagccccggacacactgtggggaggaggaggaagaagaggaggagggaggaagaaaa

SEQ ID NO: 38 - DNA, 1471 bp, Homo sapiens
ttggcatggcagagattaaaaatgcaaggaaaaaaattacatgcggaacggacaaaatgttctcagagattacttcagaaaaaaaaaagtgaaatgcagattgtacttcttcctttagtgcagagacgacttttatttccgccccctcccctccacattcctgacctctccctcccccttttccctctttctttccttccttcctcctcttccaagttctgggatttttcagccttgcttggttttggccaaaagcacaaaaaaggcgttttcggaagcgacccgaccgtgcacaagggccatttgtttgttttgggactcggggcaggaaatcttgcccggcctgagtcacggcggctccttcaaggaaacgtcagtgctcgccggtcgctctcgtctgccgcgcgccccgccgcccgctgcccatgggggagatgcagggcgcgctggccagagcccggctcgagtccctgctgcggccccgccacaaaaagagggccgaggcgcagaaaaggagcgagtccttcctgctgagcggactgggtaagcgccgccgccggccccgctgggggcttggctcacttccccagagcggcttggaggcaggggccggctttcgtcggagttctcggggccggggtcccggcggcgggaacgggaggacctggcgggcgaggtcgcgcgcgcaggcctgcgccccagggataaaccccggagggtggcgcgcaccgccggctcgggttggggaggagggtgggagtccggccgcaggacggcgcctggccggggagagggtatctgcagggacagtgagcgaagccaccgtggccgccgcgcacccgccgggaagcgcttcggcgctgcgaacccggctttctccggcggcggaataaatgagagaggtggaaaactaccccgggctctccggccctccccgcgccctccgccggcgcgttctctctctcctgccccaggagccgatggagactgataacggccctgcgccaggccgtccccgggcggtcctcgcgcccccgcccggggctcgccctctcaatggggacagaaccgcccgccgcaggcagcgtagccgccagcaaaccgcgaggcggccggggcggggcgaggggcgaggcgaagggcggggccacttctcactgtcgcgcaggccccgcccccgcggcggtgccttttttataaggccgagcgcgcggcctggcgcagcatacgccgagccggtctttgagcgctaacgtctttctgtctccccgcggtggtgatgacggtgaaaactgaggctgctaagggcaccctcacttactccaggatgaggggcatggtggcaattctcatcggtgagtgcaggaatcttgcgggacttctgctccaggagacgcaaagtggaaattttttgaaagtcccggatcagattagtgtgtgtggcgccggacgttatgaagccgtctaaacg

SEQ ID NO: 39 - DNA, 1192 bp, Homo sapiens
tgatgcaatttgaaataagctgctaaggagataacacccttaatctattcattgctggtgcgcttacccagtctggtttagaaccgtttaacaaaggcttagaatcataatgtctatgattattacctcttagctcctagttttactgacttccatgtctggaattaccagcacttctttttcgtacatatggattatatgaactaaatgtattgtttcttccctcactactgaaaatctattcaatatatggagttacaattcaaagtattttacaacccagaaaatatggccattccgtatgtggtgtgtatttcagaggtgctctgcaagctccatgaggacaggcgtgaagttcaggctacatgcctggtacgtaatagacgctctgacagacatttgctgaatgaataagttagtcactacggcgtttgtgggctttaaaacacaagtaaatgcgcttctatcgccaaaacctcacagcttcccttctgcaaggtggcgtacaaggcccacgaaatagtcggccgccgcaggtgcgcagcctgtccagcctgtccggctcggggcaggcgacctcgtctggtggcagtgggggaggcagccgtttgcttcctcacagggtgtgccggaatcagaggctggaggcgtctggggagtaggcaaataaacaaagccaaccgcaccgaaacgggtcgttccgtttcacatcctccctcgggtgtctgggtcttctcggaacaaagtgaccctccatctgtccgcaggcaggtggagcccgtcccacgcggcacgcgccttccttcctcacagccgcgtgtagacgcggaccctcagggacactgcggacgcgagaaaggacacgccccctcgcgggagcataagtccaccgcacagaactcgcgcgcctcccctcgaacgaacgcgcacgcgcgcgcagggggcgggtcttcttcccgacacccactgagcgcccggcctcctcaccccaccccaccgaactccggccgcccaggctccgcctccgcgacgggccgtcgggaggaggcgaccggaagccacttaaagcagagatcgaggtgacaggcgagctggctggactcggagcgcggtcgaggctttctgcgttcgcggcggcggaatggcccgtgcgcggctcgccgcgtcgcggctctgtggtccctagacgtcg

SEQ ID NO: 40 - DNA, 1185 bp, Homo sapiens
atagagaggtctcaaaggtgggggcaggaaagcagaagactgccaatcggggtaggggcaactgccagtccgagtaggggcagttcccagaaccgcctgaggagcagtgcagcgcccgaccagcgagaacctccgaccctggagtctaaccagctcagtctttggggcagagccgggacagcgggcttggcggcgggcaccgcgcccggccgcgtccgagctccagccaacaggaagagcaggagtggggccaggagaggcgggccagctggccagtggggagtcccgggcgtgggtgtggggagcgggggaacccccgccggcccctcccaggccccagcgggcggagggagcctccccaccgggcctcagcgtcctcctctgtaaaatgggccccttctgagggctggctgcgcgctaatggcgggaggatgcgaagagggccaggcagggcagagggaccgggagactcggtgtcccgcgcaggcagaggcggagggacgctgtccccgattgcagctggcggggcgaggcctggcagggcgaggcctggcgggggcggggcctggcgggggcggggccggcggcacctgggtgaggtcgctcggccccgccccctcgcacttccgtgtgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggaggtaagtgagggccgggtccgggcgcgggatcggggctaccccgagggcgcggcgcccttccttcccccttcccgccccagttcccgtttccgaaactgagaaactgagccgcggtcagcgaaagtcccgccgcgccgagacctgccggtgactccgtccccctgtccgtctgtgtgtccctccgctagacagtgggggctgaggtccttctgtctgcccgctcccggcccctccacccgcccgtgtgtctcccgctcctccgaggggcccgtccgtccctcccgactctctcccgggccctgtgtccgtccgtctgtcgccacccactctgtgttctccccctgc

SEQ ID NO: 41 - DNA, 1122 bp, Homo sapiens
tgagtcggtgtcaggttgagttaatatttggagagtttctggcacaggtaggtgctccttaagtgcctgttaaataagtgaagctttgagaaagtgtctaaaaggcgacacactaaatttttaagaggctggaggtgggccagggaggggaggtctcttatgtaatattttaatatctttttaaacctgaagaatgtgttcttgtagcactcctgtaattaaaacttaatgaactaaaagtacacccctcctgctcataccccttttgaactccgcagccgcgccccccagccggaggccccttgggcagcagacaatgggtgtggattcgccccaggtcccgccggctggggcggcgacaatacaccagtccccgacagctatttacatgacaagggcttccgggcgtgtctacgcgagttcccgtctttcctggtcgtcctccttgggttcgggtgaaagcgcttgggggttcagtgggccatgatccccgagctgctggagaactgaaggcggacagtctcctgcgaaaccaggcaatgggtgatccatcttgggggcttcctccccctttctccaatttctcttccctgagcccccagggaccttgtgctcctcagaagataggctagccccaagagcctgggtcaaggaccccagggacgggggcgaggggagggcgcaccagcaacccgcccgggtgcggctggcaccgagttcggctccccggccccgggcgtgcgccgggcaggcgttccaagctgaccgccgttggggagagggcacagcgcccctcctccgttgcgcgggtgccgggtctacgtgggccgcctagctctggccctttaagagcccgccccgtttcccgtcaccccgccccccggctcggggagggggtgcgggggaacctcggcggggattggcgcagcgcgcgccccctccccggcccccgcgcggtgggaaccggcagccccgtctagcgctgacgtcagaccgtctgcctgcctccgaccgcggtctcggagcgaaacccgatctccttggacttgaatgaggaggaggaggcggcggcggcggcggcggcggaggcgctcggctggggaaagctagcggcagaggctc

SEQ ID NO: 42 - DNA, 1096 bp, Homo sapiens
acggaggccgattaagaaaattagcattcattaacccggttcacgctccggccccggcggaggggaggggcgcgccgggcggcggcgctggcggtggccgggtgaccggcgggcgcaggtgccaccgcggcctgaattttactctctcgggccggcagctgcgccacttgcgcctcgtcgcgcgtctggggcagccgccaccggcttgccccagctttaggcaaatccttttgaaagaccctgagggagaagaaacgcctccctctgggtaggagaacctgtagcgtctgctgttcgtcgcgtgtccagttgctcagccgggagctccggcatcttcagggcgcttattccactctccgggttttggctgcagctctgaggggagcgagctagaaactgacagaacgcgaccctccccctccgcgcccaccggagcccgggctgagagggacctggggagctgcggcctggccggggcggcgcactcaggtggcctcgcttccctgcgggtcaccgcccgccactcgcacagctaggtcggcctgttgggatcgggagaggtgggcgcacgagttttagtgcgggagtccggggtgcgggcggagtcctattgtccccgtgcacccgggcggcagcacctccgggtccctctttaaaccgagcgtccggcgacctttctttgtgcttagggagtcgaaagcggcatcttctccgagagaagtcgcctactggggggtggcgctggggaggtaacaatgggcgcccattgtcctccgagggtccaacggtgacccccccccgcgcgcgcgcccggccaccggttggccccgggccagggcacaggtaccgcggctgggagggtcggccccgctgcccgcgccctccgccccgccccagtgagtccccgcgccgccggccccgccccgcgccgccccgccctccgcaggttcagtcctcgcgtccggccgccccgcgctcagtcgcgcgcaccttctctcgcggccgggggaccgcagcgcggggctagcccggagacccggccaccggcctggggcgccttcacgccgtctcggagcggataatgcggtgagcaggc

SEQ ID NO: 43 - DNA, 1800 bp, Homo sapiens
tggaatagaggcaatgtagaaaaatgttagaaagtgttgttcaatccttcacaggcttttcactgcatggtacaaagttaagcatttaaaaattggctataacccacttggaagagggcatttgtatgcttaaagtggcctcagaaaaggacagcagagaatttaggaagattagcaactggactgtcaggcgaactcaggctgttggcctcaactccaagagggagcgcagctaggcaaaagaatacggattaagcggaagaggttggaacacctgtccaggccaggtaggggaggagtttcaatgctgacaaagaacccgttgggagagcttcctaaaacacccagctgtcatgacgcactgaggagtactctactagttgactgttttgaagtgtgtgtgtgtgcgcttgcttgctttaggagacaagctattaatactaaagcatatgttagggagttgctcagcgtacttgatatctagtagcaccagccaaactagctaacagcctttccatggagataggccaggaagtagctccatagagaaaaaaggaagtagtggacctgcctccaaggttccgatactgggaggtgaaagagatctgaagttccgaataagctgtttacactaccagagaaaaatctggctcccatccaaccctcacccacgaggtgcccattccagacatggggcaagctgccttctcatcttccgcaggtgacagctcggctcacatttgtccacgtcttccatctcgtgcgctggcaacatacctaaatgattactggaagagctgcctctttttataatttcctgacagaatttataaaattaaaatatttaattaaagacagaatcggggacatgttgccttcacatttgctgttcaacctgtgcacattttggtggttcccaagaatcgtcatgccaaagcatcaggcttgaaaggagagatcaccttaagcatcaagatttaaaaaaataaaacacaactctcctcagtctaaactctaggatttggatgacgcttccctgtcaaggtttctcccgagtggaggagacaagaggcaggaaaggcaggtaactaaaattgcctcatgtaaaggggctcagcgcagaggaggaatgagataatagcggcggtgggggtcttttcccttctctccctttctatcttggaaacaggggtccgactggcagcggagtgggggcagtccaagctccggggtacctgcaggaggagactcgaccagcgagaggggccagcgagggtgaccaggtgcccgcttggggaccccgccggcggtggccaggctagcccaggtcctccccgatcccaggatgcactgcgccccgccccctccccgcgccgcgttccgcctcccctcggccccggccccctcccgcccagcgcggggaggcggggacgcgtcggcggcggaggcttctccagtcgcgtctttctcactcactggggagcccggcggtggcggcacctttcgaggtagacccgctgagctgctagcccgccggccagcgagtgagaggtcggacagactgtggagccgacagactgaaggacagcggcaccgccagacggccagaaagttccgccatgagctggggcacggagctgtgggtgagtcggggagaggggcgccccgcacggaccccggcccctgagaagcgcgggttgggcgggcgccgcggaccctcggcggtgaaagcgcgctccgccgtcctcggtccggcgctggcggagggtgagggtcccgctcgtctttgtgtgcagactc

SEQ ID NO: 44 - DNA, 2258 bp, Homo sapiens
tagtgtgaacatcgttgccttgttttcttcaatcagctcttaaaagaccatgtatataaaaagtatttcgaaggacagaaataactctagtgttagacatttctggacatttagctggcaagatgagattatggcccctcttatgcctagtaaccagaataacaaacaaatgaaacttcagcaaaaaagggtaaaagtacaaatgtgattttatagtagttcattaaaaacattgagctggacctcagttctatcttttttctttaaaggattgctaactaataattttgctctttactcagtcattcatctatgacttatagaatgcctataatattccagacattatcttaggttctttctcattttttactatacccatgtgaaataggtattagcttcatttcataaaaggacattggagtttggagtggttaaatgacttacccaaagtcacacagttagtaagcgtagactgattttgaatctgggtctcctagtttgaattaataagtgctcaataataaataataactaaaggttatttagtgtttactgttttacatacttcatttatatcgattggtttaatacaaccaccaaatggcattttcatctttattgtctgttttttatagatgagaaaactgatagcacaagtagcttgccaaagatcacaagcaataaagctgaaattgtcttcagatcccatgattaagaaaccaatcactacactataaaccaatcactacactattcttctttcaaagaaacgaaggaagttctaggatcatgagagatggagagtattcaatctcctgaatgtaaatctaccagcattacttaccaagtttaagtttttctgttgttacttgaggcagtgggtgattatgcaattggtaaagggaatgaaaaggcctttgcacccaagaaagtagaagaaaggcgcctgaatctctttatgataggtggtatgttaaatctaggtattttcgtatttcaacatattccacttcttgcaaaagctgcaaaatgcaacacaactttaaatgtaaacatagcttccaagggcacagtgctgaacatataataacctgtgtgtgcacacccacactaggttatgtaacaggactgtaaacactggtcctggaatggcctgggaggtcatctaggtcctccaccatctttctgcagagtactgaggcctagcgacgttaagtctgcaaactcacaaagatgaccccgggcttatactaccttaggttacctactacctttgcttgcatttcctctctcctttcctgtctgtttgtgcaaaagaaaaaaggcctggcttcgccttcttgggagccaaaacacaaccaaacagagagcgagtttggagcccggccaggcatcttgtgaactgcacacaaaataactagcccaaggtcagagagcgcgccaggcccgccctgaaagtttctccgcaggaaaatccaccgccctttcccaaccacccgcgtgggtggctcggaaatccgccaccctggggacacagctccctgcccatctctgtggcccgcttgtgccccgtgccgctgggccgactaagagcctcgggctcgcacctcccagtacaacctagggacgtcaggggtcctgggacccacgagccgctctctgccggccggctcctggcccctcctagcagacccaaccgacatccttcaccctcagttagtgcgcaggagggaccgggacgccagccgactgcgctccagaactattcccattgggccagagaatgagtgacgcactaggccccgccccggcccggtgggttactcctttcatgcccggcccccatccctagccccgccccggcgccccgggccgcggccgcctccgcgtccgcgtcgtcgtctgtgctcccggcgctgacgtgtctgggcggtcggcttccactccttcaggcgtcggcagccactagtcgtggcgagaggggcggggtggccggggctggcgctccacttggcccccgctcccggcccgccccgccgccgcggccccccggatgagggtatatattcggagcgagcgcgggacgccgatgagtggccgcgcggaaggagctggagacggtcgtagctgcggtcgcgccgagaaaggtgaggggctcccagcccagcgaggagacggcggggctcgggacccgggcgggcggagggcctggccccaccgcacacacggccacgcgctcagacgtggacacgcgt

SEQ ID NO: 45 - DNA, 2146 bp, Homo sapiens
gataagtggggagactggtgttgatggaaacctcagtgagaaaagtgtagatgggattacagttgacaactggttgccttgatttaggataattggggaaagggaggctggggcacattgaaacacccaggttgtcgctgcctaccccagctgctaacatgaccagctgtaaacttgctctgttcttagaaacctcccttccaaaacatggattctcccgccagtgctcaagatgggacacattaccactaagtaagcacttttcttaggagcatttcttaggctgttaaaatgccaagactcctaaccatccttggtagctttgaacctatgtaaagaggtcagttagctgccctagtttattcctcagaatgatgagatttggcactgaaaatattgttcatactgagcctcccatcaaatgcaataagtagataaccacaaatacccacccttttatgctcataactcagcatgttggaaactattttcccttgacctattgccagcccatcacgccccacacccaggagaactcaagccccaaaccggccgctgaatagtcacgcttttctgcaggacatacctactattagggccaaaactttgtccacccttcaaaggaagtcgatgtttccatataaaggtcccctcaaatgcaacagcaagcccgtgggagaggggttagcagaggctacggccagcccacgggctttcttcgaccttgattatgaccaggagtgtagctgttaattgcgaggcttgcctcaaggtggaaaacagtatcggtttccactgccaccccagagaaggcaagttccgcggctggcggtgctggggacacggtccctcccaggcccatctcttgccacccagagagctgctcggaggccgcctacaggtgcaatcccggcactgcggccggggcgtcgggccggggagggcgtccaagcccaccagcatctccgccggcccttcccaaagcctgaacagggccccggcgtgcccgccgccttctacccccggtttccccgcgcctctgccccggcgcggtttggataggaagctgggagccctcccaggctccgcagactcggatttgggagggggtgggacgcggccgaggcttcccctcgaatctgcggcaagcctggctccaggaaagtttttcaaagttcccagcagcgtctgcccaggtcgcctccgcggggcgagcagacggcggcaagcgcgccagcctcgccgccgcctctgccgccagcagagcgctctgggcggctcgctcgcgggaagcgggccgaactcccggcgggcaggcaggccctcctcccggggcgaaagccgcagctgacgcaggcggttcggaaggcggaagctgccccgctccgaccgctcagtcagcgccgcggcgcctacacctggggccccgacgcgcgggcaaaggcgcacggcccggggcgcccgagggggcggtccccgctgggggcctccaggcgtccctgagcaacgatcccttccaagtacctccccgcactctcccttccctcctggcccgaagctcccgagggcgggggttggtgtggggccctggttcttctacgccgccctgagcatcccgctgcccccaaccccttccaagttcctcctcgcactaccccctccccagcaacgtgaaggggaggggcgtgcccagggtgagcacgccctctcatgaatattaataagcgcgcatgcgccctgcccggcgtgctgggtagaggtggccagccccggccgctgctgccagacgggctctccgggtccttctccgagagccgggcgggcacgcgtcattgtgttacctgcggccggcccgcgagctaggctggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattaga

SEQ ID NO: 46 - DNA, 910 bp, Homo sapiens
acagctgaggtgagaggaaagaaaaggttgctttcttaggaacaaagagtggtaccttcagtatcgtgggcaaagcttttccaagtccaacagcagtcaaaacagcgctttttataaataacactcagctaaaagtttctgggtttgtgattgttccaacggttaagctcggatgagggtccctggagtcgtagctcccgggaaacgtcgactggctttccacctggacttcatccgtccaggcagcccagaggggcttcaggccccgcccgctctcctgccaactacagcctcgcgactgcgctcagccttcaggccccgccccttcggtcaagcggcgtgctctcactgcacggcgcctgggccccgcgcgccgggacctcggtttcagccgtcctgtcctgccccgaggcccctaggccccgcccctgggccccgcgcgccaggacttcggtttcgaccgtcctgtcccgccccgaggctcctaggccccgccccctctgtccccggcgtgttctcgcggctccgcccctaggacccgcgcgccgggactttggcaagtttcagccgtccggccccgccccctcggtcccacggctctcgcggcccctcccctaagtcccacacgccgggactttggcaagtttcagcctccagccccacccctaggtcccgcccactcggccagcggctggctctcgcggccccgcccctgtgccctgcgagtccctattttgggagcattgcggccgccgtgccccgcccctccccgcgcgccccgcccctctggcggcccgccgtcccagacgcgggaagagcttggccggtttcgagtcgctggcctgcagcttccctgtggtttcccgaggcttccttgcttcccgctctgcgaggagcctttcatccgaag

SEQ ID NO: 47 - DNA, 921 bp, Homo sapiens
accctgaattgcaggatagacaatgagctcatgccttggtgccttgtgttgggggtgctgttagtgcatcgacaggacatgcccagcagacagaggagtggctgtaggatgagaaggtgaactcagagatgtagtgtgaggcccacgggtccagacagcatgggagcccaaaaaatgaaccatgcattgatagtggtaaaaagctgatacatatttaaagcagcacccaagtgtgttctaatagaaatgctgtgaccctgaggtcctggggattgagagaggaagtgatgtcactgtgggaactgccctgtggagacaaggacggcccttatcctctgcttctgttcacagtgacactgatctggtaaagcccccatcctggcctgaccctgccatgggcaccaggctcctctgctgggtggtcctgggtttcctagggacaggtgagtcctcagaacaccaagtagtttcattttttctgtttgtaggtgtgtgtgtgtgagagagtggttgtgtgtgtgtgtgtgtatgatgactacaaatattttccttattctgttgccaaattctatttccacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagcttagccacagcatggcacagttgcctccttcctgttcacaaacctcat

SEQ ID NO: 48 - DNA, 926 bp, Homo sapiens
ttttctcacttcaaaagatccgccagggaagagtcccagctttttcttggtgttattttaggtattaactcaggagggcttcctgaaggtttgtcagtgagatagttggggggttcctgagctttttattgttgtacgtgaacttggtacttacttctttggcttttaaactctcagcagcacgtacagatgccctcacatgctttctgggatgactttaacgctaaatagcaggggtgtttctcaagaatgtttaagaaaagaaagcagacatttgtttgcacaaacagatatttgtgacttctgtgaaaaaattccaatagttgtaatataggaaatttttataaacaaacacccctaccaactaacccatcgtgtatttttatgtgtgtatagaaaaaatgaaaggatatactaaaatgttaattgcatagtttctctgggaattgaatttaattaaaatttttttatcaagatttttaaagttttataatgaccacgttatgtttatgtaataaaaataaaatagaggctaggcacagtggctcacacctgtaatcccagcactttgggaggctgagatgggaggattgcttgagtccaggagttcgagaccagcctgggcagcatagtaacaccctatctttatttttaaaaaataaaataagagagggggacaataaatgcaaatatataaatgacagaaattttatggtctggtcaaagaactatcattgcatgaaattatagatatggtcatgtaaggttaccttttttcattataattccaccaataattctaaagtttcttttctttttttttttctacttcttccacagaaaaacaggacaaagaaacctgtgtgaattttcagcttttcaccttctctgattttatttcttcctcactcttcctttgacagtcc

SEQ ID NO: 49 - DNA, 1033 bp, Homo sapiens
taatgaaccatctccctccacattcccctttctttaaaacatttaaatattcttaacttagttgcacactattgatgtgataaaaacttataagccttttaagtttagagttgtattatttggtaggatgatgattgtgatttaatctgctgatcattagtttacttttgttttctgagtcagatgctcacccagttttaccatgatttttggaaagcttggctagaaataaaatagaacatttgcttctctgtccccaagcattatgttatttcttatttctctttataattccctctctgtccaggtatacctggtttaagacttctcatttgtaacctcagtgttcacatttgaaacaagaaaagtgcattaacatgagaatcattctggtgcaaagattctcaggatttgtaatatccttaagaatcacccaaggagcttattgaaaatgcacattcctggatttactctcaagtatggtaccccagggtctgcatacttcacaagcgtccctggtggttttagggcaagtggtgaaaaaagtacacttggagaaactattctagagttgtagactagactagggaataaagaaacataaatgtccttcattcctgagcactaaccccgccattatgtgaatgcatattaatggatacttaatcacattgaattacagtatgcagattttattaagaacatgtctacctcttattctgatgctgtgaatgtctaccacaatgagaaagtaattttaaaatcatttctatttgtgtaagagaaacccgagtttgaggaccttattttattctacgctgtttagatttgtatcctctggtaatttagtggcattagtcacctgctaattaatctttttcctttcccctgtgttccatatagagaaaagtggtaaagaatctacctcactgggaatgtcatcattaccaacttcagatgggtttaaccatcccgcccgttcttcaggacagagtcctgatgttggtaatcctatgagtcttgctcgctctgt

SEQ ID NO: 50 - DNA, 969 bp, Homo sapiens
tttggagggtaagtggtgaagaatggagtcttggtatagaaaggaaaatgatacctttgctgtaaagtagatggggggtagggacatgtctgtacatttaagaatgtctgatgctttaagaaggctgtctcacatttcagttgagggatatcttacaaaatacttgaccaatactactcaaaaatgtccaggtatcaaaaatgaggaaagtatgagaaactgtcatagccaagaggagcctagagacataggaactaaaggtaatgtggtatcctgaacagaaaaaagggccattaggaaaaaattaagtaaatctgaataaagtaatgacttgagctcagaagaatgtaccaatattagatcattaatttcaaaaaatattctatactaacacaaaatgttaatagtgggtgaaattgggtgctgaatatatgggaattcttggtactatctcaatttttctgtaaattgaaaacttctaaacaataaagtctgttttgtaaaaagtccatctctaccaacattcatattttaaacaagaaactgtaggatgaaagaagtgaaacatttaatacagatcagtggtgttgaggaaattttctagactgtctcccagaatgctagtccctattgcaaagaactacttttttatataaagctttttccctcctaattatttgcaatttgccgaaaagggaacaccaaaaaacatttccggatttgccacacacacaaaacaaacaaacaaaaaaaagttagaaaaacttctggtttggcttccagtcttgtctccagggctaactggcgtgccatctgctcgcagcagagcggtaaccatggttcatgtgtcacaccagcgtgcgatgttaagaagtttgccccggcaagtctggacaactccgcttccgcacaggttgctgagggcgggcggggatggcggcagcagcatccagagggtgtagatcgttc

SEQ ID NO: 51 - DNA, 943 bp, Homo sapiens
tcacagagaccaaaatcaagctgtgttttccatatgtatcatgtattctttatcctatagattctcgacagcaatatgacactttaagtctcagatttaataggttgttttgaaatagagaagccatggggaccttgatcgcttctaatgtcctttagccaggtaaatgagcatagacattctcagttacttacatcgttaacccaaacatttggtttcaggatcccataagcgacccatgacaggaagacttgggcttccctggctagagcttctctcattagagcagatgtgtgtgccttgcactatctccttatctttccccctgctgtaggggaggggcaacttgggggaaaatgactcacattagagataaggtgtcaatgatataatctccataaagctttgattaacagggcccaggacacagtaagcctttggcaattaagcttttacaaaaatatgcagtttttaatgtcattgttgttgttcctgttgcagcattttcccttgccctctttgcctgttctctgattgttccttagcaaagagcaaagaaaaaaaccaaacgttccaaagtcgaagacttttcctttgatacaaacaagcgaaagttcgattatttgttcaataattttccgttgatcccttagtcttgtagtcgctactttataaccggtccctagaagggggcggttctttccggaaattatgactgcagctgttttcactccgctgtgactcagagcgctccgggctgcaggagaggaaggtaggggaccaagctaccggtgcagggcctggatccaacccctgctctggaagactgagagctccacattctagctccctttccccagtccccaaatttgtaggggctccttgaattgcacgccccatgggtggaggatttcatcctgatgtatgatccccaggaaggttc

SEQ ID NO: 52 - DNA, 1089 bp, Homo sapiens
ttcttcagctaggctttgtgaccacccaatattgaaacgatttcctctgcctctgaattcctacagcaacatttagttaagcattcatttggcaatttaatcaagtggtgacttatgatagctttttaagtgagcccagataataactatttatccctcatattgagtactgtccagtgctgcacaaagaagtcactcataaatatttttggatggctgatttactgattgaaattatatccttccatggagatttgctttgcaagggaaacatgaaaagagggcatctgggtgatactaggctgtcatcaacctatcatcaatgcttcctttacatgaccaaaatcaggccaagacaaagaagtcagtctcatctccatcatttgaatcgaaagaaaataatcccggtaatcacaaattccatttcactttagaataaccattcctaaaagtttgcaaaatttatttgtagtgttaatctgccctcctcccccacccaaaataatttaaaacagcccaaagttagaaaaaactgaagggaagaaaagacttggagaattttcaacgctgccaaaactcagccaatttataagcatatgaagatccaaaatgagcccgaatgttggtcccttcctctcagtcttgcaaacttcagggagctactgaacgggaccgctctcaagttagcccccgaaaagacactgatgtaaaagtgctgaccggcaagttgacttgcaaactgaggttaattactaagccgaccctctgtcccggcaactcacttgcgctgagaagtgagggttgcaaaggtgaaaatagggaaagaggtcggtgggctggggagaggaggcatttccagtttgtctgctgcgggaagttgtccgcctgggctggtcgctccagagcaccaccgggggcaggaccacgccgcgtttgggagctggacaagcccaggcccgccccgccccgccgccgggacccatcaggagccagacagcgcccagcgaccggtcagggtgcagcccagggcccagagccagtctccgccccttccctctgtccccgccccgctttcccagcaggacgcag

SEQ ID NO: 53 - DNA, 902 bp, Homo sapiens
tgctaggaacatgagcaaactgaaaattactaaccacttgtcagaaacaataaatccaactttttgtgcaaaaaaaaaaatacaaatattagctgggcatggtggtgcatgcctgtaatcccagctactcgggaggctgaggcagaattgcttgaacctgggaggcggagactgcagtgagctgagattgtgccactgctgactttgtctcaaaaaacaaaacaaaacaaaaaaacaaaatgaaaacaaaaagccagggctgcctctgctcaataatgttctatctttgttccgcctcttctctggggtctcacttcttgggagcctgtgtgaaggtgaattcctctgaaagctgactgcccctatttgggactccccagtctctttctgagaaatggtgacattgttcccagcacttcctctcccttcctaggcagcttctgcagccaccactgagccttcctcacatcctccttcttcaggcttgggctttccacctttcaccattcccctaccccatgctgctccaccgcactctggggagggggctggactgggcactcttgtcccccaggctgagcctccctccatccctatgctgcctgcttcccaggaacatgcttgggcagcaggctgtggctctgattggctttctggccgtcaggaacatgtcccaacatgttgagctctggcatagaagaggctggtggctattttgtccttgggctgcctgttttcaggtgaggaaggggatggtaggagacaggagacctctaaagaccccaggtaaaccttagcctgttactctgaacagggtatgtgatctgccagcagatccttgcgacagggctgggatctgatgcatgtgtgcttgtgtgagtgtgtgctgggagtcagattct

SEQ ID NO: 54 - DNA, 712 bp, Homo sapiens
acgcgtggtacattctctagacgtttatgaccagttaaacagggaatttaaaatagttttcccatgacagagaaagacaaagcgctggtgttcttggcaggaaattcaaagaaatatttaaggcaagggctgactcccttggaccggatgaaggggaagagcaggtaataatagagggttctatggatcgcagaaacttcctgggcaaggagggtggagctggggaggggtttaagaattcctgaaggtcaagcgatctagcccagctggggttttctcctgcttggagaggggtgctataaaagcgcagtttgggattactactgtcgccactgctcaccaaattaagttattccgggagggatcttctcgtcgccatcctcattccaacacacacccattgacacactcgggttcggctgtgcggtgcaacgaattcccaggtgggacacccgagcaggaagaaagccaggctgcggggctgggggcgccgcccggcccgcgccacagtccgcctggaggatcaccgccagggggcactctctccgaactcggccgctctgtctcctccccggcgcgctccctgcccctcgctccccgcagccagcagagaaggcggaagcagtggcgtccgcagctggggcttggcctgcgggcggccagcgaaggtggcgaaggctcccactggatccagagtttgccgtccaagcag

SEQ ID NO: 55 - DNA, 1092 bp, Homo sapiens
atgacgtaaagatgagggcaagacacaagccatttccacccaaagggtgcagggtccaggagagactcccagccatcccaccctttccctcaggaaggcaaaggtcctaaggccccctggccctctggctggaaggcaccaggccccaggcccagcaggcaccaggagaaaggagacccctctcttcccacctcccgtggtggcccaggttcctcagcagcgcttcccactcactggcccattgcagcccaaatctccgaagccaggcacccatgggggccacggggcatgggggagtggggaggagtcctcggttgaccctcatctccctcccaaacctgccacttgattctggctccctgggccaattgcccccaattctgcccccgcccccatcatcctctatctcttccttccctagtgtcccctatctcactcaagctcaccccatttctgcctggctgtccccactctccatccccaaatcatcattcaaaactctctgttcccccagctccggacagcccctgactccatgccttctcccgactcatccgctgtcccttgtcccaggggttcccctccctcctaacacacacacaccggctcagggagggagaggaaatggtgcaccaggagagagaaaaggcaaaaggtcataggcagtcgggtgggcggggaggaaggaaagtgaaaggtgacaggagagctgggagctgtcccgacatgtcctggtttgcccctcccccaggggggcctgttctcccgactccccccaggcccccttagacgcttttccagggctctgcagaagggcacctgaagatggtgggggccggggtcagcgggcgagtgaggctggagacctcccccggatcccccatgctggaacagcggggacaggggcctcctcaagttcacttctcctgggtcccctgttcgtcccagcatcccaaggcagtgctgaggccccggggtggctgcgggaggggggccacacccctatatctcacctagcgcagaccacacgcttccagacaccagcagatggaggcggcacctgctcccgtcccaggccggagtttgcaagct

SEQ ID NO: 56 - DNA, 1046 bp, Homo sapiens
ggagatggagacaagagaaagcaggcaggtggtttgggatttggcaggaaaaggttggaaggaaaggggaaagggtctccgcatggatttctcagctccccatggatttctcagccctcgtgagagccacggcgccctggggactggaagtgtgggtccgcaggccccagtccccaggtttgtctgagcatagatgccctgcctgcttccagggggactcgggcccctctgccagggtcaactttgtacccaagacggctgaaatacaatggaaattcagacggcccaacagggagtggcagtcacctcaaaggccccactagacgggtgcggggcaccactgcagagcccctccctggctgtgccaaggccgtccacgcctgcagggggccccactgccgggctgttctttggcaacagtggcttgtccctgtttcctgggggcttggccagtgccagggtgggctccaaacgcacggctctgggctcttggactcacccctgctttgggcaggcagtggaaggcaggccccacaagagctgctcactcccgtcacctgtctccctcgggggtctagggtcgaacctcctgtgagcccctcctctccatgcagcccttggactggtcctggcggaccaccgagttccccgcgcagggggcaggtgcgccccacctgggtgccaagggaggcgacaccatctctcccccttggggtggcccagccttgcctaccatgatctccagggccggggctcagccctcatgcctgggaacagaggctgctttacggggtgagggcctggggccccccgagccttccccaggcaggcagcatctcggaaggagccctggtgggtttaattatggagccggcgctgaccggcgtccccgccctccccacgcagcctccttggtgcggtccaacacatcaccgggcaagctgaggcctgccccggacttggatgaatactcatgaggaataaaggggtgggccgcgggttttgttgttggattcagccagttgacagaactaagggagatggga

SEQ ID NO: 57 - DNA, 1099 bp, Homo sapiens
tatatgtgggacagagccttggtctggaaaacactttcaagcccactgtctcactctcttgtcactataaataacctggtgagttggcagtcccggcgtgaatgcccacaatttgcaggtatgcaaacagaacagaggggctaagttccgtgggtcacatgagagctaggctgcagcgcctggggaggcggccgttcccgcccggtgcgcttgttgtccgctggagcagaggcccccgagcctgctgacctctctgccttcaggcctggtctcgcagtcccttgtgcctcgcctataggcaggcggaatccagagcgtgcagcaagcccggccggctctcggtggcggtttctacagcaggtggggcctggctccgtgattgagcggcctctacccctctatctggggcccagcagcggccccctcccagcaccctggctacacgtctaaccctaggctgaccaggtggggctctcggaggcgttagccccagccctcccaggagtcttaatgttcctctcacaggaaaaaacgttctgcgccctttgtgccccaaaccctcgacccttcactcggcgagaggggtcgctgagggagagatccacctctgcccttcccgttgcccgccggttcttcctcgcccgcctcttacgcaccccgctcccgccggctcctggaaagccggccccggccccagcgcttccctccccggcctagcccctctctcccacccttccgctcgcccaggccttcacgctcagctcccggtttttgttgcccgggcttgtttcggagctgagcgcgccgccggccgggcgccaggtcacgtgcgttggtgacaacctctcgcagggcggccccggggcccccgcaccgccgattggtggggcccggcctggcgcggcccggggcggggcagcggggcccgacggcgagcggagcggccgatcagctgttgcgagcgctgcacaacaacaaaaggacttggactggccggcctgggcgcagcgacccgagggctggagccggccccgcgcctgccgtctgggtacctgaacgaggtgcagcgcagcccggccccaccgcagctacctcagca

SEQ ID NO: 58 - DNA, 973 bp, Homo sapiens
ttggtctcctgtttccttaccaagcttttaccatggtaacccctggtcccgttcagccaccaccaccccacccagcacacctccaacctcagccagacaaggttgttgacacaagagagccctcaggggcacagagagagtctggacacgtggggagtcagccgtgtatcatcggaggcggccgggcacatggcagggatgagggaaagaccaagagtcctctgttgggcccaagtcctagacagacaaaacctagacaatcacgtggctggctgcatgccctgtggctgttgggctgggcccaggaggagggaggggcgctctttcctggaggtggtccagagcaccgggtggacagccctgggggaaaacttccacgttttgatggaggttatctttgataactccacagtgacctggttcgccaaaggaaaagcaggcaacgtgagctgttttttttttctccaagctgaacactaggggtcctaggctttttgggtcacccggcatggcagacagtcaacctggcaggacatccgggagagacagacacaggcagagggcagaaaggtcaagggaggttctcaggccaaggctattggggtttgctcaattgttcctgaatgctcttacacacgtacacacacagagcagcacacacacacacacacacatgcctcagcaagtcccagagagggaggtgtcgagggggacccgctggctgttcagacggactcccagagccagtgagtgggtggggctggaacatgagttcatctatttcctgcccacatctggtataaaaggaggcagtggcccacagaggagcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggta

SEQ ID NO: 59 - DNA, 911 bp, Homo sapiens
ggaggggtaaagttcttggaatgctgagattattaaattattattcgttattaaaactctagttacttagcacttacagctctttagcttagaaatagtctaaatacgttgctatatttgcttttttaataaccagcgctcccgttattcaggtaaagaattaaaaacatctaaaaggtaattgctttgtaaatcctaacctctttcattcaaaatacctaaggtagatggctctttataaacgtgcccggctcagagagctctcatctatattatatctccgaatccaaatttcactgatgcccagtctaagagtgtttcctgggctttgagctttgagatagaacgaagcaggtggatcctggctttgactaggcagggccagaccaggcccgacccagccagcccatccgtagagtcagcatcagccgggcgtgaagattggtgtcggctcctgcgttccgccaagttcaggaacctggcatgggccggccgcctcccgcgaagggacacacctgttggtcaccgcgctcttactggccagacccggatattggccttctggcgtcagcggcaggggcatgtccctggccggagagcacaggccagagtggggtgacgtcatcgaaggcacgtcccagccttgcagagcggtgggcggggcctgcgaagaaggtgtgccgggggctggttggaggcgcgggcggcggggccaatgtggcggtgacgtcacggggcgggcggacgctggcgcgggtaggtaagagcagcggcgggcggtggcgctcactcccggcttccaaccgcgcggagcctctgccttggagattctcagtgctgcggatcatgtccctaaggggcagcctctcgcgtctcctccagacgcgagtgcattccatcctgaagaaatc

SEQ ID NO: 60 - DNA, 1088 bp, Homo sapiens
ggtggcactcagtctctcttctctccagctgactaaactttttttctgtaccagttaatttttccaactactaatagaataaaggcagttttctaaacttcctgtatcctgttgtttgtgttgctctctccagggctgggggtaggaggatgcaaggacttcctggcctagctcaccctggagaggtttgttgagtgcaaaggactagcttgtgccccacctcccacccacccagcagctaatctggtccctcccaacaacatggaaatgattaccctgtaccgcattctggttcagatttgggggtagggtgaatgcagcctgaggaggccagggagggaggactccggcagcgtttccttggcctcggcgagctactgggctccacttaaggaggctggggcagagcttccaggactctgcccggttagaaaacccgcacgagggcggtgccgctttggagacagggaggagggagaccggaagcctagatccctctggctgtcccctgcactgccggtaacatggcacaggagaggagggctgtttgtgcacgggcagctcctgcagctgctgccgtcgcccaccagcctcctatgccaaaccccacatcctaactcaggaacctctgagaaaaaacggagccctcgagggccccagcccttggaagggtaacctggaccgctgccgcctggttgcctgggccagaccagacatgcctgctgctccttccggcttaggaggagcacgcgtcccgctcgggcgcactctccagccttttcctggctgaggaggggccgagccctccgggtagggcgggggccggatgaggcgggaccctcaggcccggaaaactgcctgtgccacgtgacccgccgccggccagttaaaaggaggcgcctgctggcctccccttacagtgcttgttcggggcgctccgctggcttcttggacaattgcgccatgtgtgctgctcggctagcggcggcggcggcggcggcccagtcggtgtatgccttctcggcgcgcccgctggccggcggggagcctgtgagcctgggctccctgcggggcaaggtactacttat

SEQ ID NO: 61 - DNA, 1076 bp, Homo sapiens
ttcacctttaatttctcctggggccacccccaactccagcgaccccgtgagcagctgaggctctaccgcgctcggtcctggccagcgacgcagcccttccctggcggggctccagggcttctggcccctgtggtccgccaggtgtgggggcccacggcctcaccgcgcctaccccactccccccggcgaagctacgcggcgctcagcttcccagggacgccggcggcgccctcggctcctccgctccgccccgccctccccctggtctcgcactggagccgacggcccgcgcccacctcacctcagggcggcctcccgcccccacccccggccccggcgtccgggcaaatcctgcagcgcgagagcaattccctgccacccgaccttcgcactcgctgtcgctcgctcgagcctcgctccccacgtccttccttccgacccgcggctggaccctcctcacaaatttctcagagaggctcacctcaaagcgcggcgcacgaggccgggctcccgggacgcaagcctctagagggcgcgcgagaggccccgcccccgcccttcggccccacccaccagccccgcccccacccgcacccaccaggccccgcccccacctccccacccaccagccccgcccccacctccccacccaccagccccgcccctcatgccccgccaataaggccccacccgcctcccccgtcccgtcgccttcacccaccatccccgctccctcaggccccgccccacgccgcatggggcaccaagcgctccaccactgtggtcgcctggcacaccccggggtcacgctcgcggcgctctgattggttgcgtgggcgtcggcccacctaagcctgagcgcctgccgaggcctgcgcctgcgtagtgcgcgcgggaggggcgggaggggcgggaggggcgggaggggcggggctgggcggcaggtcccgggtgcggacatctggcagctggcagtgggcggcgtagagcactgcagcagcaatgacggagggcacgtgagtcccctcgccccgggctcctgacgaatgcggggtggtcctaggtgctgaggagag

SEQ ID NO: 62 - DNA, 1200 bp, Homo sapiens
aatggagtccctttcctcagagtgcatggcctggcaaaaatccttgaattcagtatcaacttcccttcacaggcaaggctctgcaccctccccacggatgcctaatcctgaaaccattttgttttaggtttagttagaaagctttgtctcaagagcacttttgtttgttctgttttctttaagtcaaggtagttttgaataaaggagacaatatttgagtatttacaaatcgggtatttagactatttacacatatacaagttctgggtgaagtattctgctccaatttgcaatctacgcacactttgctagaaaacgttaagactgaattcaaatcaagtacagtatttcagaaatctttcaggtgaagcctagttctggttgctaggcaacctgacagactcccaagctgggaccacctcgcctcccacatttgaccatctctccagcggtgggacgcggagtacccattggcccgcatctcctctcacttagtcccaattggtcggagaacctctcactccgctcccgttggctctcgccgtatctcgcagctccgtcattggcaactgggctctcgtgccacctcacgtcagtctctcacaccacttcctcggccctgagactttgtccccgcctcttctccccgcccttccagccacgagggaaaatcctagcgagtcatcgcctctagtttccttttgattggtagaagccggactggggggcgggcgctgccgggcaactctaccggccgcgattggctgtgggagccaccgtcccgcctcccagcgactctcggcggtgccggagtcgggtgggttggcggctataaagctggtggcgaaggggaggcgccgcggactgtcctttcgtggctcactccctttcctctgctgccgctcggtcacgcttggtgagtgtcccgcgctggggagtagaactgggctgcggaggtgccgcgggcggggtgtgggccagacagaggcggtgtccttgactaggcccgaaggagctggggctctgggtcaggacgtaggcgtggactttgcccgggaggatggggcaccgtgagcggggccgggcgggggttccctcgtgagggacctgaggccgaccgtagcggatctgagaagatccgagaacacaggcgagtcgcggaggggagaacgcgagagggcgttgaggtctaggtattct

SEQ ID NO: 63 - DNA, 1192 bp, Homo sapiens
atcctgctgagaggttagcactgcctgccaaagtcagtttgcaaaatcccagagaaatccagcttattcctgggggaaccgccaagactgcccagccctgtgtggggttcaggcaagtttctcacatgtgcctttttggcaagaggcctctggcaaccccatgagtccccaaagagactcaattctaaaagttggtctccaccagctctctgtggcttaggggttcaagttcaactgtgaaagccctgttttgttttgattttgctttgagggagaggaaaccgcccttctgtttgttcaactccttctcctaaggggagaaatcaatatttacgtccagactccaggtatccgtacaattgatttttcagatgtttatactcagccaaaggcgggatcccacaaaacaaaaaatatttttttggctgtacttttgtgaagattttatttaaattcctgattgatcagtgtctattaggtgatttggaataacaatgtaaaaacaatatacaacgaaaggaagctaaaaatctatacacaattcctagaaaggaaaaggcaaatatagaaagtggcggaagttcccaacatttttagtgttttccttttgaggcagagaggacaatggcattaggctattggaggatcttgaaaggctgttgttatccttctgtggacaacaacagcaaaatgttaacagttaaacatcgagaaatttcaggaggatctttcagaagatgcgtttccaattttgagggggcgtcagctcttcaccggagacccaaatacaacaaatcaagtcgcctgccctggcgacactttcgaaggactggagtgggaatcagagcttcacgggttaaaaagccgatgtcacatcggccgttcgaaactcctcctcttgcagtgaggtgaagacatttgaaaatcaccccactgcaaactcctccccctgctagaaacctcacattgaaatgctgtaaatgacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcaggtaaggcttgctccaggcgccagaataggttgagagggagccc

SEQ ID NO: 64 - DNA, 1162 bp, Homo sapiens
ctaaagcgactcagggcagtctcagctcaggaagacttctttttttgaccttctggcttaaagccacaaccccaggctgaggatgccacatcaacggcgtttcctcgccacgctgcaggcgtgactcacgtttctaagcctgcagggtccccgggccaagcgcggctactgagagcacagcgtcctccctcagcccctgctcatctgcacggagcaaagccgcagctttctctgctgtcagcgctttatacgactcggatgtaggctctgagcgggcacgggcccgccctcagacggcgacccgaggggcaaacaggatggaggcgcgctcccttggaggctgtggtctcgattttatctgctcctgggtggtgcgggtggtttgctctctaggcgtgagcaaaggccacaaggggcccgaaaaaatcacccaaggatgcaagcccgccattgcgctgagcaggggcctccccgccgccagagcccgcgcccctccagggaggcccgcgcgatcgagacccgccgcctcccggccaggcgcgggacaccaggcgaggggagccaggagccgggaggggcggcgccgggcccgcaaccccaccctgtcctgcctccgcctcctcccggcaggaccgtcccctcccaggccccagctccgcggccgcccactcgcagccggccagtcccgctcgggcccgcgtgccccgcagccgccacgcgccccgcagtccgtgccgaggctcccgcccgagtgcgcgcgggccggcggtggcgtgtgcgcacgtcatatgggccgccggcctcccattggttgcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggtacgcggccggctgggataggggtcgcgggcgggctttggtcgcgcagcagccggtcctccccggaggtaggcgggcgcgggccctgttgggtctttgggacg

SEQ ID NO: 65 - DNA, 3237 bp, Homo sapiens
gcctgggctctgtctctaaaaataaaaaaattatacttttataaactctttccttgaagggttaaatgcatatgaggaagcggcacatggacttccttggcgcttcccccaccctccctttctaccttgtgtccataccaaattttgtgatttatcactaagtacaaattattagttaagtgctataaagattcttttgaaataccttttgggaaggatatagaatttattttaagagcataaaactagacaactggtgtttctttattgcttgctttggaactcatattcctattggagttcccaattaggcagtttgcgaatgaaaatttctaaatcttgggctaaagcctgttttggtaacaactttagtccttatttgaattacattagtaggcatgtgtacaacctgtaacttctgagatatttggtccttgagacttctagcggcattaaaaatatgacaggttctaggctctcggtacttacacacttttctctcttttttttttttttttttgacaaggctgctaagagaacactgcaatctttgggtagttcacccgttttctttactgtgcaaggttcataaaggcaggcactatgtctgtcatgtttgtcactatatctcccatgccaaccacagtgtgtacttcacataatgagcatttcaaaggcaacatttggtaaagagatatgaatgaaggtcttacactgaagcagtggggaacagtagaaccagcctaagcattagatctgggttcaaattccagttttgctcattatctatgtgatctacagcaagttgcttgacaaactttaatttttacttttttgtaaaatgggaataatacctattatataaggattataagaatctataatcatttattaaaactaaggagtgtttagtgttttcttcgtaatgtgtttcaaaatatgggctttaaaaattgagtgaaatacaattcctgtccttaataaatttccacatacgatagtaagacaaataaaaaaatactacggaaattttatgggttttcaaggtcgggagtgatgatgtgtttgagggaattaggaaaggaggtggcatatgaaaaagtccttaagggatatttaggatctcagcagttaaaatgggtaggcatatccaaggtaaacaaagagaacataagcagggaggtaaaaaggtactgagtgtgactgaagaagggccagttactcctggctgaactgtaaggttcgcacaggaaagtagagatacgtcagaaatgtgtggtggggccatattagtggtgacaggttctttctttaatccagtagacaatgagaaacgctgatttgggtctatggcataataggaagtagtatgccacatactgcatgtgggagttctgcaggacagattgggaagtgcatgcgtgtaagactgggaagaccagttaggagaggctattgcactgttttaagtaagacataataaagccctgcaccaggcggagagcagaaggaacgcacagaagacgcaggagaggcacatttcagagagaatccagtatgcaatggatgtcgcacacaagagagagagacgcaggtgaccggagccatttacactaatgggtaaatctcgggaaagcgctggtttcggctaccggccagttacaggtttgaggtgcccgtcgccgccaccttccctttttttatattcctctttttctcatggccgcctccgcttccctccatctctcccgcgctagtaactgagctttcagtcatcgacctgaccctgcgttttccctcacgctccgattctgcttcctatcactgcctcctactgtactatcacagccaggacgagcacgggtcaggcactgaggctgtgggacactccacccgcctggtcccctatcgcctccgcctaggcagctgccatgcgtgcgcccccacagctctaggaccaataggcaggccctagtgctgggactcgaacggctattggttggccgagccgtggtgagagatggtgcggtgcctgttcttggccctgcagagagctgtgggcggttgttaaggcgaccgttcgtgacgtagcgccgtcaggccgagcagcccccaggcgattggctagacaatcgaacgatcctctcttattggtcgaaggctcgtccagctccgagcgtgcgtaaggtgagggctccttccgctccgcgactgcgttaactggagccaggctgagcgtcggcgccggggttcggtggcctctagtgagatctggaggtgaggcgggcggtgaccgagaagaggggcaggggcggcggggagcggggcggagatgggtgggagcggggtttgggctgtgttggtggcaattctggagcttccctcggccctgggaagtggctaccggcagctcctgcggacctggagggggctgcggttgcgctttgtcggtgtggcagctcggacccgcggggactgcaaggaatgtccttgaggcccggcaggccgagcggcggccggcatcagtgccggagtaacccggggtcccggggtgggcttgagaggcgggcggcggtctggcctcttcgtgactgcggtcatcatcggtggacccgcggggcgtagctgcgttcatcgtccctgttcagtcagagtaggcagtgctggctgcacggtcacgaaaatcggggcggaaagggtgtcaggcagggtgacctcggaggcccctggattcgagaaatgctaggggtctatggggctgtcgggccggcagctcgcagggcagacgggagaagcgcctgcatcccgggatccgggcattcacgcccaggaactgctgttcgttagcacctttcttttaggtgacgggaaagatctctgtaaatactgctgactaacttagaaccatgaaagaaccgtggattggtgtagatgtgtctggttatttacaggagaacggcttgagaggatgcggagcccaacgtggggattcgcacaatgactcaaaagattcttctccctctttttttttttttttttttggtaaggggtgtagtctccttggtgctgatattcttttaggaaaaatgtaccttggagatacaaatatagaacagttaatttctgcagtaggaggaggtcgatgtactccattcttaagtagtcgtttgaaatatttcaggatttgaggatattccttcttagacatggtcctgcagagtcgtaggaagcatttgt

SEQ ID NO: 66 - DNA, 1165 bp, Homo sapiens
actttatcccaaagcgtccatttactcttctgtgaaatactactttatagtgttgtttggcctaaattaaacaaaccatgcaaaaagcccagccctgtgcctggcatacagtgagtgctcatgtgtttgctgctattatattctcctaatccagtttgaaagctgtgaggcagcaactttccaggaaaagatggcttcagccaagggtatgttcctaggacctaccctaaagttagtctctcctattagagtagtttgaagctgaacttggctgaaaactataagaaaggctggtttaggggaagcctttgttacttttagtttcttgagatctcttcttgacctaactcttcaatgctcaccacgtgtcatccattctccagcactgtttctgtgtacctgactgacagtttgcctcacagtaaaatgattcctctgggctccctaggtgaaaggatgttgggcatagcaagttgtaatgctgttgatctcagaaatccttccgatgctccaaaaaataaagcaatgagcaagacatgtctagccagcaggaaatatccttcatacaaaatggttaatttctaaaacctgtggcatcaccttgacagatctcttctgtttggtttatacgggggaatccaactggaagagtccttcctgacccttggtctgcctgggcagaggaggtactgtcctctgaccatcagattatgttgggtctagcaggctgccttcttccaggctttgtgcaccaacattaaaaaggcagtcatttctcaaaattgtttgggaaatgattaacttgtttcctttgatcctccctgctctgtgtgaggacagtcaagtagcagaggtggagaatgtgttctattattttcaacagtgctaagtaaacactgggggaaattctgccactagagaggtacaactgtgtttgagggtttgaaggcgtgcgcgcgtgtgtgtgtgtatgtgtgtgtgtgtgtccttctgaaaacatagagctattgagtacaaaaatatggccatttcctctaaattttctttcccctgttttttttttaaggtctgaatttcctgctgctgttcacaaagatgctttttatctttaactttttgttttccccacttccgaccccggcgttgatctgcatcctgacatttg

SEQ ID NO: 67 - DNA, 910 bp, Homo sapiens
ctcagaagagacaaagagcgaggaaggccccgcgggacgcgaaccccggcacccgggccaggcggcagcgccgccccccaaggttagacccccgtgcgcccgcccggggccagcggcggacgggacccgcgctcacagcgagcagcatccccggccccagcgggacccgcgtcccaaagacccaacagggcccgcgcccgcctacctccggggaggaccggctgctgcgcgaccaaagcccgcccgcgacccctatcccagccggccgcgtacctggccgagaggcgcccgcccgccggctctccgaacggaggcggggcgggggaaaggaggagtcacggcccgggacggccgcagcgcctggcgggcgcgcgggtttatatggcgggccgcggggcccgcatcacgtgagcctgcccggcctacccaccgcccgcgcgcaccgcccaggggcgtggcctgagcttgccccgccccgcccgcgagcccgtccgcacgcggtctggtgaggcggccgcaaccaatgggaggccggcggcccatatgacgtgcgcacacgccaccgccggcccgcgcgcactcgggcgggagcctcggcacggactgcggggcgcgtggcggctgcggggcacgcgggcccgagcgggactggccggctgcgagtgggcggccgcggagctggggcctgggaggggacggtcctgccgggaggaggcggaggcaggacagggtggggttgcgggcccggcgccgcccctcccggctcctggctcccctcgcctggtgtcccgcgcctggccgggaggcggcgggtctcgatcgcgcgggcctccctggaggggcgcgggctctggcggcggggaggcccctgctcagcgcaatggcgggcttgcatccttgggtgattttt

SEQ ID NO: 68 - DNA, 1026 bp, Homo sapiens
gaaaacagtcttacgatgcccactcccagtactccccttcccagtaagtactccgacttcccaattacttctagatttggccaaatattagtaagttgttaagatgtatattgtgtcagtaccgagtaataaaactcaatccatctggcaccttcgtgccttctccaagaagctaaagcatcccctgaatgcccctgtatttaaattgtaaaaaacattgtaacagaacacgatacaccttttcccagctgtgtgtggaaattttggcagaatgaggaggccagggggccaaggtctgagagagtcaggggcctgtgagggattcgagtcttttttgcccagggaggttcaccgaggggatcagggaatgcaaggggagcccgaggggcgggtgtgggcctgttgtgggtgaagaggaggcagcagcgaagcgcaggcccagtaggttggttagcgtctgtaccctactctcccgggaaagagctcaaaggaaagactggtgcgctaaagccgagaaaggcgcaggagaggcggcgtggccgagctggggcctgggaagggctcagccgctgggcgtggggcgcgacagagcggcagcactcaccatagccaaaggagtccgctgccggttgttaggcaaccgacgtgtacactgactcggcgccgttcccaccgccccgcgcgcgcagccccgctccccattggccgtccgctcgtcgccgcctctccctattggtgcagggccgaagagggtgggactaacctggcaaagccccggcccagcgcggggaggggcacgctggcgacagagccccgtctttattgggcaagatcacgccgtgagcgccaattggctgagtcgtcgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacgggtaagagtcgtg

SEQ ID NO: 69 - DNA, 991 bp, Homo sapiens
ggatttcagcttttgctggtaaccgtggcagctcccctacactggttgctgagtgagggcagggccatctgctttgctcaccaccctacccgaggcttgcaacactgcctggcacagagcgggcctggggagtttactcgggctgaaatgccttccttcattctttctcctccgggcctcccatctgcctcagtgaactggaaaaagaggaagagtgccagccatagccttccatgcttccaatggcctctggagttcacgaacaggtcttcacctttctgggctgcttccaagtgtacacaatggagctcaccactccccactgcccaggactgctgtgtagctcaaatgaattcgtggaaagtgccccctaaaaatgaaaagatgcctctggagaccttgcgcacaccgagtggcacgacctgcagaggttaccgccaggtttccatcctccgcgcccgggaaccgcctgtccggccaaagggtgactgactcagggccggggcgcctcccagccctccggcggaaagccactgcaaaaccgcttaaggcgcgtttggaagaggcggccccgcagccccgagggcctggggccctgagtcccaactgcccacccccagtattcgcagcggaccccaccggcacccagtccctggcacccccgcctcgcgcggcggcggggagaaaagggtggagcggtccgactcccgcagccaatgaaagctgcgggttcctggtccgatccccggcgcggctcgccattggtcgccgcccgggtctcggcccaccgaacctcggcgacccgagccaatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggt

SEQ ID NO: 70 - DNA, 1059 bp, Homo sapiens
cgggaagctgctaaggaggggccgtcgggtgggtggacgtccgtctcgggtctgggttccccgccgcacccgcgaggaaaaccggggatgcgctgcgatgaccggcagtaaccccggccggggcgcccgcggccggggtcaacgcccgcacttgcgccgcggcccgcgaggcatccgggaccgccccgccgcccgcccatcaccctatcgcctagcaacgcccacccgcgcgccgccattgggccggtgcgaacacccctggcgcccgattggttgctgctgccgccgcgccgcgcaacgccgcgccctcagccagctccgcgcgggcagcgacggcggcgtggagtcggcggccgaagtgcgggcacgcgggtccgtccgtccttccgcgcgcctgtgggtccgagcgccccgccgcagccggctggacccccggtgtggccacggggtagtccccagtgtggcccaagcattcccatcccgcacacgtggccccggcggacacgggggtcggggatggctcgggaggcgcgccgcgggctcggtcgcagccgcgtgcgcgtcggggcccgcggggcgggaggcggaagtcggggggcggtggtttcccgcccgccccgcccccggcgctcctcagtcccagccccacccccccaggcgcgttcccgcgcagggtcccggctcgggcggcggcgcgcacgagcatcaccccaccggcggcggcgcgccgggtcccggggcgcagccccgacgctcattggcctgggcggcgcagccaagctgtcagcccatgtggcgtggccgcccggggatggccgcggtttaaatagcgtcggcgccggcctagagggagccagagagacggcagcggccccggcctccctctccgccgcgcttcagcctcccgctccgccgcgctccagcctcgctctccgccgcccgcaccgccgcccgcgccctcaccaggtacgagcagccggcgctggggccggggcgcgggtcgtggtcggggctgggcccggggttcccggggtggcccggctcctcatcctccgctct

SEQ ID NO: 71 - DNA, 800 bp, Homo sapiens
gcctctacaaaatgagaaggggttcaataccgttaactccgggcctgggtaaaagactcaagtcctgaccccatcatactccaaccaatacataccccgcctgcgctgtctgcgcctgggtctcttcaaccgcagtgagcggtcgcacggctccacatcagggtcgccctgaggctcagccttccccggccccattccgagtgcgcacaggactgaacgagcacgcccggtccctgctccggagcggaggacacgacgcggacccgcacggtgcaccgcagtgacctgaggaaggagcgacgggcgctcgcgccaaaggcgtccgagtgcctggtaaactgtaaagcgcggtcctgcgtgagttgctatggctacagctgcgccaggcggacggcctgcaggaccgaggtgcagctgggacgagcggaaagctctgcgcgtgggcggggagcccggagcctcgccggggcaatgtcatctaggtgctcggcgctccactgatccggcccccgggggtgggcgggcacgtttgcctcggatggtctaacaggcgtcggggagagccaatggtgtggcttcatggctccacccccttccattcgattggccggcgccgaaaagccgggcgtgagcggccgcagtttctggagggagccgctgcgggtctttccctcactcgtcctccgcgcgtcgccgctcttcggttctgctctgtccgccgccatggcccagtgagtgactcgccaggggcagcccggctcggcctcagcgggcggggaactctttgggggtcgagatct

SEQ ID NO: 72 - DNA, 945 bp, Homo sapiens
atgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcggggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcaggtactgtggacgggcggcggagttcgggagacaggggcagggcggcatcggggagctgcgggacggggcggggaggaggcccgaggtctgagccacccgtgaggtctcggcgcggaggcctggacagctgggggtggcggcgttggtctcccgaactggag

SEQ ID NO: 73 - DNA, 1162 bp, Homo sapiens
aggaatctgcgtgctcactttacgttcaacttgtttgtatgctgaacatttttcaaaacaaaaaggtgcagggaaaaaagaaaacatgatgtctctctgagggccacagagacgtggcaaccagatcgctctgacagtaaggcctgttacccgagctgttgggtgtggggtcagcagacaccttcagctgccccctcctccagggctgcctcgccccaggtcatgccctcgcaacgtggcccgtgcgtccggctcgcactgtggctcagcttctccctttgcccagtcctgctgctccctcccctcccgtcctcgcacaggtgtgcccccctaataagcaggccacccagactccatctcgggtcactttggcggtctcccagcggcgagccttccctgacacccatgtgtttacctgatcgtttatggaggatcctcttcgccccgggacgtgagccctaggaccaagaactgtgtctgttttgctccttgcggtgcaccggcgcctggacatacgctccatcaatgtgcgtcgcgagccgctgaagccccatttgccgagggggaaactgaggcacgatgatccaggtgatgagcctggcgcgttctccgcgcggcccacgtggccactccgccacgccccacccccagctggtcagctgggatcccgaagaagcgccagaggctgcgcccacccactagggcccgggcgggccggtggggcggcagggcggggcctgggccgtcaatctcgagtccggccgctgccgaatggcgggcgcggtgggcccggagtcagctcaggctcctcgaccaatcacggggcgcggagccgccgggcgtgcagggtccgcctccgattggcaggcaatcgctgacatcatccgggggcgggcgcccctgccctgcgggtgactccgacccctggctagagggtaggcggcgtggagcagcgcgcgcaagcgaggccaggggaaggtgggcgcaggtgaggggccgaggtgtgcgcaggtgagtggccaaggtgtgcgcaggtgaggccaggggaaggtgtgcgcagtggggggcgcttgcccaggtgagcaggtgcccactcacagggcgagggtggggtcaggggtagggggcgtgcgcgcaggtggggagagggtccagctcacag

SEQ ID NO: 74 - DNA, 1478 bp, Homo sapiens
caagagtgacctctggtggtcttcaacgctatactcctaccacatgctgtgtcgacatcagggagttaactgtatatggtctacaaagcagaggcatgaataatccaacccttgtttagcttataatcaataaataactgcctgggccaagtggctcgtacttgtaatcccagcactttcagaggtcgaggtggctggatcacttgaggtcaggagttcgagaccaggctggccaatctggagaaaccccctctctactaaaaacacaaaaattagctgggcatgctggcaggcacctgtaatccaggagaatcacttgaacccgggaagcgaggttgcagcctcccacgtagctggaattaaggcgcggaccagcacacctgggtaatttttgtatttttagtagagaaggggttttgccatgttgaccaggctggtctcagattcctgaccgcaggtgatccgcccaaagtgctggaattacaagtgtgagactcatctttttttttttttttttttgagacggagtcttgctctgtctccccagctagagtgcagtggttcgctggatctcagctcactgcaacctctgccttacgagttcaagcgattctcccgcctcagccctcctgagtggctgggattacaggcgcgcgccaccacgcccgactaattttttttttttgtatttttagtagagacggggtttcaccacattggtcaggctggtctcgaactcctgacctcatgatccacccgcctcggcctcccaaagtgctgggattacaggcgtgagccaccgtgcccggcccaagactcatctttcttaagcccttaaagcactttgcacacattacctcatggtattaccaccctcattcaacagatgaggaaagctagtttcaagcaagttcactgaggatcagagacgttaaatgatttgcctaaagttagagaactaataagtgagaaagctagtcctgctgcgttttactaacgtgccaatcagctgcccaggaagataatgaaaacttgagtaagacaggcagccaaagccacagcggggacgttcccagcctggctcgcttccggcactgacgcctccagccgcgacctctagacttcagcccttccattggtcgtccgtcacagtgccacagtgcgccatgctcacacgacggccagcagccaatcagcgcggctcatcttcgcccagccaggacacgcaggatcgcgttatctgtccctcccgcgggcacattgggagttgtagtctaattatatatttccgcccttagtgtggggagagcgggaactactcgacccacagagccgatcgcggagcggattctgcttttaggagtacccgccaacaagcgggaccgagcaggaatccgtatctgggaacaggtgagagaggatgtgtgctgggccttggaggaagggggccgagaccgggccttacttctgtaacgata

SEQ ID NO: 75 - DNA, 1125 bp, Homo sapiens
cgggaagctgctaaggaggggccgtcgggtgggtggacgtccgtctcgggtctgggttccccgccgcacccgcgaggaaaaccggggatgcgctgcgatgaccggcagtaaccccggccggggcgcccgcggccggggtcaacgcccgcacttgcgccgcggcccgcgaggcatccgggaccgccccgccgcccgcccatcaccctatcgcctagcaacgcccacccgcgcgccgccattgggccggtgcgaacacccctggcgcccgattggttgctgctgccgccgcgccgcgcaacgccgcgccctcagccagctccgcgcgggcagcgacggcggcgtggagtcggcggccgaagtgcgggcacgcgggtccgtccgtccttccgcgcgcctgtgggtccgagcgccccgccgcagccggctggacccccggtgtggccacggggtagtccccagtgtggcccaagcattcccatcccgcacacgtggccccggcggacacgggggtcggggatggctcgggaggcgcgccgcgggctcggtcgcagccgcgtgcgcgtcggggcccgcggggcgggaggcggaagtcggggggcggtggtttcccgcccgccccgcccccggcgctcctcagtcccagccccacccccccaggcgcgttcccgcgcagggtcccggctcgggcggcggcgcgcacgagcatcaccccaccggcggcggcgcgccgggtcccggggcgcagccccgacgctcattggcctgggcggcgcagccaagctgtcagcccatgtggcgtggccgcccggggatggccgcggtttaaatagcgtcggcgccggcctagagggagccagagagacggcagcggccccggcctccctctccgccgcgcttcagcctcccgctccgccgcgctccagcctcgctctccgccgcccgcaccgccgcccgcgccctcaccaggtacgagcagccggcgctggggccggggcgcgggtcgtggtcggggctgggcccggggttcccggggtggcccggctcctcatcctccgctctcggggcgcgcgtggcccggccccgtatccaggggtcgcctgggcggcctgtccgggtctcggtgtt

SEQ ID NO: 76 - DNA, 2532 bp, Homo sapiens
gacagtccacatcagctcttcaataggatttagtggctttgcataaaatggaaaagcagctgtgattgcaagagaaattaaaaataaccaccatctgaaatgcaaattgaaaacagtgagacaacacatgtcactctggcaggtgacccactgtgctggtgaaggcatgcaggcactctcagacttccgcagagagacctgagtaatcaattgacttccacaaagggcgacttgccaacagctatcaaaagtactcaggcacatcccacttggcccagcaattccacttccaggaatttctcctgcagaaatacatgtgcacaaacaacgtaggaaagcactgtttatagtaacaacccaactaggacagaccaggtatatttagacaacaaacaaggaagctttttactaaattgggatgatctctaagaagaaggtacgtagaaaaagcaaggtgggagaacacgctatgtgcttgtactatgcacgtcaatgaaaaaatacacaaagaattgacaggccaggtggagtggctcacacctaatcccagtactttggaagactgagatgggagggttccctgaggccaggacttcaaatcagcctgggcaacatagcaagacccccccacatctctacaaaaaaattaagaaaaaaattagccgggcatggtggtgtgtacctgtagtcccaactactgaggaaactgaggtgggaagatcccttgagccaggaggtcgaggctgcatggagctttgatcgtaccactgccctccagcctgagcaacagagtgagaaaaaaaacagactttttttctatttctggaaaaaaataaagaatttataagtatgatggttctggtaatagaagtaggtggctaggcagagtggacacttcacactgcatactcccctattttccgaaatctgagttttttttttttttttttttttttttgagatggagtcttgctctgtcaccctggctggagtacagcagcaccatctcggctcactgcaacttccgcctcctgagttcaagcaattgtcctgcctcagcctccccagtagctgggattacaggcgtgcaccacacgcccacctaattattgtatttttagtagagacagggtttcaccatgttggccaggctggtctcaaactcctgacctcgtgatccgcccacctcggcctcccaaagtgctgggattacaggtgtgagccaccatgcccagccaatctgagctatttaaaaactaaaggtaaaattttaaaaggggaaggggaaaatgggaagtcattgttttaaggggacagagtttctgtttggggtgagaaaactctagaaatagtgggggcgtggcacatgattggaatgaatggcagggaacggcacgcttaaatgttcctgtacgtttcacaggagaagtcaatgcacacacaagcgccgcaacccagtccaaggctttgctcctacagggccttacagggggtatttgagacgcccaccttaatgcaggttggacccagctccgggctgcggggcttccccgccccggggtctttcgtgtgagccccgtggcgggggatcctggcccaggacatggcgcggagaaggctgtgggcggcgggacagggtgccttcggctgccgggttaagagtggatcccgggatacatcctccagcgcctgccctcgggcctgtgtgcacccccatacccagcggggccgtccaagagcttcaaggagggcacagcgcgacccgccctcccctcagccccgcacaccgtcccacggccccgcacagcctccctcccacacagcgccccacggcacccgcacagcgccccacggccccttcatggtccccgcacagcgcctcacaacccgcacacagcgcctcacggaccctttacggcccccgcagagtctcccacacggcgccccacacagagcctcacggaccccgcacagcgcctcaaggtctccgcacagcccccagcacagcgcctcacacagcccttcgcacagccccccgcacagctcctcacgggccccacacagctgccgcacagccccgcacaagcccgcacagcaccagcagacaggtagcccccacaggcaacagcgcccacctcgccgcgcccagaccccggatcgccgacgcggacgccaggcgcctgggcacacggcgcctgcgcagacaacaccacgccccaggcctggcgagcgcaccctgcgggtggggcggacctacgtcagcaacccatcgtccgatcccgtccattggctgagaggtaatgcgtgcgcccgactcgccgctgattggtcggcgcgcgagcagccgggctcgcacgggccaatcctgtggtagcgcgtgaggaggcagaggcctctggggtgggatcgcgggccgtaagtggctgtggagctggggtcactgcgcggtgggaccatggcctcggagaagccgctggcggcagtcacttgtacagcgccggtcaacatcgcggtcatcaagtactgtgagtg

SEQ ID NO: 77 - DNA, 1156 bp, Homo sapiens
gctcaataaatgctagcggaatgaatggaaacgttccgacccgaggcagcggatcactccaggcttctcctcaaagcgagcacacctcagtccagggagggcgcaggagctggggctgctgcggtgaaccaaccccaaccccgaccccgacgccgatcccggccccagagcgcctcctaggcgacccctggccccacccacgccggagccggcccgcgcccatccccacgccccaacccgcaccacgcaacatcgccctagcgcctttcggggcgtcgccgcgcaggttgcgccgcctccgattggccaaacgcggcatagcgccatctcggcctaccgcgcggtgcgcgccctcattggccggcggcggcaggagcaggggtagggggcggggcagcacgcggggcgcgcggtatgggcggactcgcgcctgagccccgcccccggtccctcgtctgggccgagcccgcccagctggctgagacgcgtggagcctggcggcgagtgggggcgtgcgacggttactctggttactggggccgcgccgcgctggcgagagccgccgcccgcgagggatgctggtgaggaagccgtcgggagccgccgccgccatctgagggaggtaccctggaaaccaccttttatcggtggggaagtgcagtcgcggtgggcggctctgggggccagcgaaacgggaggcctctaaatctttaggttggggctgcattgccctggagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttctgaaagggcacctgctcttggtgagaaaagaaattatagcacgaagagccagtatcagaagagtatccatcacccgcagcaaccgctcagggaacaccatcaaaaaagaaaaaaagggaatatctggatttcctgggcgaggaggagcgagtctgctcgggagctgttccagcaggcgatttttaaata

SEQ ID NO: 78 - DNA, 2299 bp, Homo sapiens
gcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagccgggcgtggtggcgcatgcctgtaattccagctacttgggaggctgagacgggacaattgcctgaacccgggcggcggaggttgctgtgagcggagactgcaccattgcactcaagcctgggcaacaagaatgaaactgtctcaaaaaaaaaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcggggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcaggtactgtggacgggcggcggagttcgggagacaggggcagggcggcatcggggagctgcgggacggggcggggaggaggcccgaggtctgagccacccgtgaggtctcggcgcggaggcctggacagctgggggtggcggcgttggtctcccgaactggagggaggccgggccttcccgggctgtggtgggcgcccgcgccccgtggaaggcggaggcgtgagtcggggcgtcagagacgttgccattctttgtcagcggaaaagatcgtcgtctgcgcacagtcacctgaggtttaggaactcgtggaactggaaa

SEQ ID NO: 79 - DNA, 940 bp, Homo sapiens
aaaaaggttagcagagggattgccccactagtagataggaactgttacaacagcctgtgacaatgaagacagattgcaaacttcctacttaggcacagatgagaatgtaacacagaagaaactggccgcaactggttaaagccaagatggtcgaaaacttggctgactgctgacccttagcttcattatgcccttaatatcataaaacttccatggggaaattcccactcccatcatgcacctgacgccatgacagttccggattaaccatctttagtcaagaaaagggtggcaccccgattccgggaattgcccgcccatttcccagaaaacccctccccttgattacagagtactccataccttcattgtgcttattcatatagtacgtgaaccacattgcctgtgactcaaatctttgagtgcctgcactcctcccttgagggtgtcgttggttttgctccacaataaaatgtctatactttcgcttgggtctcattttcagattctcttatgctttgaagacaagaacctgcactgccctactggcaacacttttagataccctctgagatcagtgtgcttgtttataccagaaaaatgtcatcaccaggccccttagtcacaaagtgtatcaagaagtcatctgcggtcattttttacagtttctaggccactttctgtttccaatcagtgtagttcctatgtggcatgactcagatacaagtttctatagacattttcttctgtggctgctagtgagaacccaaaccagctcagccaattagagctccagttgtcactcctacccacactgggcctgggggtgaagggaagtgtttattaggggtacatgtgaagccgtccagaagtgtcagagtctttgtagctttgaaagtcacctaggttatttgggcatgctctcctgagtcctctgcta

SEQ ID NO: 80 - DNA, 927 bp, Homo sapiens
gagggcaatgtagcagttcaaataactcctcctttggaggaagggcaaggaagcagaagagaaccgctgaaggattcagcaatagcactaggtagcagtctcatgtaaccaagtttaacccacagttgaaatttccagttggtcatgtgagcaacggaagcaatttttaaactctggccaggagccccaatgcttacaaaaataaaagctttgttcggctcttattttgaaataaaatagatgttccagctgctccaacatgggcctaaacactgcagtgagaatgctcaggacacaaagttttgtgtccagagaagcccagtcatcattacaaaattgatctctaaaaggggttgggggacagacggcatagctgcttcccaaggaaatgagtaggaggtgacctgggtcctgactgccacactggctgggagcttggaccagatgatcctgatgggtttcttctgaataaaattccgggttgtgtttatcttgcagtttaaatcactgggagcttcgagagttctttggctccttccctttctggaattattgtgtgatataatcaagacatttacctggctctttaaatcagttggtttgccggctacagtgtaggtaaagagtatgtcataatggacaataaaaagttgtttacatacctcatttctgaaaagtcatgggccactggcaagttaggaaacgaaagtgaaatcagctgatagtgacatcagtcagaacaaatgtaccaaagttcagagagctgtttactaggcacgactgcgaaggcaagggggcaccagctcaggactgcatctgcctgccatttcccttccactcctcctttctggagtctgacattagaaagccagcgagaaggaagattcaaacaaccaaccctgatttcctgcttctccttttcatgag

SEQ ID NO: 81 - DNA, 909 bp, Homo sapiens
attaagtgcgtcttctatgcggagtgatcgcttttgtcacttgttcgaggggtgagagctcccgtcagttgtccctgtttctgtgagccgtctacgaagcccgggcttggcctgggcgacgctgagcggctttaaccggcggcgtccagccggctccgccagcgctgccgccgccctcgaggctccctctgactgaaggcgcgctgagcatcgcggcattaggggctcctggtccctcaaacatccagggaagccattttcagggactaggtactgacccccgcgagccgccacagccacagcccgcgctccgggccgaacgcccgagctcaagagctcccgagcttccgtcgggcggcggcctcacagctgggggccctgaggcggaaggcgcagccgctcagctgcggaccgggggcgtggcgagggcgcacaggttctgtttttcgccggcccggggccgctttcggtttcgtttcccgccggcgtctccaccctgcgagagccgcccgccagccagcgtccgccgccgtccgcgtcgcgccacccgcggtccgacgggagcaggcccagcggccatggcccaggccggcgtcgtcggtgaggtcacccaggtgctgtgcgcggccgggggcgccctggagttgcccgagctgcggcgccgcttgcggatgggcttgagcgccgacgcgctggagcggctgctgcggcagcgtgggcgcttcgtggtggcggtgcgggcgggcggcgcagccgcggccccggagcgcgtggtgctggccgcctcgccgctgcgcctgtgtcgcgcgcaccagggctccaagccgggctgcgtggggctctgcgcgcagctccacctctgcaggttcatggtctacggcgcctgcaagttcctgagagccgggtaag

SEQ ID NO: 82 - DNA, 1099 bp, Homo sapiens
tcttttggttatcttggaggcaatatataaccacataaggtaaaattggatgctgcttgctttctctaaaagctgtgaggatgtctttctgttccagaaattgcttaatgcaagtaaatgaaaatatactgaatacatgagtaaattcataaacagaaatacaaatgaaatttctaaagtaggtcctggtgagccccaattttatgaattattagaagacaatgcacccagaaactaagacactagcttgaagacttttttcatttcttttctttttttttttttttttttttgttgctgatgttgttgttgttgttgtcgttgttttgaaacagtgtctcactcttgcgccttggctggagtgaagtggctcgatctaggctcattgaaggctccatctcccaagcttaagcgatcctccccacctcagcctcagggaatggatgggactgcaggtgcacaccaccatacccggctattaatttacttttgtattttttgtagagacgaggtttcgctatggcttcaagactttaaaaggcaacaatgactcttttgaaattgcctgcattatcaaatgcctgaagtcaaccacaatgaatggtgagtctggtttctccatgacactagcaatcctctgaaataaaggaagttagaattccagaacacgtttgggtctctgactcttcctcggtggcttccaggagtttaggtcagcctgcaggcccgaccggaacccccgacacccctccacgcggattctttacatctccctccctaccttgtttacgccctagggggtagggaaatgaacagtcagtcaggtgagacccagcagggggagtggtgagctggtccgagggcagcccgaatatgtccctgggtgtgggtatgggtgtggggcaatttgggtgggagcagcgtggaggctcccaggaccaagtcctgcgcctctttggcggggtgtgtgcaggaggaggggggataaataggaggctccctcctcccggcgacattcacggagccggccggcctcccgccctgggtgtttccctgccttgtagccagggtgccagcctgggaagtagtttcgtttcct

SEQ ID NO: 83 - DNA, 916 bp, Homo sapiens
cctcttgactcagtccatcttcctagcagtcacagaatgcagatgagtactaagacattgcacatttcaaagttcacttcctgccttggcttcttcaagtgtaagtcagggaagaattaatcattggaacagcctcctgctttgcccaaaataaaaaagagctctgattaagggagagccaaatggtcagcaagagagaaagaactaacaaccccagacctccccctgcccccgcaacccccgcatccctgtgaggctttgtcaaatgcttagggaaggaggatgcagcctatcctcttcccaaccctcaagagggtccgcagcacttcacaaaagcacctgccagtgacagaagcctgctagggttaccacattcgtcccctcagtcgtctaagatcacgcagaaatgcttttgtttttggaacctgctgcggcctcaagcgcaacagtaaaaggccctttcaaagggctggtaagggaagagcccaaactgttttttcttaatgatagggcactaggagcccaccttctccaccaaaacaacattaatggcgtgtgggactgcctattccaccctcacgcggtaaccgcggcccaaaggcaggtctccgcccgctaccagtccagcgccccgacctctggcacagaggcggccagcggactccggataagcagagacacctagcggagcacccctgacttccgggagcgcccgcggccccgcccaccgcccgacttccggtaccggcggggcccgcccgccgcgcgcaccccgggcagagtccctctccttccgggaagcccgcggccgccccggcctccacgcaagcacccgagcgttactttcgtttccgcggcaaacgtctggaggcccgggtgagggaagaagcggcggcggagggttggggattactcc

SEQ ID NO: 84 - DNA, 1076 bp, Homo sapiens
taaccgcatccctctttgatttactgcgggagtttcccatcttccttcttgttaatgccctccaacccccacccaacccttgctgcagagaatctgcctccctctggttttcctcctcacggagcccctggctccctctcccccaccccaaggaaagtccctgctattgtttctccacccccacccactccaaggtgccgccccactccctgccctgagcactgaggtggttcttaaagcagggatgggtgaagcctgggcgcttccctctgccgggtggtcactcatagaacccctgagtgcccctgcggccacagcagctggcatttccaaaggagcagcttccagtactaccccaggttccggccacagaacttaacctggattcactcacttgatcctaaaacactgtgacgtctgtagacgtcatttgacagctgtagacgagagccacagaggggagggcgggctcagagcccacgtcctgaccccgggaccacggctgccagccccactgctacacccatgtaacggagggggagactgaggctctgggtggcaagtggagagggaagtggaaccatggggggccctgcaggacatggcgacacctgacggagagggacttggaggggaaagttggcctggcccagggacctgtagcccctctgtccccgtgggaatcaaggaggcagagagagtgcaggggaggatagaaacaagtggcctggtgatcagggacgggggcaaaccgaaggggattccccgttgttggcacggttacctgagcatctatttctggcctccaaaccaccccagaactatctggggcaaaaggaagtgaatagactgattaacttcctccaaccccctttctccaacctcaactagactctgagcattggaccagagcagctccaggaaaccagtttcatttccctcggccagtttcccaaaaggaggggtgggcggggctctgccagtttaaggggagagaaagggccacagcagagacagtggagggcagtggagaggaccgcgctgtcctgctgtcaccaagagctggaggtagtgac

SEQ ID NO: 85 - DNA, 1043 bp, Homo sapiens
cttgtcagcactttccctaatggaaatacaccattaattcctttccaaatgttttaattgtgagagtatctgatattcttgactgaacaatgtaaaaaacccaaagggggctgcgcacggcggctctcgcctaaatcccagcactttgggaggccgaggtgggcagatcacctgaggtcgggagttcgacaccagcctgaccaacatagagaaaccccgtctctactaaaaatacaaaattagccgggcgtggtggttcatgcctgtaatcccagctactcgggaggcttaggtaggagaatcacttgaacccgggaggcggaggttgtggtgggccaagattgtgccaccgcactccagcctgggtaacaaaagcgaaactccatctcaaaaaaagaaacgcaaacggtgcagctgcccctttttcgaggcacgtccacctcccattacccacttccttttttttttgagactgagtcttgctctgtcccctgggctgtagtggagtggctccatctcggctcactgcagccactcccaacgccctccactcctccctactccgcgctggccggggcggggttccgctggtcgcatccaataataagaacaggcggcgcgcgcccttcccggaaactcccgcctggccaccataaaagcgccggccctccgcttccccgcgagacgaaacttcccgtcccggcggctctggcacccaggtactggggaccccagacccacgcggtgcaggccgggagcgagagcctccgtgggggctccgtgaccccggaggggtagagccaagagctgggggagcctgagagatgagggtcgggcggggagggaggcggaggcggaggcggggttccgcggagctgagaaccggacggggtgggatcgaggagggtgcgaagcgccactgtttaggtttcgctttcccgggagcctgacccgcccctgacgtcgcctttcccgtctccgcagggtccggcctgcgccttcccgccaggcctggacactggttcaacacctgtgacttcatg

SEQ ID NO: 86 - DNA, 1077 bp, Homo sapiens
accaccttcctctcttatcccagctaagatactgagagtacaaactcctggttataattctaactccgctgcttactacctgtgttaatccaaattctctgtgcctcaatactcattagtcactgtgccaatgaactctggaactctgtgtgactctgggagtgtgtcgcagtccatcaggtgagtagaatttctataaatcgaggactactggtgttggactatggtaggaagctccctggggtactgtaggaagcaggtgtctctatttagcagcaggactggcccacaggtgcttttacagcggctggcaagtgtctgctcatgaatgaatggatgggtgggagcggagtgaaggagattacgcccccaggcctctgatccccaggcttgtaaaggtgagggggccgcggtgtggcaagagggaaagagtgctttggtgtttacaggccccgacttgaactgaatcctggctttgccacttacgagcggcaggacccctgggtgagttcatttactcagtttcctctattgtagaatggagctggtaagatccatcttcccaaccccaccccaaatatttgtgttgagagtaagtggaacccttgattcgagaacctagtgcggccagcggactaggccagcggagaaccctaggagccccgggggcgggggatgggggtgcagggtcctggccgtgcaggggcagcacgtgggtgccaagcccgcctgccggtgccaagcccgcccgccggtgccaagcccgcccgccagtgcctctcgcgcgcactctggatccagcgccaatttaccccaatcccgtagcagacgagggcttgtgcgagagggggccgggcggctgcagggaaggcggagtccaaggggaaaacgaaactgagaaccagctctcccgaagccgcgggtctccggccggcggcggcggcggcggcggcggcggcgcaggtgagcagggcagggggcagccgagggagcgcggggagcgggggccggggggccacgtacgaggggctgcaggcccagccggggcgggactcgccaatcctgcgtccccagctc

SEQ ID NO: 87 - DNA, 967 bp, Homo sapiens
agtctctcccgtgtttgactgactcccggccgcatacccagtccctgacacacgggggcgcacaacaaatatttcccgaaagatccaggagcagcatctccaccagcaagctgggctgctgggtgggtacttccttcaaagctgagggagcgtcctacgcccacgcgcgcaggagggcgccccccgcaaagcaacgtctaggagaccacagtggatgccacagcgggcccgaagcggatcagccttgtggggtacgcatgctaatgtaggcgtggagtcccccagggggacgccagcagttccagctgggatccaggtttcgctaggggagagcctctggctatgggaaaggggtctccgagttgatgtgaaggcccaggtcgaggtgtacactgggggcggggaagtggaggtgaccacacgagcgccccatcactgagcgccgccgcgaaatctgcgctctttgggtcacttggagcgcggccagtttggcagatttgtttttttcccggaacaacccgcggcggctcggctgtcccgggaaactgcaaactttgctgtgcgcgttctcccgcgcgcgggctcaactttgtagagcgaggggccaacttggcagagcgcgcggccagctttgcagagagcgccctccagggactatgcgtgcggggacacgggtcgctttgggctcttccacccctgcggagcgcactaccccgagccaggggcggtgcaagccccgcccggccctacccagggcggctcctccctccgcagcgccgagacttttagtttcgctttcgctaaaggggccccagacccttgctgcggagcgacggagagagactgtgccagtcccagccgccctaccgccgtgggaacggtaactgcagcccccacctcggccggcgcctctccagcccgccggccgtgcgcgccttgcctccctccttcctgccggcttcctagt

SEQ ID NO: 88 - DNA, 1023 bp, Homo sapiens
acacgtgactaaacccacagaccccgccgggctttcgggacctgcatggagcccacctggcgcccgacactcactgtgggtgacagtcacggtgagcccagctgccgccatttcctccctggtcacctcctcgctccgggtcgactcctcgtcccgggtcacctcctggctccgattcatctcttcgccctgggtcgcctcctcactctgggtcgcctcttcactccaggtcgcttcctcactcagggtcaactcctcgctccgggtcaactcctcgctccgggtcgagcggcgccgggttttcttcttcatccgcggcctgcgagcgccggcggcggcgcccctggtgggtcggtcatgcccgctggcagtactccgggcaggtggacgcccagagggaggcggaccacgctgggccgggggctccgactggcgcggctcccggcctggccgaagggcgcgcagccgggaacccagccgctcccggtcgcctcgcggtctccgcgcccccccgcgctgagccaggcccgcacttgttgaccgcccagcgatggaagctgagcgcggcgtctcacaaccccgcccgactacttcccagccccgccccggcctgccggccccgccctcgccctatgccgcgttagttgcctccaggccccacccactcaactgaggccccgccttgctacagtaaaacccctcccactccttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtgggcatttgatcatgcataagta

SEQ ID NO: 89 - DNA, 926 bp, Homo sapiens
cctgactaggaaactcttcgctggccgctgacgcacgcagcaagtgagacgcgcggagggatcgagccgcggcccgggcgcagcggtaaaaaacacccattacagaaaccgacccaagggaagacgctgagagcaaacggcacgcgcggacgccgtccggcctcatgcaaggaatcagcgccgcttcgccgcagctgccagccggacggtgcaggagcgcggagtggctcccccgggccccgcggccaaatcgcacccccgccctggaagcggaggcctggccctgggcggccgcgcaggatctggggccgtccgcgggctgcagcccggttcgggagcctcgtggcggccactgcgcctgcctgcagcggctcgcggggccgggcctctccgggtgcggcgcgccggccgggtcctcctcgggccggcggggcctgctttctttttccaggtctccggaccgtggccactcgcggagccgcacaagcctgcgtgtggctgcggaaaggggtccgcacgcgggcggggccccgggccagcatgcaggcttggatgcggggcgcgggggtggcctccgactccccgcccgggctgcgtacagtagcgcgcggcgcggcggcgggggcgcgcgggccaattccaggagccggcggcggcgagccgcgccctggctgataccggaaaggcctgtgattggccgccggccgcccctatgcaaacgagctgagggaatggaattcctccggccgggcttacagtaaaagcacgttcatttccaggcactctcattcatagagccagcgggcgcgggcgggacgggcgccccgcggccggacccagccagggcaccacgctgcccggccctgcgccgccaggcacttctttccggggctcctagggacgccagaaggaagtcaacctctgct

SEQ ID NO: 90 - DNA, 961 bp, Homo sapiens
ccgatctgaaatcttgggatatgtcttagcatgtccaccgtgattgaggtacaagcagtggttcagggcaccgagttagcgattctaggtaagcaagaccatgtcaagaagtggtttgtccaaaagttcgtgagaaggcagaaacgagggagagtggcaatcgttgttctttaagagggcacggtggtggaggagaaacttgcacatcggggcctggggtaccacgatctggggcctggggacgcgatttggggaaactcggtggcatctgggctccgcttgatgccagtgcgtgttcgtgcaagttacttcctcaagttcagggtgaggataataatatctaccatgtggagttgctgggaagattcactaccaacagaggcagagcgcacggctcgcaggaagcgctcgctagggtctgctctttccgggaatgggtggggtgcgcactcctcaacagggctctcaggacttgcgtcacacgcctcagtcggctggcttataaaacaccggccagagccccaagatcgcttttagtttctcttctttctaaagaaggctcgcggagcccggctggagaacctcaccctcgccgagcctagaaccgagagggggccaccccaggcggtcaccagcagatttgcccgcgcgttctctttctttccacccagttgcccttgcggccggctgtaaacctgccactaggacccggtcggtgagatctagcctcttgacctgagagccgagagtggatcgctgggctgggctaacggcgacggagagcgcgccctcgctgactccgggcgcgcccagcagtagcaccgcccgcgcccgcccctggacacttgtaagtttcgatttccgatttccgcggaaccgagtcccgcgccgcggcagagccagcacagccagcgcgccatggcggacccggaggtgtgctgcttcatcaccaaaatcctgt

SEQ ID NO: 91 - DNA, 941 bp, Homo sapiens
ggatctctgaatcaagtccctcctctgcatcccacagccactgtcctagaccagggcacctgctcctaggttgtcagagtgactgtcccatcatgcacagctgatcgtgttgttccctggttccaaatccttcagcaacttcccatcactcacagaactggttcaatctcctcagctaggatcttgtcctagcacactccttgggtatcatttctcatgaattccctcttaaatctgaaaatggccaaaattagttcccaaacaggcttttgcaagagctatcttttctgtttcaagtgtcccccgtaccccaccacctacaaccctaaatccctggtgaatttccactgcttttgcaggtcccagctgtgggctctcctttccagaatgtctccgtttgcaggcttgctcttccattacatctacggctcttagaaagcaggggctgcgtgtggctcatctttgtacgcccagctcccggcaggacgtggcacgaagcagtgccagtgtgaacggatgaatggatcaaagccgggagcagggctgcccccctgcagctctgccctacctctcccgctttaccgtaagtcagcggtaggtctgcagctctccgcctctacctcctccccgctctgggcgtgtctttaaaacccacagtcggcctctctgccccctagaaccgcccccagcttctgtctcacttcctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggcc

SEQ ID NO: 92 - DNA, 972 bp, Homo sapiens
catctgatagtggggagatttggggctgggtcctgaatctgagggtaattaactccctgtaacttcttttcctaatctgtaaaaggatagtgacagcgagacattgtgatggggttaatattttggaaaacatccacatgtttttttcctttgcctttctgagtgtgtcaactacttcctacctgtccagcctaacacacaggcatgttgtcttggtagggatggagatctgagaaggagattagaatttgtgtctgaaggtttgcaaagaggaagaagtcgtcaatatttagattctgacattcaagatggaattatgtagcaagaccattgctatgagacagtatttctattttcctttatccactcccaccctgccctcttcccaccctcacagtagcatgagaaaaaccacatatggaagtttcaggtcataaaaattatcttataatttagaaaacaggccttgtgcctatgacagccaggccatgaggcttagagctctgtggtagaatgaggatatgttagggaaaagcaaagaaaatccctcccctctttggctgaggacattatcaaaaggagagcaagaaagagaagagagaaatgggcttgaggtgagtgcagataaggggtgcatggatcctgagggcaaggagaggagcttctttcagtttccctcctttccaacgactactttgagacaagagctgtccctgggcagtaggaaaggggagggacagttgcaggttcaatagatgtgggtggggccaaggccacagaacccagaaaaacaactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgct

SEQ ID NO: 93 - DNA, 962 bp, Homo sapiens
ctcagcctcttggtgtaatctggatatcagatgcaatcagcgaacagcctgagttttggaattagatctgagttcaatcccatatctcccatttactagctgtgtgatcttggctgaattactgaagctctctgaacctcatttcgccatctgtaaaatggggatgtggttatcttccccactacatggctctcgtgagaatccgcggagatcacatttgtaaacacttctctcgctatgcctggcactttgttggggcccaataaaataaaaatccatggactctcagaggctccggtactcaaatgagcctcctggatccacgtctctttgattagccatctgcaagctggcatttctgagcgagggacttttcaaaacaggctgctcaagtttcttggccaataataggcgccgggttctgtgcggtgggaacgagtaccaccaaccccagcaggagaccaagcagaaatcaccatgggagtgcaagctaagaaagggcaaaagaagaaagagaagggcagaaaaacaaaacaaaatgaaaccactcaggcagcgacttacagtcttaaagagagaattcccggaagggagacaaggcagtttctttttctgtgtgacaataaaaaacggtaaacaagcctccagaagctcattcagcccccatataactttttcgagaaagaaaaggtgccgttcttccgagccctccggcttaaccactgcttcggtgctgacttatttcctacgtctgagaactgccagaaaatgagcaatatctgttctgaaggctgcaggctctctccccgcccccgcggggcggcgcgcactcacccacccgcgccggagcggacctttggcttggcttgtcagggcttgtccaggagttccgctcctctctccaaccggggtccccctccagcgaccctaaagcttcccagacttccgcttcaattcctgtc

SEQ ID NO: 94 - DNA, 900 bp, Homo sapiens
aaagatggtctttttggccattttattcagctttaattgttctaaggggagtgaagaaatggtcatttactttgaaaaatcagagggaacgtgttgatgcgggaagcagctaatccttggggtacagtggcccttggtagtgcaggaaagtcctgggggccacctctaacccaccttcctcctctacagcatctcccactgtagtcattctctaccgaagccccagaaggtgcggcactttgccacgacagagtactgggttcatgtttctttccgaggcgggccaagagctctcagcccactggcagtggcgagatgacggacacccagcgagtccaatgggcgtcgaacgcgtctaggcttggtggacttgtcagcgcctgcctggcttcggtccccaacttgagcaccggccctttcctgcatgcccctaaccctcgcaacgctaaacagtgaaaaaaaaaaaaagacaaaaacaaaaagcatctcaacacacacacacacacacacacacacacacacacacacacacacacacacacacacacacacacacacacacacggatccgcgttcagaaaggcgtgcacttcctacgcctgatcccccgcatcgcaacctcgcagcttccccggcgtgcagcgctcatttaccaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtacagcg

SEQ ID NO: 95 - DNA, 1083 bp, Homo sapiens
tctgaagtgcaggagagacacacttcagcaaaagtccaagggggaaaaagaaaattgcaccaaaggaaaaaaaaaaaaaaaaagtgggggctgggattgttacatatggccaaaaatttaagcttctttcaatagtattagtattgaaataatacatctttaaaacgcttgagggattagatagggaaagaaaaggcacgtacaaaaaaatccaaccgatgccgatcctgtgatttacgtaacaccacaaacttgcaaaaggcaaaaaatcagaagcaaaaatccataaaccatcaaaatacagaaaccaaaaatcccaagccaccacaccagaaagaaaaaaacccagaacaacagcaaaaacccctgtcctaaataaaaataaagcaaatgaacccaccgaaaactgcttggcaaatatttttctcgtggtgcctaatattctagttggaaagagctgtgatgtttattttattttatttttctcttactcgcctctctaaccctactatatatataacatacttttcccagtggttcaaacctctcgctcccttttgtgcatttagctcgatctgctgagtttatgggtaagaaagaaggaattagccccagaccccgggaaagcaaagcgcactccccctcttatgtcaccgaatagcaaattagttctcagaattccagaggccgagctttgctacagcgaaggcgccgacgtcacagaggaggagcccacgtgatggtggcggagcaggccataccatcgtcttgggcccggggagggagagccaccttcaggcccctcgagcctcgaaccggaacctccaaatccgagacgctctgcttatgaggacctcgaaatatgccggccagtgaaaaaatcttgtggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggtgattat

SEQ ID NO: 96 - DNA, 958 bp, Homo sapiens
gaacccacttagaggctgtcagaaaattttaagtattttcttccttctattgttcattcctaaaattctggcagtaggtatgattattattattcccatcccacaggggaagtaattaagtctaactacttgaatattttgccccaaatcactgacagtaagagacggccagacactgaaacctggaatctctaaatgtttagatattgatgggcaccgcttagaccagggagtccaaaccataggcttgctgttccagtttctcttatcggatgaagggacccccatttcaccgacgtcattgacttttgggttctccgctgaccccagatgagatgcctggtacctcatggtcaagtcccctccaacggggactcctcagaggcttggtcccagttgctcaggctgccatctgcctcctcaggccagagcccgaggcgccgccagcggtcaggtcccgggccggctgccagccacaggcccaagtaaacgctgaatgaagggcagatggaggaacctgtcccggtcggccgaagcgccgcgggcgcctttccacttacggcgggcctgcccagcctcccgcccagcccgggcccgggtcccgccgaggcaggtgtgcgtggcggactagctctcgggcactcggctggcccagctccaccccgaacgccaccgggccaggccacgcgcagacccgagcccggggcccccgcctctggctgccggcccgcgcccgccgcgcgccccgcgttcactgcgcgctcggccccggtcccgcctcccggagggtttcgctttcgctttcctgccgatgtcgttgaggaaaatgaaagcggtcgtggccaggactggcgcagctgccgtttcaggcgaggggcgcagaatgcagcggccgccagcctggagcgcgggccctggggccgcaacccgcgccgggcgaggtaagcacagccccttc

SEQ ID NO: 97 - DNA, 2154 bp, Homo sapiens
tgcactataaagaacccggaaaaaaaggggatcagggtgtgttcagggaacagactgaaggtcccaggtatccccatataagtgcatttcggacagcagccccaacttccaactccctcatttgcagggtgccccattttcagcccccagacctggctatggtgagaatggacatgagagttaagtttcgagtgaaggtatcggctgagccatcttgtagaatccagtcagtgaggcggcccgtaaagaatggaatggccatctcccctggagaaagagaagagaggtcacgcacaaatattaagtctaagtaggtcagttccagtcagactggccccaccacgcctcctccccctcaccattatcctggagggcatcagcagaaaggaaacactgacgtctcaatcccgaacctaaataggctgccctggaactcactaccctgtggttgctctaccagaactttcaggattttattaggaaggctggagatcatgaagtagaaaagcctcctgttagagatgaggatgccccgcccttcggccccagagcaaaggatttccccgcttccggcgtggcccaaagaatcaagacccggtcagcaatggagcccagaacctctggcccccgccagtccagtgccgtttcttctacaccgaagtggtgttccaagacccacgctaggagtccttctcctgctccacatttcccagaacccacgctactctaccttactgacaattacctttgattcctgtcccagtccccttgtgtcctcccctcttgccctgcgttccccttaccaagagaggagaggaccaccaggaccaggaacagcgagaggcggcgcgtctccgagcccaggcagcctagaagccgacgcacagggtttccagagccgccctgaccgccgggcacccagaggctcccgagtttgtgccacagggctgctgcgggcagtgccgctgcataactgacaacgaaggcggtagggtgacttccccagtgcagtagcctggtgctatccgcggacccgggggctccccatgagatcagctctcggaacaaggcaagtcccggcagggccaagcccagtgccgcagctaatggcttcaaagcagccagccagccctgggcacctgcgttttcgctcttggagccaaccgttgccctgaggaccccgcaggcccccagccagagcacggcccagcggctcaggcccaccgcccagacccggagcagtggcagcgcggtgggcaccagcagggagaatatgcggggcagcgcggtccggagcagcacccagtcggcgagaagtagcagtactgtccccagccatgcgagagaagctccggggaggcagcggcacccgcggggagcgggacacctagagctagccattggcactcggacgccgtcccggtcccggccgggcctgggactctccgcgccccggtggggcctgaagctccgggtaccgccgagtcctcccctactggcggctgggggagggaacgagggcggggctctcggaaagtcccaggaacaggctgatcctgcgctggcgagaagctcagccatttaggggaaagcgaaatcgaaagcggccgcctgctcactagataacgcctacttccaaaagtggcctgcccagactattttggtagcaagcgtggaaatcagatctgagaatctcgggagcagccctggtgcccaattttctccatcacgcacacccttctcgcctctccctgcctcctgcctttccacttgcaccagttttcccaccccagcctcagggcggggctgcctcgtcacttgtctcggggcagatctgccctacacacgttagcgccgcgcgcaaagcagccccgcagcacccaggcgcctcctggcggcgccgcgaaggggcggggctgtcggctgcgcgttgtgcgctgtcccaggttggaaaccagtgccccaggcggcgaggagagcggtgccttgcagggatgctgcgggcgggagcaccaaccggggacttaccccgggcgggagaagtccacaccggggtaatgggtctgggcttgagggttggcagaggggtggaggagatgcagcggccaggggaccctggaagcgcgcgcggagaagtgaatgcagagaccaacg

SEQ ID NO: 98 - DNA, 1055 bp, Homo sapiens
taaatgagctgttgtgctttggattatgccgcccataaagatgtttttgaggtgtttttaatggctttgagtgtggcacttttagtaatttgtcctgcagaaattagatccatagaaacctcaggaattctaggtatgtgggagaagtgccatgcagcacaaaacatgtttacaggggtgattcgcgttaagtttcacacacagcagttactacattttagaggaaggaaattatacccatgagtgcattcctaactatcttgaatggaagtgttaaaacccgcatgccccacacaagtttgaatatgtcataccatttgctgtagcaattaatggcatacacaattgagagcacacacattaccactgaacatttgagtatgtatttcccaaaatgagcttttttccagtttggggatgttttgctttgttttggggtggagtctccctctcgcccaagctgcagtgcagcggcgtgataacagctcactgtaacctcgaactcgggctcaagcgatcctcttgacagccttctgagtagctgggattacaggcgagagccgccacgcccggctaagagcatttttctaattgcccacacttcttatgcgacacccagaaaaatacaattttaaataaagcgcatatgcaaatttccctaatcgtctccaatattctctgatttcttttttatattttaactagaaacaattggaggtttccgcgttgctttgtgtggttgtaaattttaagacttcaggaaacttttccagtacaagacttgtccacagtggatatagcagctaaggggttaacaaaatgacgtcagagtagctacggtaatgggcaggagcctctcttaatctgcaaccaggcacagagatggaccaatccaagaagggcgcggggatttttgaattttcttgggtccaatagttggtggtctgactctataaaagaagagtagctctttcctttcctccacagacgtctctgcaggcaagcttttctgtggttttgccatggctcgtactaaacagacagctcggaaatcc

SEQ ID NO: 99 - DNA, 900 bp, Homo sapiens
accaaaattgcctaagtgctcaaaggtgtttgtagttaaacaacaggagattgataaattatgttatatacatgtgatgctatgttttaaagaggtactgatatgataaaagatgtacgtggcataaaattaaatgtactttattaagtacttttccaagtgtttacggaatgagtgcatttttgaaaaaaaaaaagtgtattcgaacttttaaaaaagctttaaaagctttatacaatgaacgattgagtgattataagagctggcgggggaatgttaagaggatgatagggagctaagtttaacagaacaattcacctctttatcttgtgacacctacgagcgcatcaattctgtaattgaaaaataaagtgcatatttgcagcagctgtactctcttcaggctgcaaggaggcttttcctcccggtaggcttgatttgcatttcactttcactttcgtggctggaaactttctacccacgtagtgggaggctgaggagccaccataaagctggggcttgacgagccgggaccgggacccgatctccacatatgcccggacttgttctgcggccgggttcaggagtcaaagaggcggggagacctgcgcgacgctgccccgccctgcgcccgcttcctccaatgtatgctctagggggcgggcctcgcggggagcatggacacgattggccctaaagtcttccccgcaaggccgtgggctggacagcgtggtgacgtcgcaacgcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttc

SEQ ID NO: 100 - DNA, 1016 bp, Homo sapiens
gaagatcaaacgagaaccaggaaattaagctcagttaagaataaaacaggaccactacccaatatgtcactgcataattataacttagcgtttaagttcgtggactccgcgttcaaaaggattctgtcatttacatctctctgcctcactactctcatctgtaaaatgggataacaggactgtctcagaattaaatgagttaatacatgcgaagcgcttgccagtgcacgtttctcagtgcacgtttctcagtgcacgtttgacttccttaatgaacaaaatctcttgaaggcacggtcctactaacttctgtacccttaacatagaaccccatacaatactcaatgcctgctttttttttttttttttttaataaaagaattgacaatacactctaggctggggtcgcctgggagaccgatgcggaaagccgcgaaggcaaaagacccgggctccgcgacccccacccgcgcgacgacgccgccgccaccgcgtcgtcacacggagcaaagtcccctgggaagtgtagtcttcaggccctgggagggacttcagccacgggccgaggagccaggaagttgagggaaggaagctaaggggagggttactgggtaactcaaaagtgtctggagccccagaggtagggtaagccgctcacctgagtctcccaacaccagtaccttcacccgatccagggacgccatcttgccactgccttccctgggttaacgcctgttcctggattgtaagccaatcagagttgggcatggagggcagagccttcaatttcattggccactcggagcgtgactgtcttgatcgaaggtttcactgaactcattggctggtctggtaaaaggtagcggggtgcttccccagctggtcgcaggaatagtgcgttttctttgtcgcgcaaggggcgtggttcatttaagccggtagttgaagcgctgggggcagctgtagtgggagtgttccaggattcgccttggtaaaccttgttccctgttccttgt

SEQ ID NO: 101 - DNA, 843 bp, Homo sapiens
taaataaataaataggccgggcgcggtgactcacgcctgtaatcccagcactttgggaggccaaggcgggaggatcccctgacgtcgggagttccagaccagcctgaccaacatggagaaactacgtctctactaaacaaatacaaaattagccgggcgtggcggcacatgcctgcaatcccagcactttgggaggccaaggcgggaggatcccctgacgtcgggagttccagaccagcctgaccaacatggagaaactacgtctctactaaacaaatacaaaattagccgggcgtggcggcacatgcctgcaatcccagatactcgggatgctgaggcaggagaatcgcttgaaccccgaaggcggaggttgcggtgagccgagatcgcccctttgcattccagcctgagcaacaagagcaaaactccgcctcaaaataactaactaaataaataaataaattggggtgggaaggcattgaccctgagctgagagagaactggctcgctgttgaagcagggccacgcatttgattgacagttcgtttgttggaggggcgtggtcacgctcggaaactccgccgtgacgttgcaaaagctggaatctccgcgagaagtcctgtcttacttccacttcccacccttcgggttgcggtctcgaaaccccgcctctcttcgtgacgtcagcacgccgggcgcggtaggctataaaagcctagtggccattgtgttcgttgctcttatcggttcccatcccagttgttgatcttatgcaagacgctgcacgaccccgcgcccgcttgtcgccacggcacttgaggcagccggagatactctgagtta

SEQ ID NO: 102 - DNA, 1094 bp, Homo sapiens
accccggagtgagaaataaaagtagccgtcatccttgcacgtgggccctgggtggcggcgtgcagccggagcctgcaccattcccctcaacaatggctttctccagggcctggaggcctccgcacgggcaaaggctggaacgccaggcagccggcgggggcggggccgcgccacctgcacctcccacgcgcaccccaccctgatactcgcggggtcggcgaggaggcgcccactttcttctccagagcgccccgggctttgcaacctcccactttcggggccctcgaggaggcctcccgcgaccaccaggtgacagctgatgtgtattgggctcttactgtcagccgtattttatgccatgctctgcaaaccagcgaggccggcgctgcagacccattactcagacgggaacagagaggccgggagaagcgaaatcacccaggggctggggtcgtcgcagccaggagagactccggccctcaccaccacctgggcgagatcacgctgcaaacggggccccttcccggtgcagcccctccacccccagcagaacttgggaaaggcgcggtccgggactctccgcggatcgggaggggattccaggcccccccgaaagtccgggccgcctcgcgcgctggaaatcccgcgcgcgccccgaaccgcggctcggctgccgggaaatcaggagaaaaaaacttctgcttttttttcttttctggcattcgcggtcacctacccggcccccgcgcgccctcctcccggttctcgcccccacgtggggcgcccccgcacgccgctcctccccctcccctccgtcggccaaccgcagagctagctgcactcgcccttgtctttccaccaataggaggggcgaatgactccactgaggccacgcccaatgttcaagtctataaaagtcggtgccggaggctcccagctcagatcgccgaagcgtcggactaccgttggtttccgcaacttcctggattatcctcgccaaggactttgcaatatatttttccgccttttctggaaggatttcgctgcttcccgaaggtcttggacgagcgctctagctctgtgggaaggttttg

SEQ ID NO: 103 - DNA, 1092 bp, Homo sapiens
cctcttccaagttctgggatttttcagccttgcttggttttggccaaaagcacaaaaaaggcgttttcggaagcgacccgaccgtgcacaagggccatttgtttgttttgggactcggggcaggaaatcttgcccggcctgagtcacggcggctccttcaaggaaacgtcagtgctcgccggtcgctctcgtctgccgcgcgccccgccgcccgctgcccatgggggagatgcagggcgcgctggccagagcccggctcgagtccctgctgcggccccgccacaaaaagagggccgaggcgcagaaaaggagcgagtccttcctgctgagcggactgggtaagcgccgccgccggccccgctgggggcttggctcacttccccagagcggcttggaggcaggggccggctttcgtcggagttctcggggccggggtcccggcggcgggaacgggaggacctggcgggcgaggtcgcgcgcgcaggcctgcgccccagggataaaccccggagggtggcgcgcaccgccggctcgggttggggaggagggtgggagtccggccgcaggacggcgcctggccggggagagggtatctgcagggacagtgagcgaagccaccgtggccgccgcgcacccgccgggaagcgcttcggcgctgcgaacccggctttctccggcggcggaataaatgagagaggtggaaaactaccccgggctctccggccctccccgcgccctccgccggcgcgttctctctctcctgccccaggagccgatggagactgataacggccctgcgccaggccgtccccgggcggtcctcgcgcccccgcccggggctcgccctctcaatggggacagaaccgcccgccgcaggcagcgtagccgccagcaaaccgcgaggcggccggggcggggcgaggggcgaggcgaagggcggggccacttctcactgtcgcgcaggccccgcccccgcggcggtgccttttttataaggccgagcgcgcggcctggcgcagcatacgccgagccggtctttgagcgctaacgtctttctgtctccccgcggtggtgatgacggtgaaaactgag

SEQ ID NO: 104 - DNA, 1049 bp, Homo sapiens
gaatctaactcccaaatgggtcctcaggcttaaaaaataccttcgcccacagcctctgtctcccctgaagaaaacgttttccgttcggatgaggcatcggccacgggcaagcaagtggtcccgcgcccccgtcccctacccaggcggccggcctggctccgtcaccgcccgcagcgtccgcccggggcccgcgcgggaagagggtcccagccccacatgctgcgggggcagccccgggacgcgcagacgccagcgccgctgagggccggggccgggaccggccgcgcggcgggggcttccagagcggccggtcacgcttccttaggtttcaagtttctaacttgctgaacatttcagattttaacagcaaaagcggctgacgtccccgcgggcaagcggcctctcggggtctgcagcgccccagggcatccgcgccgccagccccacgcgcgagcccgcgaggcccccgggcccccgcacgtcccgaggctctgagtctggacgaacgcaggccgcgtggaggggccggcgacccctgcccgagagccgtcccctcctggagggagcgagcacaaggcgcccgcgggacccggcccgagtgcccgagcgtggaggggcgggcgcgccctcggcggtggggccgcccgcagtgcccccagcgcccgggagggggcgcccggcggagcgcaggcgggcgggcctcgggcggcgggcgcccctgacgtcaccggcccgcggtcgccagggcaacggcctcatcccgcgcgcgtcagagccgccagtctcttggcaaccgcccgatctcccgctctccctccgcccggcgctcggccgcgcgtcgctctggcgtcaaagcgacgtcaatgggcggcccccgcccgggcggcgggggcggggcagggggcggggactacggggggcgggccggggcgggccggggcggggccgggcgccgcgtgcggcggagcgcggcggctccgggctgacatgcggcgcggccccggaggcagcagcagcggcggcggcagccggagcagtaggcacccgag

SEQ ID NO: 105 - DNA, 1042 bp, Homo sapiens
aggaagtataagtcagcctcccggagaactccccgcgttcgtttcctctcggacttccaacccaggcagtgggctggaactaaagtgggaacctccaaaaacaaacaagtacaacatacccaaaagagggaagggctggaggagtgggggagacctctgcctgggaatttgccagacgatgggcaagtttccccccgccccaccccccccccgccttttcattcataaatgccactgtgggtattaatttgcaattcactgaactttgctaataaacatcatgccaaagctttgggacttgttccgaacacgcctctttgaagtccacaaatattcctgactcagagacacactcctcttccccgttctactctttcaacagataacttgcctctcaccttcgctgtaaaaaagcaaacagctcactgccttcccgggtgagggcttcagtggctgcccggtcaactcgcatcaccaaacaaaacgacttttgttcctccctctcaggtcctcccacccacccagtccaggcaaagttctgaactggcccccctcgcccctcacgaccctccaactaccatcaccaccatcacgccccaaagaacccttcccaacataagtcgtaatttaaggtggaaaaaacgaactgttttcttgacgggtctgggacacacacacacacacacacacacacacacacaccccccgaactgttttcttgacgggtctgggagacagacacacacacagacacacacacacacacacacacacacacacacacacacacacacacacacacacaaaggtgcaatggagccaggggaggcgcttggcagcagcccgcgccaaccagcattcctgagatgtttgagaattctggaacgcgcagacagagccgacgtcactgcaacacgcggcgcctccgccggcccgtataaaaggcgggctccggggcgcctgggcagaccgcgagcgagagcgcccccgagcagcgcccgcgccctccgcgccttctccgccgggacctcgagcgaaagac

SEQ ID NO: 106 - DNA, 929 bp, Homo sapiens
ctctctatgtgccaagccttcattaagtgatccaaataaaatttgacatttaaaaaaaatgtacaaatagtaattttgatttatttatgaattttaaaaatcccaaatgtcttttcagggggttttaatctgggaaaataaggtattagattgaatcacatgaaactgctatttttgtaggccagaaagttcaaatatcagcaagttcatgtgattcaatctagtagttatgggagaatactacataatacttgctccattggcacagtgaatttttaaaatttaattatctactccctttaagtgaaagtagcaaattctgtatcaccttaggaagagttggattttttgatggtgtagcaaatggctcagcaaataaaaatgttaagtgaacacaggtggctggatatttcttggtgagtttagaagtgactatgaaatatggtatttctttgctgatagtcaatgtgttttttttttttttaaatctccaagtgttttttctcttatgagttaggaaattatgttgggtttattctcccttagtttacctagaagccttggacacaacaataataaagaagtagccctgtaagatacaatcatgtaacttttaatgctaaaagagacattattattattattattattattatttgctagagcccacctcaaacagatttctatgtaaaaatgagaaacaagagcattaagatggtttattacaggaagagtttttatagggcttgggtttcagtgagctcgcctgtgacaaagcaaattgatggcagtgataggctagtgatgtcattgtgatgtcagtcctcctgcttatcctgcacatgcttgctaatttggaacactttatgttgaactgtggtagaggaaacaagacagttctgtctgcagaagcccattatggctgtaac

SEQ ID NO: 107 - DNA, 1100 bp, Homo sapiens
tccaggaaactgaaaaagacgagttcatcaggcttccaagacctcctgggaaggcaaaggacagagggacctcctcaggtcaggggaaaaccgagggagggggacagccacacaaacgccctaaagtctaatgacggcagaaaggggtcttgggggacgggggtggggttcacagcagtggcctgggcgtgatgaccctggcgaaggacggggtcgcagagcccttaaatcctggaccagtggctgattccaaaagcagcagggaccatgccaggattttgggcagaagcagaaagtgctggactctcctgacaagagctgagagaactcagcggcgccagcaagagtttgtgccgtgcactgaccatctgcatcctctctgcctcaccccagcctaggattccgtgacaggccctctgggaagaactccgcgaacaaccccctgccttggagtctgcaatccttcctcgagcacacggacgcccggggtggggaagcccacagtctggcagggctcgcactgggcagaataattgcaacgtagtcatgaggatcgggctatgacctgcctgacttttcactcctcccatgatacaccgatgcataccgcaggtgcacactaaacgccgaatctatagaaagtggaacacaccaggacccagcagaaggcgacatgcgaggtttgtttacttgtggcatcaaaggctgggagccggcgagctaaggagggagcgaaagagcgagcggtggggacagccaccgctaaatgccagcccggtggagggaggaaggcggaccccaggccggtgggaccacatctcccagaagccccggcgccaaggcactggcctctcagtcctcccccgaggaggcggggccgctggcgaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcag

SEQ ID NO: 108 - DNA, 1056 bp, Homo sapiens
ataatagccctgcctccttcttgaaaaggaaccctgaaagcgccctgcctgtgagagctccttagcgaccggtgaggttgggcatggtttgcaataagtactcattttcttgagtttacagtaatgcctcccgcgctgctccgggttgcaaaagcccacactaagcctgtcgtcgaatgcgtgcgtgggtggtttgtttgtgttaacataacttttccttatctgaagagacgaactcactctacaaacgtgactcttcagtgacaacctaatttgcgttttcactttcttctgaaatgctttctatctttcctcacgctctccctccgatgggttgcagtgaactgtggcttcccccctgcggtgctgaactcgcccgtgtagctgtgattttagagctgccgacagctctaaggtgtgtagggcttggtctgggaacacccccagggcaagggtcccgccgcgcgcttggaattagaattaagaatgcatatttaggcgcccagggtctgcccccttctccctcctccttcccctcccccttcccctcccccttcccctcccccatcttcccttctcttcctcctccctcctcctctccctcctcccgcctccctcctccccgccccccgcccgccgctccccgccccccgccccccgccagccccgcacttactgtactgtactctatttaccaccccagctgggctcgcgccccgcccaccccgcggggattggctgcgaacgcggaagaaccaagcccacgccccgcgcccgcgcccaccaatggaagcgcccgctcgtcttgatagacgtgccaccttccgccaatggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacag

SEQ ID NO: 109 - DNA, 1094 bp, Homo sapiens
gatttcactttcagtggaaacgggcgtcccatccccaggaaaggaaggctttcctgcatgtgtaaaaaagtaaactgttactttgtccttgcaaaagaaaacttcattctctgaacttccccgggatctgcaaagcgccccgcggaactcccggtacttagtagaagctcattaaaggtctctgttcccctttgctccccgttcgcccgctggccctttctcagagccagacaggcacagcgctgagaagggaagaagtccgaacagggagctgtgaagacaaaataagggagtcccgagtcagtaccctttagtccaaagaaagggagcgggatggggggaaaggcagccccgccctgggactgaaaagtctggattcttaacagctgcaaggtcgtggatattttatgggttttcttcctcacaaaatacactcctataagcagagattccccccctccaccccgaagagaggtgacgcaatgtcctcaaacactaccaccacccccaataaaaaagaaaagggaagggggagcgtcttgcaaccccttcgcttcacacaagtccagccactccctttcctcccagccgcttcccatcccttcccccatcccctaaaaagtttgatgaccgcaaaggaaaccgaaaaaaagttgtcttgccccagtcctggcgggccatcagcatctcttttgttcgctgcgaacccacagtcccccgtgacgtcacccggagcccgggccaatcggcgcgcggtcggctgcggcggccggcgggcgggcgggcgggtggggtggggcggggcggggacagcccggcgggtctctcctcccccgcgccccgggcctccagaggggcgggaggggaccgtcccatataagccccggctcccggcgctcggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcc

SEQ ID NO: 110 - DNA, 912 bp, Homo sapiens
tgcttactatacgcccgatgatttaccgatttttttccctgttaaaattcacagaactgccaataagtgctttgcctcagttttgttgataaacttaggctcagacttgggaggaggggaggggtggggggtctcaccactaagaagcggtggaagccgaatccgaacttaagtcggtctgtcatcactgtagcctttccgagacagttgtcttatggagttgcttggagaacgtaaaataagaggcctaagcaatgcgtctgatgtacacctgtcgtggaataactgttcccgctcattcggccgctgtacctctgctccctcattcggagcgtagctgggtatgaatgaaattccgggcttgtagcacagagaaaacttctctcccacaattggttggtgctggggaggaagctcctgattggtggaaagtccgaggaagtgggcaagccggagggatttcgtgtacctcaggtgccctcactctgaccggccccctatcattacgtaattttctacgactcgcggtagctcaggcagagcgggttcctgcagcggcgcgaccctctgacgtctccgcttctaattggtcaagagctgcgactgcagttctgaagcctaactggttgcccgtgccgcctcggaggtgaagtgtactgcgctgattggcttccaggcgccggccgcgtgtgatgtcccgggcaacgattggctctcgcctaccgggggcttctctcaccgggactcgggactcccgggaagtggaccggcagaagagggggctagctagctgtctctgcggaccaaggagacccccgcgcccccccggtgtgaggcggcctcacagggccgggtgggctggcgagccgacgcggcggcggaggaggctgtgaggagtgtgtggaacaggac

SEQ ID NO: 111 - DNA, 1016 bp, Homo sapiens
aaactacacaacccagggcactagggttggaattcaatgtttattcaaaaaggcaccctaaggcagttagggaggaaacgctacatgtatgaaaaataggagccgggaatcaaagctgatctgagcagagcagcagcgactgtatttactaacacttgttttctgggagcctatgagagaaatggaaataattagaaggaagctgaaaggatggggttttgtggcttgttctccttatatggagcaaagaaaactgcagcaactcttcgggagctggtattccctactgccatgggggcagccgaattctgggtggaggagtttgtttataccttaacacatacaggctattttgttgattaaacaagcaaaaaaaaaaaaaaaaaaaaaaaaagccccgtttgcgctttcaaacactccctcaatgagaaaatgtctcataaaaatgcatcatgtgataagctcttgctttagtcccaaactgagcttgagtccacttggagatcttagaattaaagagttcttagggaatacacgttttagctaagaatatagttactctgtcatgaaacagggagctttgccacttgcttgttttggaaggaaaataaattaaaaaaagattgcaggggattttggttattatatggccagggctccgtttagagtctgtggcattcaaagctggctttaatcacagcatgatgcttgaagcctccaaaagtctaagtgtttcctttctttctttcttttctttttctttctttttttttttttttaaagcgttacttcactgaagcagagggctgcctttgagtgacgtcacgagttagagcagcaagctgcacaggggaagggaggctgggtgagtgacagcccagcctactttttaatagctttgtcatgtgactggggactgtagtaagacaggtgccttcagttcactctcagtaaggggctggttgcctgcatgagtgtgtgctctgtgtcactgtggattggagttgaaaaagctt

SEQ ID NO: 112 - DNA, 1157 bp, Homo sapiens
ttgcagttttgttttgatgtgctgattaaagtagcgcagagggcatgatcagcagggctccagtaagacgctcccacgggaggagcaagaacacagaacagagggggcaagacagctccaccaggagtcaggagtgaatcccctctgggaacgaggcactaggaagaagaacttccagcccaggaggtaggtagcgttcagaagaagcctggggcgggcgcggtggcgcacgcctgtaatcccagcactttgggaggccgaggcgggcgaatcacgaggtcaggagatcaagaccatcctggctaacacggtgaaaccccatctctactaaaaatacaaaaaattagccgggcgttgtggtgggcacctatagtcccagctacttgggaggctgaggcaggagaatggcatgaacccgggggacggagcttgcaatgagccgagattatgccactgcactccagcctgggcgacagagcaagactctgtcccaaaaaaaaaaaaaaaaaaagcctgggactcttagcgcctcagagccttactcagaatcataaaatcattagaagcaatgtctgtcctcactgctgcatccgatattcttccggaccactggatcacaaatcaaaccatgtgactcccgcatgagcaggcagagtggagataacacggatcgctgtgtacactgtgtgctccggttgttgcatccgagggttgatcggatggtggttcccatccagatccaagtcctggcccctgatcacagagaaacacagctggacattaaagtggtgaggacggaaattataatatttggtgaccagtgacaggaggggagagagccgagctccgctccgagttgtgcaaagaagtggggagtggggaggaagaacagtggggactcagtggagtgaggaaagtggaaaattaccaaaagcaggaagggagggttagccttgggaaaccaatctgggtttgccacgggggcttactgaagtcaggcccccagtcccacagaggctgggagacaggggccccatcttcaggtgttggccagaacacaggaaattctcttggtagccatgactttctcaggcaggcgctttgaagggggctgggatcattttaggaatgtggccttgagctgttagaagccatgt

SEQ ID NO: 113 - DNA, 1089 bp, Homo sapiens
gatggtgtgtgagtatggaaaaggcctttctcggccagacttggtggctcacgcctgtaatcccagcactttgggaggtcgaggccagtggatcgcctgaggtcaggagttcgagaccagcctggccaacgtagcgaaaccccatctctactaaaaatacaaaaaattagcagggcgtggtggcaggcacctgtaatcccagctactcaggaggctaaggcaggagaatcgcttggaccggcgaggtggagattgcagtgagccaagatagcgcaattgcattccagcctgatcaacaagagcaaaactccatctccatctcaaaaaaaaaaaaaaaaaagaaaagactcttctcagcgccgcacagtggcttacacttacagtcccagcacattgggaggctgaggctggtggatcacttgagtccaggagtttgagaccagcctgggcaacatggcctagccccgtctctaccaaaaatacaaaaattagctgggcgaggtggtgagtgcgcctgtggtcccagctactctggaggctgaggtgggaggaccagttgagcccaggagttgaggctgcagggagccgagatgacagcacggtactccagcctgggagacggagggtggccttgtctcagaaggggaaaaaggctgaggtttttttccctcttcttttggttgtcacttttagcaaagtaagattgttattcctttcggttcattgatatttaaaagtttacatgtcacatttttatttcagcaaagagaaaatatgatttttaaatgaataaaaaacatttctgtgcagtagaagtcgtgctaacatctcatgttaaaaagataaacaacaggattaactgtttactttgggagcgcagaggctggttgttttttgagaagaagaacacaatgtcctgctgtctctggtttcccggtcggccctcctcccaggcggctacaggagtgggcgaggcccccgcccccaatgcgtccccgcccccaccccgccccgccctcgctctggcccttctcgcccccgccttttctcagcggctcccttgcgctcaggttccagccctcttctgtc

SEQ ID NO: 114 - DNA, 1075 bp, Homo sapiens
aggacagagggagagcttcattttctataaaacacagtctgcagattgaggagatgcagcctcggaggtggagagctataaagtcaaaaaccacagagcaggatagaggagtcagaggagtgaagaaaagagtcttgattagacagcctttaagccccaagtcacatgtctcttaattggctgttcctaggtggtcagttagttcttaccacatgatctgttggtgagcagttggaaaattcccaggtacagattttttcagaaaatgttatttgacttggctacagaaaaataggttttgcaacacttactaagaacacagagaacatgaccatcacctaaacctgccatggcctcttgggtttgtttttgcttttgaggcacagggagtccttcttgtctgtttacctggaggcatgatttggcaacctagataacaaacagagataggctttctaaaaagaattatttttatttgggaataaagcattgcaatgggaatatgcgtgccaaggtaaactatgtgcttattcaggtaggtaaagtaagacaaagtttaaaaaaataatgagaaggattacatatttgttttggaatgattatccttggctataaagatcaataacaagactgacatcagtttgaggttggacaggcagttgctgggcagatgttcttgcagaagtatttttctttaggttcctgagaatctataacctttgggcttaccaatagcagtgactgatttgtttactgattgttcacagaataggaaatcaaaggaggccaaaataaggacagccataattatttgccaattgtcaatttgaaaagggtacccaaatccctccatatgaggagtagcataagtggcttttctactggctgccgctgtagacccacctccttctccagcacataaatatcgctgttaacattaactaaatcacctctgggcagagaaacaaagctctatatgcacagcccagcaaagagcagcacacagctgaaagaaaaactcagaagacagagctgaaaaagaaaactggtgatggatctcattccaaactttgcc

SEQ ID NO: 115 - DNA, 1057 bp, Homo sapiens
tcatactctgacccttgggattctaaagaacaaagtgtcctatactcttaaacagatgctcatctgatgggtctgacccagtttgaggtcatgcgttgcccaaccagtggtccggagcctggcttggcttgagaagtgtccagacgcaggctgggggaagtcagaggcttcgcaaacaccagacatgtttgaccccaatcagagggtcgtgcaaagcttgtgaccccgggcctggggttccctaaggagcgagagactcctgtttctccatgtgccagccttgtgctcacaagctgcagaatcaggtcctagaacgaagctggccacctctcgggacagggtaaagagatgcccatgggttggctgtgcagatttcccagaagtgggaagaacctggctgtgtttttgtggtcacacattgatttcctaacctgagtcagcatggctgcttggaggtacagtatgtcctctctgttcccaggggccctggatcccagcctggctgaagcatttccaaaacagggcctggaatagtgagggaaacggaaggggtggagatcccaaatcccctccgtcagtaccagccacccaccgttgtattaaaaacgcccagcatggactgagttcttaccaggtgccaggtcccgtgctaagcatgtcatatgtattcacttaactaaccttacagagatgcaatggagtagaggctcttccatttaacaaaggagtaaacagactcagagaagccacatcacttgtaaatggtcccacggagatggaatttgcaggtctgtgattgtggaattctggagtgttagctccgcaaattcactacttcactcagccctcaccacaaacccccacccagtaaggtgctgccacccgcagtaaggatatgaaaaaactgaggctgggggtggtggacatgacttgtaagatgtttctagaaagctctgctgtgacaaccagtaactgttttttaaaagcccagtccaactctctgggctcggacctagttcgcggtgacatggccaaacctaccaagaaagtcgggatc

SEQ ID NO: 116 - DNA, 1046 bp, Homo sapiens
gttgcgtttttcttttgttcgaggcagcacacccgtcccaggcacaggccttcattcctctgtggacgtggtcttgtgccgcagaacaaattgtgcgcttaattgaaaagtatataaataaaatctgataaagtgcccagttataggcccctaagtgggttctgtagaaaacggattagaaattgtaattacactgctctccggggccctgccccgccctttctgcggcctggaggtcagggcggggctccctgtcaggtggaggagtttgccaggcactccctggagtccctgaggaggaagcccaggctcttccaggagcctgctccacccctgtggctgtggaggagttcagcaggcccggagcccttcacacccacttctgattagatcagactctgcctctgagatgctgggaggcccctcaggcggcggcaataccaagtaatgcctttagcctcctttgatcagctgtgacgggcgtcctggtctgagactgtgaagcaattggaaatagttctcccactccaggctcagcttggggatctgtggggaaatggcttcctactgcccagctctgcagtttccttgcccagggttggttctttgtctcatgaaatacagttagtacaacactccctccccccggccctgcctggtagcacgtgatagggatcagctctctgcaatttgacttgaatagctcaggacctgaactggtacgttgtgttcttacgagtcaagggagctctcatgattggggtgaaacaagaatatcaacaagagatgggttctgtccaacccagaaatcacagcgagtcgagtattctcccagcttgtctgggcaggagacagggttgggcctgtgcgtgccaagactgccgtgtttttgctgggggtcttgtctgtccctcgtggaggaaataactgctcccttttcttctctctcaggtgtgacgtatgcagccaaaggctactttgacgccctggtgaagatgggggagctggccagcgagagccagggctccaaagaactcggtgagacc

SEQ ID NO: 117 - DNA, 1009 bp, Homo sapiens
tctctgagggccaagaataaatgtatgctttgtgtatcaaactgtacacttgacctctatactttcaggaatacagtgctctgtccttaaatgttcatttgtaaatacagaaccattttcttgttaatatcacaaaatgaaacttaccaggaagatgaatgacaaccccagaacacagtgttttgtagaaaataccataggctgaaaagatcacaggaataccgagtgctaggttggaatctttcatgacaccaaatgttcattcattctctgccagactttacaactgtcctcggtgtgtttttaggttgtgtaactttacacaaagtggaagcaataatcagggcaagacttaagagaaagtggatccaatgcaagaggagtaaagaaaaaaatccctcaagtatgtgtagcagattgttttaattatctacagaatcttgtgccctaagaaattaatagctcaagtttccagcaagagtggtggatgagatggagagcatttgtgtgagagagaaccaaggatattactaaaaatgaaagggaagctgggtttctcctgggcaaacagccctcagtggctctatttgttctaactactatgcctgccttcatgtactttggtcatttagtggcctgccagaggacagttataaaatctgtggtcattctgcaggcagcatatagttttcatccagagtttggatctaaccagcaaaactctgtcttacacaggatgacttggaattagagtccttatagcagaaagagcagcagggctgtccttgggtatccgttgctcagccaagtcatcaaataaaaaggatgattgcacaagtggactatgtaccaatctgtgggtttctgcatggccaagagccagaccctccctctgggctctgctggcccaacccaccaagggatgctttatttaaacagttccaagtaggggagaccagctgcccctgaaccccagaacaaccagctggatcagttctcacaggagcta

SEQ ID NO: 118 - DNA, 941 bp, Homo sapiens
agtaacagaaccattcaggctgccatgttattaaggaatctgaactgttgatagcagttaccttgtgggtgatacaatgggaggcggcaaaaaaactacctgcataggagaccctgccctttgtcaagagctgggagcacatttcatcagagtagcaggcccacctggtgccagagggcctgcccctcctgcttctgttcctttgccttgcagtctcctggagagagcctctcttttcctgtacagcctttgggccaaaatgcccttctagcttctccaaagaagatccgagtttatttcattctatgttttaagaggtaaaaggacataacaagtgaaagaagttttgggctaaagtaggctatgtctccttatgtattactcaatactgttttgcagagaaaacatttttcaagcatgtgcttcctgaagacacctcagtctttgggccatttgatttccaatacatagggtggaagaatgtgattttggggctgaccataaactggaaatttgtgaaatggcagtgattgggcaatcttcagtttattttttcagttgaagtggaactcatttctggaatggatttaataggctgtgtctaatgtacaaactgggtgagtcctgccttagtgtgtcctgccccaccggtacgcttccaggatactcttttcccctctgtaaagtcactttcttctgatggccagtgtcactatgatgtcagtgaggtctggggatgaggacagtgtgtcctgaaattcacaggactgactcctcaccccagtgcacgaggattcctgtggcatcaggtgctgctgtacctggtgtaggagcctaatcattgaaccattgtgttactcacattccatgtcacagaacatatcagcctcaagaaggatttggtggaggtggatttaccactggttttacaaaggaccgtg

SEQ ID NO: 119 - DNA, 938 bp, Homo sapiens
gactgacgttcctcctacgtgtgcccagccctggtgcaggcccaatagcctttccttcctgtactgactgtccattgagcactcactgtcctgtcctgtgttgtcacagggtcccgggaggagaagaggatataaagaacagagagtccctactcctcctgctgggtgctgtagacactcccgctcattcactctgtgacctcagatttctcatgatctattgttcaggcattccctaagcaccttctggtgcccaggggacacggtgaccaagacaagcaggaccctgcccttccggctcacagtccagcaggggagagagacttgtcctcagacagtgatgacccagagtaggaatggctgagggcccccgacccagcctggggatcagggagggcttcctgcaggaggagcagttaagtcaacaagataagaccgagggtgtatcctgctgcctagcatagctcctcctcagcatctcattcattcatcccttacaccgaccacttgtcccctgccccactctcagaaccttcccggtgccctccacaccctcgctccgcctccagcctcttgcccatccctggctcttcctcgtatctctttttgcctcctcccatctctcctctgccggctctacctctgcccatcccgaccccacagcctggccttcagaccgcttccggtccaagcccggctccaggcctctccacgcccccgcttctgcaccggcttccagctctttaaggagcggccgcggctcgcttccagcccctcgcctctgctgggcgcccctcgcctctccaggagcgctccgccctgcccgtactaggccccgcccaccccggcgggtctgcggctcacgcggctcccgggctcccttcccgcagcgctgatgcagcaggaggccgcgcagcgcgagagcgaggagctgcagc

SEQ ID NO: 120 - DNA, 903 bp, Homo sapiens
gtgagtgcatgtggaatgagaagcctcccttgggcaggagttaacagccacaatggggaaaggattgggacatctaatcctttgagtgtgtgtgggggccaagggagcagtagtagcaggatgcctgcgcatacagccatgtacacagtgtgtacacagaagtgtaattcttgggcctgaatatttcatagggtagagacatattgagtactttattaagtaagcatattgagtactttattcatctatacaacaagggtcgtctattaagggccacacagtctagctgtttctgtaaagcacattgttttgaattactgttagcagtgtagtatagaaggaaatcgggaatccagattctctatggatttccccctgaacagttatgtggctgtatccttatctagtgaatggtgacattagcttttcccctgctgcacgggctgtagtgaggctcaggtgtgcaggtgcacttactaacatatggaaaagttaagcactgtataaccagaaggtagcccttttactcctattttatatgacagccacgtatgcaaaatatctaatttcttcctgaacactcaattgaacttcaacacttcgtatttttcgtctcagaatttttattttcctcaaatttatattatgtggttaaattcctttgaagtgctagatactttaagattaaaattaaagtaggaatgttttttcttcaattagaagctcttagaacttggcaagtactctgtgttctctcatttccttatctttgtgtatgctgtattgcagcacacgtcacatggagatgggcgtcaagaagttacctctcgtaccagccgctcaggagctcggtgtagaaactctatagcctcctgtgcagatgaacaacctcacatcggaaac

SEQ ID NO: 121 - DNA, 900 bp, Homo sapiens
ccaccagtacttatccagaagcgaatacatggggtcctttactatgttgaacacagagatgatgaattatacattctcactaatgttggagaacctacagaatttaaggtaatcctggatgctcgttgttcctatttgggctgttaagaagtgtcacacttcgatcaacaacatttcttgctccaagagctcattgttttataaattgatgccaccttcctatgtataaccaatcccatttcttttcccttagagctaatgcctctacatattttaattgtgcctaaaaagttagtaaataaaacatattctgtcctgagtttatgttaacaaaatcaaacttagtagcttaaaagagcaaacttacaaactcgtgattttatgagttggcaatttggattgatctcagctaggcagttcttctgctgatatcagctaagctcactgatgtatctgtagtcagctagctgtcagtgccctcactcaaatgtccagtggttggctaagcactggatatactgtctcaccacccagcaggctagtcaggactcattcatatggttgatggtcacactttatccctgatgcagcgttagttccttcagctcttcataaaacagtgaggactagtatggtctagttctcagtgattgcatctctggatgctgcagccttcgtgttttcttacctatatgtcttctaactttgttccacgtagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctct

SEQ ID NO: 122 - DNA, 1100 bp, Homo sapiens
gcacatgtcatgaccacacttttcaagaatgatagtgtttctcctaatacgatggttcaacaataattgaatgaatctaatggtaagaatttcagaagaaattatatcaactacatatagtagattcaaggcatttttcaaaaacacaatgccagtccaccccttttcactatacaattgaggaaaatgaggtccccaaatgttaaatgacttctgctgagatccaatgaattaaaggcagagcagaggctaaaatctagatctctttgttgttaaaatacattttaatttgacacagatgatgagtaatgctgacccagaggtaaatctgaactttcttttgttactattcttaactttggcttcaggatccaagtgcctagaaagttacttcctaaacttgatcctcacctatgttgcatattatcaagcatttggtggtgttaattctttcatgtccaattaaattaaagcagtaattttctttctagttattgctagtagagacactggtagattctgccttggtagaccttcctctgtcaacaatttacttttgtcttcctttcttttaaaacatgtatcccactcacaaatacctaaatttccttgaagactgctgccatgtcttaagatttctttttttttccatagtgactagtaaaacctgccattttcattatacataggcactctataaatatctgctaatttagcaattattagtaatttcctttcttctcttccatttcttcctttcttgtattgggtaaaggaacatttcaggattttcttatgtaaagttttcaggagtttctttccttcctcccttttacagagagcatacaaaatgtagatgattcatattcacttatttcatttaaataaaattataatgatgtatgttgtgttctgtttgcagaacagagtgttctgaacatcaacacaaagtggaagaaccttaagctgaaggtacagtatattatttacactgaaggggcttgtgtgtggacaagaaagcgctgacagctcaaatggatcccatggaactgagaaatgtcaacatcgaaccagatgatgagagcagcagtggagaaagt

SEQ ID NO: 123 - DNA, 1093 bp, Homo sapiens
ctcctaattgtgcccactgttctgtgcagcgcggaccggcgcatgcagcgagcggggctgcgagggcgctgctgtggccaggcgtctggcatgctgaccacgtcgcgctgctgtaaaggaaacctgccccgcgcagcggcggtggctggagcgggagaaaccggactttgtgcaactttggccatagtggccatcccatgaatctgtttactagcttggtggtgggtccaacagagcttgttgctccctagccgcttgctcgtgcccttggtggttaccggtagttaagcttagggcgcatagggccctcgtggctcgccacctctcacggttcagtacccacgcttcgaacgagggatgggagcaggcgccacggccggcaccccagagccctgctgccccttagttcgagcggccatcctcctgtggggcttgtgggcagcctgtggggtttgtgggcggcctgtggggtttgtgggtggtctaaggaaagagttggggcactcaggggtctgctgtttttgcccgtggccttaactcatcaggggagggtttctgcagcagaatctcgggctcagggttggcggttaacgagggagcagcggggtcttggggagggggctcgacacccctgaaggtgccccctaaaggagccactgttagaggggcaccccatctttgtggccatggcggtggtagagcggctgggaggggctctgcggcgagcaagggagcaggcggtaggggttctgcggcgatgggcgggctaggggcggggcgcgggtgggctctaaaagtcggtgcccactcgctccgcgctgccgcggcaaccagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggtgagtgtgcggtgggaac

SEQ ID NO: 124 - DNA, 1235 bp, Homo sapiens
tggtagactcatttctgctgctgatgcttgaaaaaagtgtcatttgctaccacaggaggaaaacggtgctagatggatcataacatacagaaaagcaagatagttccaaaatgtttccaagagcttctggcaggatctgtcattctacaaatactgcacaggaaaaattgctttaaatgctgcatctttgcagtagaaagattaggattgagccaggctgtgagtcaggcagaaaaaggcacacagagggggatgaaagaaagcactggagagtcttgtcatgctttgcccttgaaaactatgccaagacctcttttgtgtttttaaatgaagaaatccatcatgttttgtgattgctgtaatgactcaggatcttccaccttccttttaactataaaccgtagcgtagttaggtgtttgttttctttgtatcatgcttgcaaaaagtgacgaaataaagttaaaaccctttaactgggactccattacggttctgctgttcagtgaccagcttgttcattattctcacaatattatctactttcttcatttcagtctgtctcttagatcctgggcttctgatgtctttccatggcggatgaatacaatttaaaacacgaaagctgctggaggaaaggtttaacgttccccctccccaaggtgaaatctttgcctggcctcagtcactaagtctctcaggagcggaaactgaatggacattccggagacggtgaataagaatgataaacggtggttggggagaacagcgcgtttcttccagcggaggactaggcccacaggacgcattcccaacagatgagcggagccgacagcaagtgtgccacgaacgccagctggccgcctcactagagagagctccgccgcaagccgccgcttttggagtggagttccacatgtcctccgcgcttgagccctgggacgtcagaggcctggcgtgctgccaccgccccagttcacgtcgtgtgacccacgaccaatggaagagcaggcaagtattcccggcgtccgctgtgattggttcccggagtggaggcggtggcagagggtgggccttaggacgggtctcccttaaactgggcgatcaggcagcgaccctagaggcgtctgtagggtaaagctgggggttctgtagccggaggcggcggcgagtccagaacgtcctggccttacagggagaaggcgtcactcgcggttacaagtgcctgaccctcact

SEQ ID NO: 125 - DNA, 1783 bp, Homo sapiens
ttcattttgtagtcggccttcatacaaggtgggggctgggaagggaagagcagtccaggccattacccccatgaattcatttgacaaatatttattaagcgtctactgcaaacttggcccggtgctggaagctgaagacacaattccagaggcagacaatgactgcccttggcatttccagtggtcaggggttggtgaggaggggcagagacaccaatccaagagtccccgcagtttatacataccacaggcacggaaagcgccaggaggggaaagaacaggatgtttaccagcaccttccacaggcagccacggtcatgggggtcaggacagggtccccagaggaagtgacgattcggctgagctagaaagacatttccacaggaacttacagtaagggctgcaaggacagcctgtcctcccccgcccaccacctcactaaactttcactgtggcaatcggcattccctaagcctgccaggaagcttccagtaaccacttcctgactcctagcatgacacacttcgggccttccaaggttgacgatctaaggcccttacacagcgccagacacgcgcaggcagggaggcaggatgtgcctctccagacaggaatgtggacgccacctgggctcttcccctcagcctccacaggggaagaatattcttgtggggtttttcccttccaaatgtctcagggcgattccagtgttcccgctagttcctccctcccaggctagaacacaaatccttcccactccctgcctggcaaacaccttctgaccctcaggcccaaggcaatggcccacctcctcccaggctggatggggtctcctcctctctgttcccccagcccctgagcttcctgaggaccaagcttgtggcttcttctccttactcttcctccttggtgtctctatgttagagggccgttagcatctgctggggcctggtcgcattcaccctgctctgccactcactggctgtgtgactctggacaaattaacttctctggacctgcagtttctcctctctacaatgagaatactggagagtccttatcttatgggttgctacagaattaagtgacatctcacacacaacacacttcctacagtccctgttacacgctaaaagtactcaacatgcaacggatacgtcatcagtaaccaccccacgggtttactgtgatgctgcacaattattaagccttggctgctacagagttgtaacctgtctgcacttccaaccggtttgggaatgcaagcagcattcccaagtcccgctttcacccgcgcgctaacggctcaggttcgagtacaggacaggagggaggggagctgtgcacacggcggaggcgcacggcgtgggcacccagcacccggtacactgtgtcctcccgctgcacccagccccttccgcgccgaggcgtccccgaggcgcaagtgggccgccttcagggaactgaccgcccgcggcccgtgtgcagagccgggtgcgcccggcccagtgcgcgcggccgggtgtttcgcctggagccgcaagtgactcagcgcggggcgtgtgcaggcagcgcccggccggggcggggcttttgcactcgtcccggctctttctagctataaacactgcttgccgcgctgcactccaccacgcctcctccaagtcccagcgaacccgcgtgcaacctgtcccgactctagccgcctcttcagctcgccatggatcccaactgctcctgcgccgccggtaagaggctggggatgcccagtgtagactgtagc

SEQ ID NO: 126 - DNA, 1263 bp, Homo sapiens
acgaatggcattgttccattatcaatccctgacctggtatgagctggcatttgttcgtctcaaaattgttcatagaaggcctattacaaacttcctgctgaaagcactttcaaaggctggatacgtttaaaatcaactcaagcatgtaaagccattttaggaaaataagccccacatcccaaggttcagctgaggagggccacatttgagaacaggtgtgccacttcactgagcaggaattttaaaatgtcaaacattagaaccacttgagaaactccaactcagcctgccaacagacacttctgggcacgtgtcaataaatgccttgcagagatgggcatttgagaaagtctctcctcaccaactcaaagttagttaaaacaaatcatcacggtaggttcttaaaaagaccacattttatttttcctcagtctcacttcttgaaaaaaacaatcatttttttaaatgtggtcattcaaaaagtttccatatattacataacagtcataacagcagtattactttttttaaatatccctgaagttcaatctcttttaacttattttgtatctgcaactgcaagagtaataagaactgagctgttttccttatcattatcagagttagtcccattcctttgcaaatgagaaactaataatacaaacttggctgcagtaccctttaaactctatgcctcccagtaggacacccggtgttctgcaacccatcagtcagttctagggcaaatgcaaacaatactttccgttacaataacttgtatccaggaaaaagaaacaggcaccctgttgcatctgcagcatagcagccagagaaaagtttaccagctttagccaattggaagctgtggagctgggccaagttagcatgtttttctccgcctctagatgaagtcatgattgaaatatgacattgaaagggaaggggaacaggaaagaaaagctaaacctgcaacaaagtgtcctgtgcccagaacgcggttaggaagtgtgtgcatacgtctgaaccctaaatggttctcagttctgtaaacttctcctcccactgggtggagtagggcctttaagagcagctggaatgcagttcccctgatcagcgtagccagttgttgcctgtctgaacctctgccagtcctggagactggtgccctgagctccaaccagcgggcctcatcctacaccctcaccaccgcaacttctcacccgagcaagaagcagctcccagagagaaagaacgttcccacct

SEQ ID NO: 127 - DNA, 2460 bp, Homo sapiens
aagggagctggaacttaaagtggtggtgtttgtccgagatgacggtgctcctgccctgtcacctactgcctctctccccattgcagtgtcaccacctatcacatgatgtcatttactagtatgtcttttgctgattgtctgtctctttctgcttaagcggaagccctgtgaaagtagaggtttctgtttggcttactgagtccaagggcttggattaggtctgggatggaagatgaacaagaggccaattcatggactttgaattcctgtaaaacagcctgaaatgatgggaaaaggagaggctctatccgacgtcaccagagtccttgagcgttggagtatttctttcaactgaagcctggaccagggctatccagatatacagagagggaggcggttctgcctattggaggaactactgtttccgaaagtgcaatgtttaacaaaggcagtggtctaccccggggggttgagacctctgaaccctgacgtggccataaagccaactgctataggactggcaacccagaataagaagagtgaaggaagccaacagagatccctggaggttgtgttagtttgcttcggctttgtattaggtactttgtggcttacacaacagacattttattgtctaacagttccagtggcagaaatcaaagggcccaacagggttgattccttctgagggctgtgagggagaatctgctccatccctctctcctagcttccagtgttttctggtaatctttgccattccttggcttgtagaagcttcaccctgatctctgccttcatctttgtatggccttctcccagtgtgcctgcctgtctccaaatttcccatttttgtaatgacatctgtcatcttggattagggcccatcctagctgccctagtgatctcctcttaactaattatatctgcaatgaccctatttttaaataagatcacattctaaggtaccgggactccaacacaggaactgagagcaggaaggaggaccacagtccaaccccttacacagtcgagcactggaggtaaatggtattctcgagaggaaagctgtttgatggctcttgggatagattaggttatgctccagcaactgcccatctcaattatcatcagcttaatacaacaaaagtctatttctcactcacactaagacccctgtgagctgcaggactttctaggacaactgtcttccgtgccatgattcttacaccccagattgctttcatcttctggttctaccagtggggcagggaagggctggggagttgcatctcatagtccccttgctggagaaacctggaagtgacccttcataccagtgctcatgttttaccagtcagcagcagggccctaggtctccatccctgcaaggggctctagagtgtagggaacagatggaatgttcacaagcaccacagcccctgccacagtgacttttttaggactggtatcgcagagtgtttacttaaggcggtggaagctaaattcttagcatgtgctggagagcaatgaaaaagatatttactttatgaattaaagctggagtcagtgtcagcccgaaggctgaaggaaaaagagcaacagatccagggagcattcacctgccctgtctccaaacaggtgaggatggggaataaagtgaaggcagtgctttggtgggaacttcaaggatagcctctggctttttccaggtttagaagctcatatgagacaggggtggaggaaaagaagaaagaagaataagaagagaaagttgaggccctggcccaagttagtgggaagggaaatccacccccattaaactctctccctggtggactgtggggtgcacacgtgaggcctgcacaggtgctggaacatggtagaggcccaggacatacttcctgtgaatgaatgattgagcggctgaatgaatgagtaccactaaaagccctcttttctattcccaaatgccacattgagcagaagggagcaatccttgctcagcaattggtagtccctttgggtgtgcaaatgagtccacagcctgcaacagcagacagtctctgccccccttagaggcgattgcagggaggtggctgaccgttgatcacacccagagctggttatgggaatttactccatggaaagactgcaaaactgcctgaaatgtgttttggcatcagctactgacacgtaaggtttcccaatcctcaactctgtcctgccagctgatgaggggaaggaaagggattacctaggggtatgggcgaccaatcctgagtccaccaactgaccacgcccatccccagccttgtgcctcacctacccccaacctcccagagggagcagctatttaaggggagcaggagtgcagaacaaacaagacggcctggggatacaactctggagtcctctgagaggtaaagagccagcgaagctgatgtcctgtcaagagcagaa

SEQ ID NO: 128 - DNA, 1189 bp, Homo sapiens
cagcctatgcttcaggatgatctgtctaaccacagagtagaggaggcccagaggatgaaggctggaggctgcaggtgaaaaggttgacgccaaagtccagacaaagaagggagagaatctaggggtgagggggtgcttgtaaggagctgcctcagaggcaggaactgggacgtgcacccattgggcaccacgcctctctgtgcttcacaacaaactggcacatcccaaggccactggaagccctgctgggccatctccccaaggccagtgctgtacacataaccctacaagaccagtttcctacacataaccctacaagaccagtttcctacacataaccccagatcccttgtcctgtcttctcagtggggctggagcaagtcagcaggtgccactttctcctgccttgtctctgcctaataaaatgcgtctcaatgttttacacctgccatttagcatggactgctttaacacctcaaaaaggcctgtggaggagcctataatcatcaaggaggaattcccagaatacaaaataacactagcggctgataacaactctaaaaaataagtttgtgtaataatgggggtgagaagagatcataaggttatgtaaataaggtgaggttttgagttcaaaggaattctctggtatttttctgtgtgtgtacacatgcacccacacacttgtgtgtatatgtgtacagacatatataaacacatgcatataatgtgtatatatgcattacatatatgcacattcatacatctttatgtacaaaatacatatatgtatatataaacaccgatgtacaaacacatacgcacacatctatatacatacacatgtgtgtgcacatatacacatacctgcatatacacacatttcgtggggtgcggagagtcacttaaaggctgcagggccataaggcttcctgcttgactgatattcattaatgtttgctgaattacagcaaacctttgctgtgcccatcctgttctttatcattgaccattgctctcaggagttaatgtttgaacctggccataaaggaatcaacagctgctgacctctggccgctattcgaagggaagggagccccctataaaacagcctacagtggacagtctggtcggcagagccgcaggtcagtcgtgaagagggagctctattgccaccatgagtttctcc

SEQ ID NO: 129 - DNA, 1169 bp, Homo sapiens
cacgcccagctaacttttgtatttttagtacagatggggtttcaccatgttggtcaggctggtctcgaactcctgacctcgtgatccgccctcctcgcctcccaaagtgctgtgattacaggagtgagccaccgctcctggccagaaatctcttctttattatgtctactgtccgttatccaactccagaaggtaagaacctccactgatacataaggacttgtataccccacgtgcctgcaacagtgcttggcacctagtaggcataccaaaatatataaatgttgaacaaatgaagaaagttaaagtaaaactagaggtccaaaaatatcacaaaagccatctatggtcgccttttccctacctgattttgctgagtggccttacttttcagtcctctacacagctggaacattaatgaacacagagggggaagaagtgtgtttactctaggatcacctctcaatgggtcacttggcaagggcatctttgcttcttcgtcagctccttttgacacgggggtgaagggttttctgcaccacactttgaccacaagcatcaccaatttcactgaacccaacagaaatttggaccctctgggggctctctgcgtggcagggcccttttctttttctttgggcttaggctgcaatttgaaacaccactttcctgagccagcatcccccttgcagcgctgtcacagggaggcttaggcagccacgtggaagccacctaccccgacctttggcagaatttccaaacacaacacagtagctttaagttgattaatttggaactctgaccttggccccaaaaggtaagaatacataacaaggtattttattctcaaaatgtgtcaggataagaagcacttctgtaaatcgacctttttaaaatagatataattagatttgcagttgggggcagtaaagaaagggtctgaacagtggataacatgttgagaggttaattattaatgggcagtcttccctaacaaagtatctaataggcattgtggtctctttggcttcagaaattaccaagaaagcctggaccccgggtgaaacggagaaatggacacaagtcccctgtgtttctccattctgttggttttatgcatctttatccaatcaagtgcccttggacaaagcctgaaaccaggtaagagc

SEQ ID NO: 130 - DNA, 1105 bp, Homo sapiens
ctacaggacagttccattcccagacctgagctttggacaactgaatcttatgccccttcccacccatggagcctggtgccggaagttcccaggacttacccaccgtccaccacgccacatagcaagcgtcctcagtgtctgcagaccagaaacacctcccttgtgtctcagcactgggccacctgctgaaaccccaaactgcctgccccattgtttgagacccagtcaggccttggctccaaaagtcctctgggactgctgctggcccccagggtctctcctgactgcacctcggtcccggagctcccacaccgctgagccccgagcccgatgtcccgatccagctctgggtcctttacgggggccttgctggcctttcctaagggaggtgttttcccgaggacaggtggactgctcctcagactaggggccctcggagggccaggcctgggcttctacctcctctcgcaggctggtgtttctctgcaaatatggctcgtgtgtcctccttcctctcagactgggggcccctgaggactgggcctgagtttccctttcccccttcacaatgggggttccctgaggactgacccagggcctcccccgtcccctccacctggctgttaatctccaacacttccacctccagtcctattctgcacagctctccccagcgctgggggctcagaggcctcttcagccttccccagggctggggctcagggagggcttcctcaggcgctggccccagagtcaggctgcacattggcttggaggacaggcctttcctctgggactgagaggcccagagtgcccacccagagctccacctctgacctcacaaaggcctgcttcagaactcggtctccacggcactgctggccggacgagggatgttattttgggcagtgcatctggacttggttcaagtggcaccagccaaacccctgccttactgacctctcccctggaggagcaggagcagcgctcgaggccgccctgggagagctgagaggcaggctctggactggggacacagggatagctgagccccagctgggggtggaagctgagccagggacagtcacggaggaacaagatcaag

SEQ ID NO: 131 - DNA, 977 bp, Homo sapiens
ccatggggtaaagtgaagtgaagagatgggaatggtggataaaaggagagaggtaagaaacggtggattggggtagtatgggagaggaggccgggattagtgggaaagagtaggacagagtcagaggtcagtgggagcacttaccagaggtcacgggggtgagaaggctggggtcaacagagaaaagatcaaggatcagtaggagaggtatgattagtggtcactggcgacgacgaaggtcagaggtcatcagaaggaaggtgtgcgtacgttacctgcttatgaggctgtttatggggagccttcgcagaagcaggaatcatctcaacccctggagagcctacaaaacgctccctcgtctgaagacaaaaagtttgtccgtctccttgaccacacacaagaaatctggactctcttccacttcagttaccagtcgcaacggttctttagggacagccgtcgttgtgggtccccgtgcccttgcaggatagaatccaactccctgacgcggttacccagcaaccgaccagcagccaaggcgcaggcgcttcggcgcgcccagccggcccggaaaggaggcggggttgggcgcgcggcgagcgagtctccactaagccccgccccctcaggaatcacagctgggcggccgcgcgcattcggaactcccgcatgtgggtggggctggggtccccaggcaccgcctcctcatgaataatgcaagatccgggcggtgtcccggacccggaagtggagttgccgagtcaccgcagtggctgagctgctgacaggaggcggcagcggagtaggaggcgaggcaagacctgcggctcggcccggccacagccgcggtagtgctaggcaagcccacggagtcacgccggcctcagccagtctgcgaacctctcgcccccgcccacccctgcatccgcccggcccctgcccgcccgagtggtccggggaggcctagtctgcaccac

SEQ ID NO: 132 - DNA, 947 bp, Homo sapiens
gagctcaggcgatccgcccgcctcagcctcccaaagtgctgggattacaggcgtgagccaccgcgcccggccaacgccctgctaattttatcattttcttgtaaagacggggtctggctgtgtggcccaggctagtctccaattcctggcttcagttgattcccctgcctcagcctcttaaagtgctgggattacaggtgtgagccaacgagttcggtctcactctattttaaaaaaaccttttaatcaatatataacagacatatagaaaaggacacaaataagcgtagagcttagtgaatgttcacaaagcaacaacacctgagatgaaccagcatccacatcaacaagcagaacgtcgctagcatctctggagtgatgctcatttagccctatgaaacctcatgaagccgaccgttttatcacccccatattacgcatgaggaaacaagcgtggagaggtcggtctcaagcaaagccctgttgaaaccggcatttgaatcagatccgctgactgactccaaagccaatgctctcaaaaagcaggtttgggggttagacggtgagttcagctttgaacgatgttgagtgggcgtctcgttttacagaaacttacttcccgacgtcacagccacagaaaccacaggtaaccagacgcctgcacgtcaggccaccgacgccttggtctacacagcgcagcctccagtgagcccgcggcatgccgcgcggcctccccacacacgatggcgatgtcgcaaccacagtagaaagagtggcgctctctactgtcccggaattcttgaggccggaagaataacagggcaaaggtcacgtagacggcgcgccccgcccccgtacgcctaagttctcgcgcgactcccacttccgcccttttggctctctgaccagcaccatggcggttggcaagaacaagcgccttacgaaag

SEQ ID NO: 133 - DNA, 1114 bp, Homo sapiens
tttttgagatcttgctctgtcgcccaggctggggtacagtggtgccatctctgctcattgcaacctccgcctcctgggctcaagccattctcttcccgctaggattacaggtgccggacaccgcacccggctaatttttgtatttttagtagagacggggtttcgccatgttgaccaggctgctgttgaactcctgacctcaggtgatccgcctgcctcggcctcccaaagtgcttgtattacaggcgtgagccactgcgccaggctaagaacatgaactctggtgccaggtaatcctgctttagcccttctgaagcccaccgaccttgaacctagtgtcttcccgtgcctgggccagtttcctctgcatatagtaggaaatagtacgacctcctggtgggagttcatattatacagtcagcgcttaatgttggcccgtctgtactcattcctttacctgagtaaactcacagtactgcaagttttcttttatttttagttaacatgatatatacatgcatgattacaagctctgctgcaattatgtccttggacatttcagctgtcgcctattattccaccattatgaaacagctgtgtgatgaactttagcgggagctgtttgcttttctgtttttttttttgtttgtttgttttgttttttttaagacggagtgtcgctcggtcgccaggctggagagcaatggcgcgatctcggctcactgcaaactccgcctcccaggttcacgccattgcaggagctattttctttggccaggttcccactggggcaaagggtccatttctgagcctggctctatgtaaggcaaccggaaatcgactgcccttagtaaagatggcggaaagaacggcgtcattgcctgtcaggttgcggcatcggtgccctcgctcaacatggcggccttctgtgcccgccccctccgctaacgggcacgttactccgtccgaacgcagtagacgaaggcggcggcgatggcggcggggatagtggcttctcgcagactccgcgacctactgacccggcgtgagtcacctcttgccttatgggggtgcgtcgcgctgtcgtgctgttatagcagatgtaggacgggga

SEQ ID NO: 134 - DNA, 1178 bp, Homo sapiens
ccagtgttttgggtagttttgctcccctacagccaaaggcaaacagataagttggaggtctggagtggctacataattttacacgactgcaattctctggctgcacttcacaaatgtatacaaactaaatacaagtcctgtgtttttatcacagggaggctgatcaatataatgaaattaaaagggggctggtccatattgttctgtgtttttgtttgtttgtttctttttttgtttttgtggcctccttcctctcaatttatgaagagaagcagtaagatgttcctctcgggtcctctgagggacctggggagctcaggctgggaatctccaaggcagtaggtcgcctatcaaaaatcaaagtccaggtttgtggggggaaaacaaaagcagcccattacccagaggactgtccgccttcccctcaccccagcctaggcctttgaaaggaaacaaaagacaagacaaaatgattggcgtcctgagggagattcagcctagagctctctctcccccaatccctccctccggctgaggaaactaacaaaggaaaaaaaaattgcggaaagcaggatttagaggaagcaaattccactggtgcccttggctgccgggaacgtggactagagagtctgcggcgcagccccgagcccagcgcttcccgcgcgtcttaggccggcgggcccgggcgggggaaggggacgcagaccgcggaccctaagacacctgctgtaccctccacccccaccccacccacctccccccaactccctagatgtgtcgtgggcggctgaacgtcgcccgtttaaggggcgggccccggctccacgtgctttctgctgagtgactgaactacataaacagaggccgggaacggggcggggaggagggagagcacaggctttgaccgatagtaacctctgcgctcggtgcagccgaatctataaaaggaactagtcccggcaaaaaccccgtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaaca

SEQ ID NO: 135 - DNA, 1066 bp, Homo sapiens
gcaaaactgagtgggaaagagaaaggggcggagagcgacgagagagggaaggtggggaagaagagcccggccgcccccggccttttccggcgagctctgagtttccagggctcatccgcccctccaagtcgaattacagaaactcctcattgccatgctaatgacgagaggggctgtggggagagggtttcgaagaccctcctggaagaagggaagtttcttttcttgccctcgtctccttcacgcccacccgagttcctcccagccagccctctgcgctcttccccctccattccgagcttgaagagccggtggcccagcctcgccctccaccacggttctatgcgctcctcacagccccacggtctcccagcccagcctcagaacagaggaggtggcctgggaacccggggcgcggtgtcagccggattccccgccttccggctgggcgcgctgcgggctgggccggcgtacttgcggccacccggcgagctctggcccactgattcccgccccgagagagccgggagccctcttcccttctcacctctcgccagttcatctttcattgaacggtggggagggggcgggagcgggggacgcctcccagcccccacctcccggaggcctggcggggcgggcagcggagtcgggcgcgcgcagaacgcagcttttgctcttcttcgctccagcactccaaatcggcctttgcagtcgccgcagcagctgccgccgcctaggctgcctgggggggcgactgcgcgtcacctagacggcggagcgccggggatttaaatgccactaaaacggtgatccatcactgcggaagccggcaaacttttgcaggaggctcagccattggctgacaccgtcacgtgcccctcctccagcgtcctccgccctcccgccccccctcttgcgcactgtacattcatatcatttttcttctccggccccatggaggaagtgagaaagttggcacagtcacgccgggcttcgcaggaccaggtcactcagtgacagatggacaatgcaagaatgaactccttcctggaataccccatac

SEQ ID NO: 136 - DNA, 718 bp, Homo sapiens
aatagaagcgtcactgttgagcacagccttgggaataggaccttggaagtaggcagagctccctaggccttgtggtccctagtggccgtggacagcatgggggaggaaattcccgggaagcagcctaatttcaccccagggaagcccctggtgggcttgtggagggcggggtgaaaagccgctggtttagggaaggggtccagcctaggctgaggaatgagatgcgggttgggacggtcccgacccttcccccagcctctttcaaggattctggagaaacaaagccaggatccatttcctcttgatggctggcaaactgagcccgggcgggaagtcctggaagactgagcctggggtggcgttggacaccaactcccaggtcctcgccccacacggccacatcctcgcccagccccgcctccgcttagctccgccccgtcgcggctccgccccgcggtaaccacgcccacacaaccgtatccccgcccacagctggcttcgccttggccccgcccacaaccctctttccaagcggcggcggcggcggcggcgcgaaggcgacagcggcggcgggggcggggctggcctcacccggaatgaaaacaaacggcggccgctgccgcatccgggcactctgctggtcgcggcgggagtggcgtggcgcaggtgaggacacggcggccgagtgtcctcgaccccagcctcagcagcactgctt

SEQ ID NO: 137 - DNA, 1007 bp, Homo sapiens
gactgatgctgtggcaggtctgaggagctctggccatggatggcccacgtgctgctgccctacgtccacgggaaccagtccagcccagagctggggcccccacggctgcggcaggtgcggctgcaggaaggtgagctggcagggcgtgccccaagacttaaatcgttcctcttgttgagagagcagcctttagcggagctctggcatcagccctgctccctagctgtgtgacctttgccctcttaacaccgccgtttccttctctgtatatgagagatggtaacgttgtctaattgatggctgctgggagggttccctggggtggcgccgaaccagagctcaggcgagctggccagcaggaaacactcctgttgggttttgatgaggccctggccccggcctggggctctgtgtgtttcagcactctacccagaccctcccggccccagggtccacacgtgctcggccgcaggaggcttcagcaccagcgattacgacgttggctgggagagtcctcacaatggctcggggacgtgggcctattcagcgccggatctgctggggtgagcagagcgagggccccgggcgtctacgccaaggacaagggagtagttctccaggagtgccgcggcctcctgaccagcctggctccggggtgccggaagggctggggtgcggcacccacgccacccctctccggcagggcatggtcctggggctcctgtgccgtgtatgacagcgggggctacgtgcaggagctgggcctgagcctggaggagagccgcgaccggctgcgcttcctgcagctgcacaactggctggacaacaggtgggagctccctcccctgccctctccggggtggccgcagtcaccagccaggagcccaccctcactcctccggcccccgctggcctaggcggcttccacagcccctcagccacgcctgcactgcgcggtccccgcagctcccgccctgccacccgctcctactgacccgcaccctctg

SEQ ID NO: 138 - DNA, 912 bp, Homo sapiens
catctttcctcagaccatgcttcccagatcttgcacacattgttctctttgcctaaaatattcaggctattttcccttatcctcctttcccgttgccctttcttctcttttctggtcttctctaactcccactcaccctttgataaccctcttatagtggctttacagactcttcttcccagatgaatgttactctttcaaagaattatggaacactaaagaatattagtagcaatttcacatgcatttgtatgtgttcgattacccctctccaccaccaactccaggtgggtagatgtcacctagcttatatttaccacagtatccccagcagctagcacagaatgaatgaatacttaatagcttcacttacaaaagggaaatagggtaaccatctcattaggttgtaaagattaaataatacatacaaacactttagcacagtgcttgaatcacagtaaatgctgacaccgaggcattgtaggcattgtagtttgtggacaggagaggggactccgtctgtctcattttagcgcctcccagtcttcctccatcacctaggtctgagaaactcctcctcctacctacgagtaagcagcaattgctacgcctgcgctttcctggttccacccctaaccaggctgccggaagcactttcctctttggcacgggccagccgcaggttgggtagatactgcgcaagctccatactcgtgtctcctcctcccgcccaccggtgcccaacctgctaacacgcctgcgcgagcgggcgtgccccggaagccgttctttggccctgtgacacgtagcaacggggctggttcagggtctgaaacagagtttgggggttgtttgggattagtgaagctactgcctttgccgccagcgcagcctcagagtttggtgagtgac

SEQ ID NO: 139 - DNA, 958 bp, Homo sapiens
cgaccttgaaaactactcagcgtctgttgcccgagtggagcatagtgctttacaatctcttcccatcacagcaaaccatcaaggtagggctactattattttatggttgaaaaacagaggtcctgcgtcccttgggggctgtgccagcagcggccaagttgggatttcccctggtccagcagccccagacagcacacggggcagggtaggctttctgccttcttcacttccccagggcaggtgagtgacctggagggagggggtcacccctaaaaacaggggtagtgctaggactgaaaccctcccttcttgatatcccactggcaagcttgaggagccaggctgccagtcgggagattcggcccagtgttcccactggagagggcggcaagtgcccgggcgatcccctcacctgcgttcgggagatatacccccgcccccgccccgccaggagggtgaaaagatggccccaggagccagccggctgggacaaggcggagtgagaggacaggctggggccaggggcgctgggctgtcccgggcagccctcctccgggcaagccggagcaggggtggattgggagcgctcggggcgggcccgcggtggccccggggcggtggcgcccggccggagagggtggggcggagcagccgccctgtacttccccttcgccgctagctctacaacagcctgatttccccgaaatgacggcacgcagccggccaatgggcgcccgcgcggctgtccgggggcggggccggccagggctggggaatcccgctaagtgtttggattgctcggtggcgccgctgccctggcagagctcgccactccttagtcgaggcaagacgtgcgcccgagccccgccgaaccgaggccacccggagccgtgcccagtccacgccggccgtgcccggcggccttaagaacccggcaacctctgccttcttccctctt

SEQ ID NO: 140 - DNA, 1039 bp, Homo sapiens
gacctacgtctcatgcagcctggggtccagagctggcaggaacaatggagatggggaccaaaggctgtcaccgctgctttttctcgaaatgcccgcccgggtcctgtctggggctcccgcctacgcgctcatcacgtgcacagcccaaacttttcagagccggcccgaggcctgcgggcccgggcgccagggtggtttttagggttttctttctttcttatttcccttcttcttctccacagttgatgattttctgcagaaaaacaactgcgaaaaagaacctatttcatttccagttcccatcaccgcgatttccacatggatgtgacgtgaccccagcttccgaaatgcccaggtgactcacgcggggacaccccggggcggggcgagggagtttctccgggcgcctgcagggaccgggcggggcggggcagcggggcggggcagggaaagggggcggggcggggcccgcaggcccggtcgggcggaggccgcgcgcgcccctcgccccctgcgccctctggcggccggctggacgcacttcgcagcccgacccagagagtcacgtgactttggaaagtcccgtggaaatccccgggcctacaacccgcatacaactgaaacggggcaaagcagactgcgcagtctgcagtcttcgtggcgggccaagcgagcttggagcccgcgggggcggagcggtgagagcggccgccaagagagatcacacccccagccgaccctgccagcgagcgagcccgaccccaggcgtccatggagcgtcgcctccgcccggtccctgccccgacccccgcctgcggcgcgctcctgccttgaccaggacttgggactttgcgaaaggatcgcggggcccggagaggtaaccgccgcgcctcccggagaggtaaccgccgcgcctcccggagaggtaaccgccgcgcctccccgtgccgtctgcctcgggctcaccgcagtcaagggctgcgggtgcatgttgggcagcgacccccgggctggcaccgtctacctggcgttggttttg

SEQ ID NO: 141 - DNA, 993 bp, Homo sapiens
actgggcacaagtcgtttatgataacgaaattgtagtttaatctgtgaagagatgtgaatgtaactgagacacgcttaaatggaatatacagatgagctttatttttatatctggcatgcttggatccatgccgaccctccagctgctcgggcctgcccttaggggctatggaccgcatgactctatcagcggcactgccaccgccgccgcctccgtgctgcctgcgttccccgaccattgattgggcccggcaggcgcttcctgggggcttccctaccggctccagcccttgggattcgggagcgccctgctaggaagccagagccccgcaggggccgcggcgtccaggccgcctaacgcgcgcccctcgcccggcgccccgaagcggccccgaggggcgggagccgaggcgagcggcaaggccgggccgggggcgcacagcgcccctagaagtgcgggcttcccccacccccggcagcgaccctacctcccgcccccgctgcgtgcgcgcgtgtgtccgtctgtctgtatgctctctcgacgtcagtgggaatttccagccaggaagtgagagagtgagcgagacagaaagagagagaagtgcaccagcgagccggggcaggaagaggaggtttcgccaccggagcggcccggcgacgcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcccggccaccgcgcgccctgcgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacc

SEQ ID NO: 142 - DNA, 1062 bp, Homo sapiens
agtggtctgggctatttatgggtaactttcaggggctgcagggaggaacaaaccaataaataaaacatccatgcattcatccaataaacttttttttttttgagatgggagtctcgctctgttgcccaggctggagtgcagtggcacgatctcagctcactgcaacctccgcctcccaggttcaagctattctcctgcctcagcctccggagtagctggcattacaggcgcacaccaacacgcccagctaatttttgtatttttagtagagatgggatttcaccatgtcggtcaggctggtctcgaaatcctgacctcgtgatgtgcctgcctcggcctcccaaagtgctgagattacaggcatgaaccaccgcgcccggcctccaataaacatttattgggcacctacggtgttccaggcgctggtctaggcgttggggttacaacaacgcacaaaacataaattctgaagctgacacgctagctttaaacgttccttaaatatcttcatcctcaatttacggttgaggaaactgaggtgtagcgagaccttggaggtttccgaaatattattatggatggcaggtgtagagccctgccaacctctcgatcctgaagctccccttccagcctgagaaacggcaggttcaagtcccactgggagaccaaagcggggagcggctcagtttgccggcttgctcaatgggtaaggcgtgatggctctaagcaggcctcagttgtctcgtccagagcaatgggcagcgacgcctgcccaacccctcctgagcgcccagcctccctttcccggccggccccgcccccgcgatcacgtgacgcgtgggggttttcccgttccccaggcgtgacgtcacggcggggtgcagaccaatgggcgcgcaggccggcggcgccggggaattccgccgccccgcccccgcccgccgcccgcccggcccggccccgcgccccgcgcagccccgggcgccgcgcgtcctgcccggcctgcggccccagcccttgcgccgctcgtccgacccgcgatcgtccaccagaccgtgcctc

SEQ ID NO: 143 - DNA, 959 bp, Homo sapiens
ctgggagttgtagtctgaacgcttctatcttggcgagaagcgcctacgctccccctaccgagtcccgcggtaattcttaaagcacctgcaccgcccccccgccgcctgcagagggcgcagcaggtcttgcacctcttctgcatctcattctccaggcttcagacctgtctccctcattcaaaaaatatttattatcgagctcttacttgctacccagcactgatataggcactcaggaatacaacaatgaataagatagtagaaaaattctatatcctcataaggcttacgtttccatgtactgaaagcaatgaacaaataaatcttatcagagtgataagggttgtgaaggagattaaataagatggtgtgatataaagtatctgggagaaaacgttagggtgtgatattacggaaagccttcctaaaaaatgacattttaactgatgagaagaaaggatccagctgagagcaaacgcaaaagctttcttccttccacccttcatatttgacacaatgcaggattcctccaaaatgatttccaccaattctgccctcacagctctggcttgcagaattttccaccccaaaatgttagtatctacggcaccaggtcggcgagaatcctgactctgcaccctcctccccaactccatttcctttgcttcctccggcaggcggattacttgcccttacttgtcatggcgactgtccagctttgtgccaggagcctcgcaggggttgatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattgggtaagctcctgactgaacttgatgagtcctctctgagtcacg

SEQ ID NO: 144 - DNA, 1085 bp, Homo sapiens
ccattagataacacctccctcccaccccaaccaagcagctccagtgcaccactttctggagcataaacataccttaactttacaacttgagtggccttgaatactgttcctatctggaatgtgctgttctctttcatcttcctctattgaagccctcctattcctcaatgccttgctccaactgcctttggaagattctgctcttatgcctccactggaattaatgtcttagtaccacttgtctattctgctatatagtcagtccttacattgctttcttcttctgatagaccaaactctttaaggacaagtacctagtcttatctatttctagatcccccacattactcagaaagttactccataaatgtttgtggaactgatttctatgtgaagcacatgtgccccttcactctgttaacatgcattagaaaactaaatcttttgaaaagttgtagtatgccccctaagagcagtaacagttcctagaaactctctaaaatgcttagaaaaagatttattttaaattacctccccaataaaatgattggctggcttatcttcaccatcatgatagcatctgtaattaactgaaaaaaaataattatgccattaaaagaaaatcatccatgatcttgttctaacacctgccactctagtactatatctgtcacatggtactatgataaagttatctagaaataaaaaagcatacaattgataattcaccaaattgtggagcttcagtattttaaatgtatattaaaattaaattattttaaagatcaaagaaaactttcgtcatactccgtatttgataaggaacaaataggaagtgtgatgactcaggtttgccctgaggggatgggccatcagttgcaaatcgtggaatttcctctgacataatgaaaagatgagggtgcataagttctctagtagggtgatgatataaaaagccaccggagcactccataaggcacaaactttcagagacagcagagcacacaagcttctaggacaagagccaggaagaaaccaccggaaggaaccatctcactgtgtgtaaacatgacttccaagctggc

SEQ ID NO: 145 - DNA, 1061 bp, Homo sapiens
gaagtggctattccggtttctttttgatgggcaagcattttgcaaggccttgggctatgtgtgtgcaaggctaagccagttagttaattgggatttttttaaaaaggcacttcactggggggaaaaggaacatagagttggttattgtccccttgcctataataaaaacctattatttttaattttttaactgggtttgcggttaaatctcacagcccaagagatttgccacttcagatggattccatacacttgcatttaagtatgcaaaaaaattccaattatccagcaatttaaccaaattattggtaacttttctaaaacaaaaaaaaattgtttcccttgttttggcagcaatttcagttacagtcctttactttctactcaagaaaatagtttcaaaaagttgatgtttgttgctaaaagaactatttttatgaataaatataaaactaagaagttatggtgtcccttttttaaaaaatgactcatcaaaagaaataactttttcctttctcttgtaagagaaaaaaattaatctcttttagaattgcaaacatatttccttgatggagaaaatcaattcacatggcatagtcgttatttatccagttcaaaaaccagagtagaatttactactctgtctccattttttctctccccacccccttaacccacattggattcagaaagcttcattctgcaatcagcattgtcctttatctttccagtaaagatagccttttggagtcgaagatgaggaaaagcctgtattttatagtcttggaagtgtcttcttttgccaggacagagagaggagcttcagcagtgagagcaactgaaggggttaatagtggaacttggctgggtgtctgttaaacttttttccctggctctgccctgggtttccccttgaagggatttccctccgcctctgcaacaagaccctttataaagcacagactttctatttcactccgcggtatctgcatcgggcctcactggcttcaggagctgaataccctcccaggcacacacaggtgggacacaaataagggttt

SEQ ID NO: 146 - DNA, 1067 bp, Homo sapiens
aaggccttacagtgagatgggatcccagtatttattgagtttcctcattcataaaatggggataataatagtaaatgagttgacacgcgctaggacagtggaatagtggctggcacagataagccctcggtaaatggtagccaataatgatagagtatgctgtaagatatctttctctccctctgcttctcaacaagtctctaatcaattattccactttataaacaaggaaatagaactcaaagacattaagcacttttcccaaaggtcgcttagcaagtaaatgggagagaccctatgaccaggatgaaagcaagaaattcccacaagaggactcattccaactcatatcttgtgaaaaggttcccaatgcccagctcagatcaactgcctcaatttacagtgtgagtgtgctcacctcctttggggactgtatatccagaggaccctcctcaataaaacactttataaataacatccttccatggatgagggaaaggaggtaagatctgtaatgaataagcaggaactttgaagactcagtgactcagtgagtaataaagactcagtgacttctgatcctgtcctaactgccactccttgttgtccccaagaaagcggcttcctgctctctgaggaggaccccttccctggaaggtaaaactaaggatgtcagcagagaaatttttccaccattggtgcttggtcaaagaggaaactgatgagctcactctagatgagagagcagtgagggagagacagagactcgaatttccggaggctatttcagttttcttttccgttttgtgcaatttcacttatgataccggccaatgcttggttgctattttggaaactccccttaggggatgcccctcaactggccctataaagggccagcctgagctgcagaggattcctgcagaggatcaagacagcacgtggacctcgcacagcctctcccacaggtaccatgaaggtctccgcggcagccctcgctgtcatcctcattgctactgccctctgcgctcctgcatctgcctccccatgtaagtcctggtcttgac

SEQ ID NO: 147 - DNA, 900 bp, Homo sapiens
gcctggcctcctttttatttttttcactgaacaaaccatgaaactttcccagatgtaaatatctatttcccatttttctttttttaaaataaggcattattttaaccatttgagtgttagatattatttttagataatattttaatttaggcataactgccgtgcaaaatctgaagattaatatctaccttgtgagtcattcctctgtgagacagtgcatgttaaatatgttgaattggcaggtgaaaaaggaagaaaaaatgagtagtgattggttatccacagctatgaatgagaaattgaaggtagtagactatggatgacaaacctattcttggtttccttctgtttctgaaattctaattactaccacaactacatgagagacactactaacaagcaaagttttacaactttttaaagacatagactttatgttattataattaaaaatcatgcatttttgtcatattaataaaattgcatatacgatataaaggcatggacaaaggtgaagtagcttcaagagacagagtttctgacatcattgtaattttaagcatcgtggatattcccgggaaagtttttggatgccattggggatttcctctttactggatgtggacaatatcctcctattattcacaggaagcaatccctcctataaaagggcctcagccgaagtagtgttcagctgttcttggctgacttcacatcaaaactcctatactgacctgagacagaggcagcagtgatacccacctgagagatcctgtgtttgaacaactgcttcccaaaacggtaagtgcagaacgctttataagggcagcctcgggccatgaaacacagatatgcaaaaggccttctaataaaaaccacatctgtacaagctcttattgt

SEQ ID NO: 148 - DNA, 1736 bp, Homo sapiens
gatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaatgctgtctgcttgtgtgtgtgtgtctgggagtgagaacttcccagtctatctaaggaatggagggagggacagagggctcaaagggagcaagagctgtggggagaacaaaaggataagggctcagagagcttcagggatatgtgatggactcaccaggtgaggccgccagactgctgcaggggaagcaaaggagaagctgagaagatgaaggaaaagtcagggtctggaggggcgggggtcagggagctcctgggagatatggccacatgtagcggctctgaggaatgggttacaggagacctctggggagatgtgaccacagcaatgggtaggagaatgtccagggctatggaagtcgagtatggggacccccccttaacgaagacagggccatgtagagggccccagggagtgaaagagcctccaggacctccaggtatggaatacaggggacgtttaagaagatatggccacacactggggccctgagaagtgagagcttcatgaaaaaaatcagggaccccagagttccttggaagccaagactgaaaccagcattatgagtctccgggtcagaatgaaagaagaaggcctgccccagtggggtctgtgaattcccgggggtgatttcactccccggggctgtcccaggcttgtccctgctacccccacccagcctttcctgaggcctcaagcctgccaccaagcccccagctccttctccccgcagggacccaaacacaggcctcaggactcaacacagcttttccctccaaccccgttttctctccctcaaggactcagctttctgaagcccctcccagttctagttctatctttttcctgcatcctgtctggaagttagaaggaaacagaccacagacctggtccccaaaagaaatggaggcaataggttttgaggggcatggggacggggttcagcctccagggtcctacacacaaatcagtcagtggcccagaagacccccctcggaatcggagcagggaggatggggagtgtgaggggtatccttgatgcttgtgtgtccccaactttccaaatccccgcccccgcgatggagaagaaaccgagacagaaggtgcagggcccactaccgcttcctccagatgagctcatgggtttctccaccaaggaagttttccgctggttgaatgattctttccccgccctcctctcgccccagggacatataaaggcagttgttggcacacccagccagcagacgctccctcagcaaggacagcagaggaccagctaagagggagagaagcaactacagacccc

SEQ ID NO: 149 - DNA, 1081 bp, Homo sapiens
acgccactacatccggttaatttttgtatttttagtagagacggagtttcactatgttggccaggttggtctcgaactcctgacctcaagtgatctgcccgcctcggcctcctaaagtgctggattacaggcgtgagccaccgcgcccggccccactcttaataaatgcctgtctccaggtgctgggtgggaggtgggatggaatggaatgaggtgaggacgcatggatgcatggatgaatggatgggaagttgagacgacgcgcccacacgagggaatttcctttgaaagagagcgaaattctgagttgggaaactcttccttgaaacgcctccccataccccagctgtggccttcccgttttctgcgtggtggtgtggggggaacttcctcaggcctctccgcagtggagcctctttcggttctgccaggatacctagaggcagcggagagcggggcagggaggggaaaaccgtgagggtccctgtggcaggccccagcacccatgggatctctctccggtcgcaggaagcaggctagctcctagcccgcctcggcttggcctttgtgggacctgggggcaaagaagaagagctgtctctgggaccatgcctcctcccgtacacagcaagatgcgtccctaaactcccgggggaattagacttgtgggaatgttctggggaaactcctgcgcggtgaattgctgggggctccgcccccccgataggtggaccgcgattggtctttgaagaccccgcccctttcctgggcggggccaaggctggggcaggggagtcagcagaggcctcgctcgggcgcccagtggtcctgccgcctggtctcacctcgctatggttcgtctgcctctgcagtgcgtcctctggggctgcttgctgaccgctgtgagttgtttttgccccgaccagacgggagttgggagtggggaatgagaaggaaagggaaggaagacttcggggaagaggccttcctggctgatttttgtgggggcaggagggtgggtgggagctgggcaaggtgcccccgctcctggctgaatggggtgggctgcctctctcttctc

SEQ ID NO: 150 - DNA, 1063 bp, Homo sapiens
cgaagttaggaggactcaagacggtccctccctggacttttctgaaggtagaaccagcctcataagtaactaggctgggtgaacgggggcgctggctagtttatggatcacagtcggctggtgaggccacgtgcctactgtgtggccctgggtggccccgggcaagcccctttccctctcaggacttccatttcttacctgcaaaattgtggagagggggagggctgaaacacatgactgccaagattctttccagttcctccgtcagggttgagtttagatggccggagtaaaagaaggagggaggtgctgcggtggtgggggtgatcttggcttcactagaatccccagttcttcccctctctacagttttgtctctgaggtcacaaaacctgtggcccccaagacacacatgcgcacacacgcgcgtgcacacacacaccccacacatttattttttaatctaggggctcaaaagatgacacgcgccagagctggaaggcgtcgccaattggtccacttttccctcctccctttttgcggatgagaaaactgaggcccaggtttgggatttccagagcccgggatttcccggcaacgcccgacaaccacattcccccggctattctgacccgccccggttccgggacgctccctgggagccgccgccgagggcctgctgggactcccgggggaccccgccgtcggggcagcccccacgcccggcgccgcccgccgggaacggccgccgctgttgcgcacttgcaggggagccggcgactgagggcgaggcagggagggagcaagcggggctgggagggctgctggcgcgggctcgcgcgctgtgtatggtctatcgcaggcagctgacctttgaggaggaaatcgctgctctccgctccttcctgtagtaacagccgccgctgccgccgccgccaggaaccccggccgggagcgagagccgcggggcgcagagccggcccggctgccggacggtgcggccccaccaggtgggtgacccggtggcgcgtcctcggcggcgcgccgagaggggacactctac

SEQ ID NO: 151 - DNA, 914 bp, Homo sapiens
ccagcattttcatcatctaagggtcaggtgccttgaagtgtctgctggcacccagggaagagccccccagcttgctgtcacaggacacagctgctcccttcctggccaggtagctggcctccctcccagaatgggacttgaagctggccgggctgcttgggggctgcagaggaagaagggggctgccggcaaacctgctgactcaggctccacgagggagcaagtaacactggactcctttcggcactccgagaatggggtgggggcgtcttcaaaggatttccctcccttcccagtgcttgtccctgctctcggtccgttttctgctaagatttggggattttcaggcctggagggaaagtcccttgggacgatcatagagcgctagcactgaatcagcctggagagcgcggaaggaaagggtcggtccgcagagggcgcggggaaggcagggtggggacgcggtggagcccgcgctcgtttgctgaaggcttggaagtgcagcgcagaagacagagggtgactaggaagacgcgcgagcggggctggccggccggcgggtgggggaggggaggcgggggaaggcggctgagtgggcctctggagtgtgtgtgtctgtgtcagtgtgtgtgtgtgtgtgtgtatgtgtgtgtctggcgcctggccagggtgatttcccataaaccacatgccccccagtcctctcttaaaaggctgtgccgagggctggccagtgaggctcggcccggggaaagtgaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatga

SEQ ID NO: 152 - DNA, 1486 bp, Homo sapiens
tcctccaaagctttcacaacttctacctggcgggggtgcgtgggggggtgggggcgaagctaaaagttcctttgctgcaaagagcctggtataggcagaaacaccggcgcggcctgcagccccctaaccacagtgcgtccttccccttagaagtctggggaaagcaaatccctacgcccagccatcatttccactcttgcgttttcaaaagatcaaaaaacggaaaggaccggcaggttggcaaaccccaaagagggaccgcccatcaggtcggcgtccttgggatctcagcagccgacgaccccaattcaaatcgatcgtgggaaaccccagggaaagaaggctcacttgcagagggacaggattacagggtgcaggctgcagggaagtaccggggggagggggcctggtcggaaggactttccagccactcggcgctcatcaaaaagttccctgtccgtgaccctagtggctcatcgcagggagtttctccgatgaaccccagctcagggtttaggcttctttttccccctagcagaggacgaagccagttctctttttctggtctgactggcttggaaattccccgagcctgaccccgccccagagaaatccccagccagcgtttatagggcgccgcggcggcgctgcagagcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgtaagtggcggaggcccggggctgggggtcgtcgggagggcgggacgcgcgcggcctgggggtgggaggcgccgggcctggagcccgagccgggggaccagcgatgcagccgggcgggcgccgcggcaccccggggctcctgcaccgccccgaacgctgcagggctgcagggccgcgcggggcaccggcccaactcggaggggcggcggctgggccctggtggatggcagcgtcgccacacgccccctccccccagacccgtcctctaggccgggggcggggcggcagcggggacgcgaagtccccggttgcataaggcggggcgggagtttctggccgctggcgggcgccgagcagccgggaggggaagtacagggcgttccgagctggcgggagggcggggcggtctggccggcgcccgccggggccgcggggggaggggggcggaaagtccctgggcgcctgccaggaacactcagctcataataacctcgcg

SEQ ID NO: 153 - DNA, 1496 bp, Homo sapiens
aactttcagccaatgaaaaagggcgcgaggcgtgacgcacggaaacgtcatgggaattcccccctccggggggccgagaaggggctttcccggccctgagccctgctggcaggcgaggtgtcgcgaccggtcccaggtgggtcgggcgcggagagaagccgcaaccagagccgccgccacggtgagtggctggattcagacccctgggtggccgggacaagagaaaagagggaggagggcctttagcggacagcgcctggggctggagagcagcagctgcacacagccggaaagggcgcgcaggcgacgacactcggatccacgtcgacaccgttgtacaaagatacgcggacccgtacgtacacctgtacctgtgctggcgcacacacggcagcgtccgtgcagtcgcactcgcacacacatgcacacggagacgtgcccaccggtgcactggtgcctgcacccacacccttcacgcacaaactcaagatacgctcacccgtgtccgtacatcaagacaggcgctgacacacacccacactgagaagctcgggattcacctatctacacacatgctcgcttgcacactcatgttgacgccatggacacacaacatgcaaccaagcactacagccgaaacacacttgtggagctgtgatggagacacactcttgtattaggtgggggggggggggggggagcgtgcagagatctccctgtcgcctgcgcgcccagaaccggtgcggtgtgggaccagctgctgttgtgaggtttgggagagagagaaaagagcccactccgaggaggagacacttttcccgcagccccagaatcgcgttctcggggcagaaccccggggcctcccacaggaaagagcccccgcctacaggctgttcgaaggggaggccgtccgacagcaggaatgtccccccaaaagcccccggggtttatcagccgtggcctccctcctggcagaaaatcccaaggttgctccagaccgggggaggggagcgggaggcggacttggccccagactgccagcctcctcccggccgtgaaagaccctcctgttccctgccctggagggaggagggggcttaacccccaccggggcttcccggattctcctagacctctgcccgctgaaaagcagcgggagcccgtagactgtcgagggcctcccgcccctcccgtcgcgagggcggggccagtggcgtcatttccaggcccgccccctccggccccgcctccccttggtattttcgggactttcctaagctgctctaactttcctgccccttccccggccaagcccaactccggatctcgctctccaccggatctcacccgccacacccggacaggcggctggaggaggtcggaccctcccccaaatctgggcccccatctcccgcccacccccatttagatctgaccccctcccccacgccactcctcccaactttaggcgggcgtctaaaattctgggaagcaga

SEQ ID NO: 154 - DNA, 2023 bp, Homo sapiens
gcagcaaggaacacatacagatggttgaaaataaaagtttcagttatggaatttccgatcaagaggtaaatacatatctcagcagccagggaggtaaatttgtaccaagagataatttgactgagaagtttaagctgacttttccaggtcaagaaaagaatcaagaagaagtgagggaagataaagctacatttattctactattgagttggaaggagccttaaagatcctcggttcaaatgaggaaaccaagtcacagaaaatgcaaacgacttatgcaaagtcacacagagttaatagtagacctgggactaaaattcaggtctaactcttatcccttgtttccacttctacttcctacttgccactgctcatttggcagtgaggggagatttcccaaattataagtggtttcactgtgtctttcttaccaggccgtaagttactctggccccaaaggacgctcctctgagtatgctttccgacggaccgacttatcatgaatagagggtcaaagaacagggttaacttcaagttagaggctattcctctctaacaaagccgcccccaagccacgagtggtggcagtagtccagagcagaagccagccagccagtcttggggctgccatctgccccaggcgcccatcctaagcaaagtccccccagtgggcacatgggagtgggcagggaagacacagggaagggagtaaggcagcatctgggccaaggagaggccttcctgggtcaagctagggaagggcatcactagttaacacagaacgcccattatcagtgcttgggctaagagttgcccagtggcaagtttatcaaaagtctgtgtgatgagttggtccttctcaataagtgcctatatttccttctcccaagtgctgttctacttcacccagggcaccatttcctcatctctttgcaccatccccaaccccctttcttgatttaaccagcccccactgtccgggaccagagtgaaagcgaaagcgctttagagtagcttcccgttgacgcttccagctaagagtcaaagcacccgctttttccaccagcctcgcgtgcctgttcccttcacggacactctagacgacccccctcagaaaagaaatactctatgctcattgcgggttgcaagcgctggctgctacaggcgacctccctgcgctcccgttggtctctgcattcacttctccgcgcgcgcttccagggtcccctggccgctgcatctcctccacccctctgccaaccctcaagcccagacccattaccccggtgtggacttctcccgcccggggtaagtccccggttggtgctcccgcccgcagcatccctgcaaggcaccgctctcctcgccgcctggggcactggtttccaacctgggacagcgcacaacgcgcagccgacagccccgccccttcgcggcgccgccaggaggcgcctgggtgctgcggggctgctttgcgcgcggcgctaacgtgtgtagggcagatctgccccgagacaagtgacgaggcagccccgccctgaggctggggtgggaaaactggtgcaagtggaaaggcaggaggcagggagaggcgagaagggtgtgcgtgatggagaaaattgggcaccagggctgctcccgagattctcagatctgatttccacgcttgctaccaaaatagtctgggcaggccacttttggaagtaggcgttatctagtgagcaggcggccgctttcgatttcgctttcccctaaatggctgagcttctcgccagcgcaggatcagcctgttcctgggactttccgagagccccgccctcgttccctcccccagccgccagtaggggaggactcggcggtacccggagcttcaggccccaccggggcgcggagagtcccaggcccggccgggaccgggacggcgtccgagtgccaatggctagctctaggtgtcccgctccccgcgggtgccgctgcctccccggagcttctctcgcatggctggggacagtactgctacttc

SEQ ID NO: 155 - DNA, 996 bp, Homo sapiens
aatctctccacctctaacccctgccctgtcccaggctccccctcctgcgtctcaatgagccatgtcccacggggttcctgggtgactccccacttcctcctgcaccaccagggggaaggtgtggtgaccacaggacaatcagctgggcagagaagagaggacatcaaagatggtcaggaagaacatgagaaatcctgagcttcagctcagccgccagacccgagggagccatagactgaccaagaactgtccctttgactatgggaatcacagcccccaaagagcaaccagcacaggcctctcctcccaagaggcatgagagattcaccctgcacacctccaggtaggacactttcctctgtgacacccaggtcctcaatgtccatccttggaagctgcagccaagctagacacgattagagaaaggaagggtccttctcaccaggcaacacacagctcacacacagcacaatggggcatcactgtgacagggacctggtgcagctccagcctcctgcactgcaagggagagccagatggggatgaaagagggcaaagggcatgaatgtgcaccgcaaccaagacccatggggacacctggaggctgaggcccaggactctgcttgcccaacctgcagggtatgtgtgtgactgtgggtctgtgtgtgtctcttctgtgtgtgtgtgggggggggggtgtgtgtctgtgtgtgtttgtgtctgcacaaagtgtgtgttgaggtttggtgaaagaatcactgctgaaaaaggcagaggcctccacaattcccagggacctgaaacacagacaaaaggaaaaacagaaggagggacaaggaggcaggatgtagagaggaggggacagagaggtgtcctgggcctaaccccacccatgagcctgagaagtgctcctgccccaggaagaggctcagcgcagaaggaggaaggacagcacagcctacagccgtgctcaggaagtttctggaacctaggctc

SEQ ID NO: 156 - DNA, 793 bp, Homo sapiens
tgttttgagacactctcgctctgtcacccaggctggagtgctgtggcatgatcacggctcactgcaacctcgatctctgggttcaagtgattctcccacttcagcctcctgagtagctgggactgtgggcatgcaataccacacccaataatttttgtatttttagtagagatggggtttcaccatgttggtcgggctggtctcgaactcctgatctcaaggagtctgcctgccttagcttcctaaagtgttgggattacaggcgtgagccaccgcgcctggcgtatttttttgaggcagggtcttgctatgttgcccggtcttgtctcgaactcctgatctcaagggatcctcccatctaaaactcccaaggtgctgggattccaggcgtgagccctgcgcccagctgctgaatgggagcacccagctgacgtttgtctcttccgtggcaggtgtggcggctgatgctgagtctagggctacagccgagccgggacagctacaacctgctgttggtggcagctcgggactgtggcctaggggacccccaggtggcctcagagctgcttctgaagcccagggaggaggcgactgtgcttcagcccccagtgagcaggcagcggccaaggaggacagcccaggccaaggcaggcaacctcatgtcagccatgctgcatgtggaggccctggagaggcagctgtttctggaaccttctcaggcacttgggcctccagagcctccggaagccagagtgcccggcaaggcccaaccagaggtggatactaaggcaga

SEQ ID NO: 157 - DNA, 1089 bp, Homo sapiens
caacacagtagcaaacatctggctgaatgctggagaggaagacagtgggagatccaggccaggctccatggacgaactgcttgttggctccttaggctttgggtctgcgggaccctttcgctactgggaatgggagcctgtctgactgcactgggtctgagactccctgctcctgctggtcaccatctacacgcatgtggtgttggtctccagggttagaaccagaacccctgaggacgcgggaaaggctaggaagcctggggatgacctaaagtccagctatcaaaatgcgccgcgttttcagaaaaactactgccacgatttaacctaaaaagcttcatctgtattttctgccacagtttgcttccgtttccttcagtcactattccctggcgaagtctccacgcgctcccgttcgccggggaacttagggtatccgggcttccctaaattgacaagcgggggccggcgccttcgcccgccttcgctggccgccgcttggtttgttcttcttctccttcggggacttctccgcccgcgcccgcgcccgcgccccagctttcgtcccgctgtgcggagatgccacccagctccaccgcaggaccgcggagcgagaggcggcagacgcgctccgggggccgccggtcaagaggaagatgaagggcgcgacgacttcgcggtttccagaatgggctccttctggcccaacaataagtgccatttggaatcttctcggccttctctgtgccttccgcgcgtctgggctccccggtaccgtagacccggccccgagctccgccccctcgccctgggcttccccgccccctcgcccccagtctcctgggctcttcggggcggcggaagagccgagaaccttcgcgaaggtggggcgggcgcccccgaggttgggcccgcggtatgggcagtggaaactgcgcatgcgcggcgtcagggtcgggcggaagttgacgccgccgtgccgccgccgcgtgacgcatttcctgtttgttgttggagaaaggagagaaaggaaagcgcgaggagccgccgccaccaccagcgcagcagtcctggagctgtgaggagatt

SEQ ID NO: 158 - DNA, 810 bp, Homo sapiens
atgacttcgacaagagccaagccacactgtgtaggagatgctcgggtgaagccagctgtccctggccacacacagcttgaaggcaaaatggcaggagctcaagcgaaagccaggcaggtctccccctgaaacctctgcacaggtgggcgctggcggggctgaagggcaagggcaccgctcaagctggctttggtcagggttagggacagggccggctccagaggcgacggggtcgcaccctgagcggaggggctcccggggtccccaggggttatggtgatggcgggaccccctagagggagggtccaggaacgaggcaggtggactgggaccttgagggcagggtgggcctgggcggtgccaacaggctgccgagggtggctgctgtcccgtttctccagcagccagggccgtgcgcttctagaacattccccgtggctttcctaaagggagcgtggatggagccagggtgtgcagatttctgtgagaaatattttcacctgggagccccaagggggaccctgcccacctttgaacactggcagatgggctggaggcctggagcctggggacggggctttgagggtccggaaggagggcggggctgtgcggccggcggaggcccccgaaagttccagaaagcgggtggggaggtcggcgcgggaggctcagatggctggaggcggcgggcacgcacactgcggggctccgaggggcacaggtcagtttcctgaggcgggtcgggacccaggcgtgagactggagtctgcccaggggcccagctgaggcagcctcctcgtcagctgcttg

SEQ ID NO: 159 - DNA, 1086 bp, Homo sapiens
ttccttcttcaggtttttccagaaattttcaggaaacgctgggtcaagctccctgcctggcaccatgatttttacccaagatattacacatccacaaaggccctgcagaagcaggtgagacgctgcgcgtgcgcccgggttctcgcccccctgccttacacaccggcagcacacgcgcgtgcaaagagccctgggggagaaaagggtcgggcgggccttgccgctccaaggtgccatcgggcgctggtcactgagtggccaccaatccctcccgcccagcccaacaaaagaggggcgtcagggatccccgtacgcctcagacaggcccgggcctgcaggcctcggggccacgcgggactcaccattactccctccgcctcagactcgtactctgctctagtgtagcgccgcaaagagactcgcagtccggccctggcgacacgtgaaaaaatcacccagcgcgcaggcgcgctcgccccagcggtcgccgctagccccctcgcccctcccagggagggagggcggtcgccccgacgcgcaccgcgattcgccccaagggccctgcgcaggacgctgacgcgaagactcggaggcggaagaaaaaaggagctgtttctaggcttttctaggcgcccagccgaggtgaaagaactaccccttcgtcccctcccggaaatgacgcgatttgacccttgagccgtagggagcgcggcattttctggaaagttctggaaccgagcgaggcccgggaactagactaagccggccggagagggctgagcgcgctagcacaccctgcgcgggtagggaggggcggggctcgcgcgcagggtgtgcagattgcagggcccgggctgacgggaagtgggtgggagctgcctgcacacgcggtgccgcggggcgggagtagaggcggagggaggggacacgggctcattgcggtgtgcgccctgcactctgtccctcactcgccgccgacgacctgtctcgccgagcgcacgccttgccgccgccccgcaggtacgcggccttcccgcaccacctccccccggctcctgcgacccccgagtgggccttcctcctctg

SEQ ID NO: 160 - DNA, 1094 bp, Homo sapiens
gaagctaaaggatccatcacgaatctgggaaccctccctcgcggttctccccggccacacagcgtgggagccgctgggttagggtaggaaaaggggcgcctgcttggaggagggtggtcgggtcatgctgtgcgcagccagggaagccgagtttgggaagaaggcagccggggagccggaggggataaaaatacccacaggggctgaaagagttggggaagagggggcggcgaggacgaccccggttcaggcgggaaaggaaagatggaaagggggcgcaggaaatgggcgccaaagaaagaagtgagaaattgcggaggaggaagtcgtccctggaagaggaggggcaaaggggaagcgagaatggagtgtttgcactttcgagagggaagggccagagcctctcccgaccagggccggcggggcggacgcctggggaaggggcgtccgggcgggctgagggggcggcgcggtgcccaaggtccccggggtccctacctgaaccgctcctgtcccgccgtgtcccagagctgtagcttgatcctcttgcccggctcgatctccagcaggcgggagaagaagtccacgccgacggtggggtcgcaggcgggggagcgcagcccggggaagcggccctgggtgaagcggtgcaggaggcaggacttgcccacggtggagtccccgatcacgatgaggcggaactggtagatccagatggtctccatcgctcacgtgccccgctggctcccgggccgccccacccgcgggctaagttcggcggcgggaactgtcctttcagcacctcgcgggcgcccgcccgccgccttccagcatattcctgcggctgcggccgccgcctggtgcccgccctctcgggagagagaggcggggccaggcccggctaggggcggggcctctggacgggggcggggcgggggcggtggcgcgtgggagggggaagcaggtttgctgccgcgaactcccgcccctgaccggctgcaaatcactctccctcaacgctcactgggcgccggcaggaaagtgggcgtggcgggaagacgtgacagcagcaacaaccaaggaaaatgaagcaa

SEQ ID NO: 161 - DNA, 980 bp, Homo sapiens
gggggagtggtttatagaacaggttactggctccacacagcaagccctccaccgcccacggcttacagcttctccagccgaatccctctcgcccctcaggctggcagagtttacctgccaggtttccccttgcacttggcgctgaccgatttccttcctttctccctcccaccctggacccaagtggcggtggggaaagcccagccctcaacaaacaaagggaggggaaacagagaaagcgaaaccaaaagccgcagtctccgcccggctccccccgcagcccctcgcccctgcctccctgtgcgcgtgcgcagggtcgccaaccccactccccccccccaccccgagcgagcacggacggggaggggggccgcgggggcgcgcacggaggggcagccgaagacagtagctccttggagatcccaggctggggaaggagggaggtctaggaaaggtctcgggcccattcactgtgcgtgccggggatgggttgccagggcaccacaccagccctccaaaagggaaatcgtgggcccaggaactgacagcggtcctacccacgcggccaactgcctcccgaccgcggctccatcggtttcccggcgccaatggcgccagccaggggactaggggcagcgcgagggctcaaactcaccggtgcgggctgaggccggtgtgtgagggagcgggaaggagcgccgagctgtgcgcagccggggtagttaccgctcctccgcctctcaccgagcgttctggaaagttccgcccggcgcgccgcagccgtcctcttttgtagccgaacccgggcgcgtcacccgccggaagtcccgcccttctcggccgctgccaccgccccgccgttacctgggcaacggcgcgggggcgcacgggtcgggaggagctgcgccgaaaggccttgtgggtgttggtgctagcgcggcttcccggcgctcgtggaatcttctggagcccttttctcc

SEQ ID NO: 162 - DNA, 994 bp, Homo sapiens
agtggttacaatcccccaaattcaaaccccacgagttgtccctcccgcgcccagccgaggtccaggatccgcgtcgcacgtgatggaacccgcatggacccgcgaggcctggacccgcaggcctgggcctgcggtgcggcgcggtgcggaactccaggttgtcgccgcccgcaccctccagctggaccgcagaggaggaaggcccactcgggggtcgcaggagccggggggaggtggtgcgggaaggccgcgtacctgcggggcggcggcaaggcgtgcgctcggcgagacaggtcgtcggcggcgagtgagggacagagtgcagggcgcacaccgcaatgagcccgtgtcccctccctccgcctctactcccgccccgcggcaccgcgtgtgcaggcagctcccacccacttcccgtcagcccgggccctgcaatctgcacaccctgcgcgcgagccccgcccctccctacccgcgcagggtgtgctagcgcgctcagccctctccggccggcttagtctagttcccgggcctcgctcggttccagaactttccagaaaatgccgcgctccctacggctcaagggtcaaatcgcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgaccgctggggcgagcgcgcctgcgcgctgggtgattttttcacgtgtcgccagggccggactgcgagtctctttgcggcgctacactagagcagagtacgagtctgaggcggagggagtaatggtgagtcccgcgtggccccgaggcctgcaggcccgggcctgtctgaggcgtacggggatccctgacgcccctcttttgttg

SEQ ID NO: 163 - DNA, 944 bp, Homo sapiens
gagcgacggagagacagacacacggacgtggggaccgaagcagagggggccgcgggaggcggaaacgtccagagccgagaggcgcggcgcggcgaggcccgggcacggccgggggacatgcgagcccggcccgcccggccacgcatctccctccctcgctccctctctcccccggccgcggaaactccgatccagaaacggaaccctggggcgagtctggggacgggctccggacgcggcggtgccccccggccaccccgtgccgcgcccacgtccccagcgccggcgtccggaggcgcccgccaggtcccccagggctcctgagctcggcggcggcgcctccacccggtgcccgcggccgccggacgcgccgggggacgcagctccgggctgggggcgcggcactgcccccgcggccgaagcctctggaagccgggcgcccgcgtgccgacccgggcgggacttaccgcgcgcgcccgccggtcctgcggagctgggtgcgggggtcgcgggcccgggcgccccaggaggctcggcgaggcggccggcagggcggggggcggccccgcgacgctcggctgggctgcgctgcgcgctgtctgcggccccgggcgggcgcgcggcgcgggggagcggctccgacgtcagggtggctccctccaaacagggcgcgagggcgggggcagcggggagggccgcgcgcagaaagagcgggcgggcgcgcgcggcctctccctccgggtgcgcaggagggggcgccgcggcggcaggggccccgggccctctcctggcccgcccgccccgggctgagcttcggcgcgctccgacggcgtggtggggcggccgggacgcctggccggcgcccgagaggcagggcagcccagccgggcgccctggcccgttcttaagcgccctccccgggtttctctgcgcttccactctct

SEQ ID NO: 164 - DNA, 874 bp, Homo sapiens
acagtgaccggagtctcctcagcggtggcttttctgcttggcagcctcagcggctggcgccaaaaccggactccgcccacttcctcgcccctgcggtgcgagggtgtggaatcctccagacgctgggggagggggagttgggagcttaaaaactagtacccctttgggaccactttcagcagcgaactctcctgtacaccaggggtcagttccacagacgcgggccaggggtgggtcattgcggcgtgaacaataatttgactagaagttgattcgggtgtttccggaaggggccgagtcaatccgccgagttggggcacggaaaacaaaaagggaaggctactaagatttttctggcgggggttatcattggcgtaactgcagggaccacctcccgggttgagggggctggatctccaggctgcggattaagcccctcccgtcggcgttaatttcaaactgcgcgaccgtttctcacctgccttgcgccaaggcagggggcgggaccctattccaagaggtagtaactagcaggactctagccttccgcaattcattgagcgcatttacggaagtaacgtcgggtactgtctctggccgcaagggtgggaggagtacgcatttggcgtaaggtggggcgtagagccttcccgccattggcggcggatagggcgtttacgcgacggcctgacgtagcggaagacgcgttagtgggggggaaggttctagaaaagcggcggcagcggctctagcggcagtagcagcagcgccgggtcccgtgcggaggtgctcctcgcagagttgtttctcgagcagcggcagttctcactacagcgccaggacgagtccggttcgtgttcgtccgcggagatct

SEQ ID NO: 165 - DNA, 1018 bp, Homo sapiens
caaatttatttcaatcctgcccaaaactccttcaccttaaaatgccttggaggtggctctcatcaagacaagaaagcagggtgtggtggctcacacctgtaatcccagcactgggaggctgagcctggaggatcacttgaggtcaggagttcgagaccagcctgggcaacacagcaagaccccatctctacaaaaagttagaaaattagcgggatgtggtggcccccgcctgtagtcccagctactcaggaggctgaggtggatggatcgcttgaacctaggagtttgagaccagcctaagcaacatagcgagaccacatctctaaaaaaaaaatttttttttaacccagaagaaaattagccaggtgtgatggctcacacccgtggtccccgctgcttgggaggctgaggtgggcagatcgcttgaggctgcaatgagccgagatctcaccacatcaatccagcctgggggacaaaaaaaaaagaggaatcaaagcaatgacccaagttatggcctcagggacttccaaaatcagagccctaatctgaccaacccgccctgacgcctgtaagaaaacgactctcacttttcattggctgaccctcccggagttgagaccttgcttcattttccttggttgttgctgctgtcacgtcttcccgccacgcccactttcctgccggcgcccagtgagcgttgagggagagtgatttgcagccggtcaggggcgggagttcgcggcagcaaacctgcttccccctcccacgcgccaccgcccccgccccgcccccgtccagaggccccgcccctagccgggcctggccccgcctctctctcccgagagggcgggcaccaggcggcggccgcagccgcaggaatatgctggaaggcggcgggcgggcgcccgcgaggtgctgaaaggacagttcccgccgccgaacttagcccgcgggtggggcggcccgggagccagcggggcacgtgagcgatggagaccatctggatctaccagttccg

SEQ ID NO: 166 - DNA, 902 bp, Homo sapiens
agcagccggtatagaagaaatccgcggagcacagagggttggggagcggaggccccaccaggagaagggtcagccgaaccagggatcgcctgagaccaacttgggtccctccaggggacaccatgggaggagaccgtgggagaagagtctaacctgagaggccgcggacgtttgctacagcgggaaccagcttgggggctgagagcagccaaggcattacggcctaactcacgcgtcgggaagagaaagagggtaacgacggggaacgcaaccgcctgcagggccgcgtcgccaggaaaccgggccagccgcacctccccttccggcggaggcggctcgcgggccttccttgcgcggcggcgcaggttgtgacgtcatgccccgagctgggaccgaccctccggctccacgcccttttttttttttttttttaggtcccgggcgttgagctctactcagtgcacgcagccacacaatatgctcttggacgtcgccccctggaggggatgttatctcccgcctccttgaagtcgcccatttctggggttgccccatccagggagctggttcctagttaagaatatgagaatgtatgcgcagggaggcaggcaacagcacgaacagccacgcttctagaagattctagggagcgcgcaggagcagcgcagagggagtaggaatgagcaggcggaggacccgaggtcacgagaccgttgggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaat

SEQ ID NO: 167 - DNA, 1097 bp, Homo sapiens
cagtcctgtttttgtatttcgcccaagatacacccctgggcaacctcagggtgcgaggaacccagctctgcctcctgctccccgcggctcctgtactacccaaggctcgcgatcttccatgacccctcgaagttgcctccctttcccgggcaaagaaggggcagcgaccccgcctcgcccgccggaccgagccaggtccagcctggctcccccctggggccgtgcttcccccgcccccaacggtcctcaggcctgggtctcacctctccacccactccctcaggaagcgcatttcctcggtgtgcagaacgctcggatcctgcttacacattttcacaaaggcccgaagctcgttcactttgcgggggtccatggtagggaggtggtgggcgaaactgggggggctacggcccggttccaggcccaggcgctggctcggcgtgaccgcgcagaagggggcggctgccgcaagacagaacagactagaacctccccggccgctggctcctcccacccaacggtctcgtgacctcgggtcctccgcctgctcattcctactccctctgcgctgctcctgcgcgctccctagaatcttctagaagcgtggctgttcgtgctgttgcctgcctccctgcgcatacattctcatattcttaactaggaaccagctccctggatggggcaaccccagaaatgggcgacttcaaggaggcgggagataacatcccctccagggggcgacgtccaagagcatattgtgtggctgcgtgcactgagtagagctcaacgcccgggacctaaaaaaaaaaaaaaaaaagggcgtggagccggagggtcggtcccagctcggggcatgacgtcacaacctgcgccgccgcgcaaggaaggcccgcgagccgcctccgccggaaggggaggtgcggctggcccggtttcctggcgacgcggccctgcaggcggttgcgttccccgtcgttaccctctttctcttcccgacgcgtgagttaggccgtaatgccttggctgctctcagcccccaagctggttcccgctgtagcaaacgtccgcggcctctcaggttagactcttctcccacg

SEQ ID NO: 168 - DNA, 979 bp, Homo sapiens
atcttagctttccccaagtgctcctcctacccggatcagccaacgcccacatacctcaggcttaaaccaactagggaactttccagtactttcccaaacaaggacctactgagcctttcaggttcacaatcaatcagatccctactggctcacctagtctcccgacgccttcgcttcagtttggaaacgtccagattacgcagccccagcgagtaggtgggggctccctcaatatcaaactgcacaaccggggtccccccaccccccaccccgtccctccctgcaaatttgagacggctccaactcagtaatctttttccaaactggcccatgaggtcagagacagtatctccattgtaacgtggccgggcggtgtcaacacaaacgcccccaccctcccctggacgcgcgtaacccgctccccgcaccagccccctgcccacaactgcgcaggcccagcaagcccccacaattaaaagcccagcgccgacccttcctgtcaattaggcgctgaagcgcaggcggtcagcatcgccatggagaccaacacccttcccaccgccactcccccttcctctcagggtccctgtcccctccagtgaatcccagaagactctggagagttctgagcagggggcggcactctggcctctgattggtccaaggaaggctggggggcaggacgggaggcgaaaaccctggaatattcccgacctggcagcctcatcgagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagc

SEQ ID NO: 169 - DNA, 962 bp, Homo sapiens
cgcaggtactccactctcagtctgcaaaagtgtacgcccgcagagccgccccaggtgcctgggtgttgtgtgattgacgcggggaaggaggggtcagccgatccctccccaaccctccatcccatccctgaggattgggctggtacccgcgtctctcggacaggtcagagcgggtcgccgggtggggtcgctgcaaaaaccctgccccggccgcagccggagaggcggagcctcgcggggagggggcgggaccgccgagacaggcctggaaactgctggaaatgccgcagtgccgccgccgcgccttccgccgcatgtcggcaaagagtccccgccagccccggccggcgccctccccctacgctgagctgcccctcagcgcgaaccctccgcccttcctctactcctgcgagagtcgggatctggggctacccaaggttgggtcccgaatgccagtccctctgtcgggacgcgagatgtgtagggcagatgctaggaagaagattgggtctgggagcggtggtccgcgtggttagctgcctccgctctttttcggtgtcccccccagtcccgcccttgggtgtggggacgcctgccccacaagtgtttagggaggtcagtgggttcctcgcccgtagagacaccgtttatgccaaatgagcactcctcatccccgctcttgatggagtcatgtcctagacgtgaaactatggggctgtgatcacaagcaaatgtgtgggcggatccgttgcttgggttcttccccgccccctctttttttcggaccatgacgtcaaggtgggctggtggcggcaggtgcggggttgacaatcatactcctttaaggcggagggatctacaggagggcggctgtactgtgcttcgccttatatagggcgacttggggcacgcagtagctctctcgagtcactccggcgcagtgttgggactgtctgggtatc

SEQ ID NO: 170 - DNA, 992 bp, Homo sapiens
ttcggtaatttcccaactagggtgcactccccctgtaaggggctggggaggggacggtgcgaaaccaagttcagcttgtggagcggagccagagctgttggccgagcttgggcctggccaacgcctgccctcgggaaggtcctgtgtagggagactgcctggagggactaagcgagggctctaactgacgtctcaggggcagcctctcagcctgagaccctgctggggaagccgcgtcctgtgcactagctgcgcctagggctgaggtgagggcgcaggctccccagggtgtgtccgaattgcccgcctcagcccgcggcctgtcctgaccgcccagcagcggcagcagcgacaccctagggctccaggaagggcttgggaaggtgtaaaggcggggctaggctcggagggagccggagggaccgggcgcggttggctcccgggagcaactggagagtgaggagatcctcatccggggaagccccgcggccgcgtctctacagcgccccttctcgggctctggccctcccgctggttattctggacctgggggcccccagctgggacccgagtccggtgcggggagcctagtgggcctgggagctgctatttttagcgggcgcggcgggcgcgaggagcctatttatagatcaaacaatccgcgctccctgcgtcaatggaaccccgcgtgcgtcacgcgcgcagacattccaggccccccctcctcgccccgccccctcgggctccccgggccgcacctccccctggccgcctcccgccggaaccgcaccgccccccgcgcccttgtatggccaaagctcgacgggcggcctgcgtcagtggcgcccccgcccctccccgtgcgtcacggagcgcttaagaggagggtcgggctcggccggggagtcccagtggcggaggctacgaaacttgggggagtgcacagaagaacttcgggagcgcacgcgggaccagggaccaggctgagactc

SEQ ID NO: 171 - DNA, 912 bp, Homo sapiens
aagagggcaaggcaggaagtaatattttatatgtgaaagtgtattctagtgtaacgtacaggagctctgacaaaagatgtgcagaattatagctttattatgagtcattctttgtatttataagtagaaaggtgatcatctttctcaagttaaaaaaataatgctgggggagatggtgtttgtgtgagtgaatagaaattcagacggtttaaatgtctcaaggcctgatactcttccccaacttccttaagaaactaactggcttgaaaaaagtcattctgcaaaagagggaaaaaaagttggatcttccagttgctgagaaggtatgtttacgcaatatgagcctaaagtgaacagttacccctgcacggattaccatacattcccgttttggagggaaaaaagtttgctagagaatgcaaaatggcgacctccagtgacgtcatacctgtctcggtcgcgtcctggggtgtctgtaagggcggaagcgggctacagccgcctcactgtgggcggtcgtggctaccatgcaaaaggaaaagtttcagtgtcgggcggatgtgtaccggcggtaatatagtaagggcggaagttctcctttaagggcggaagttctccttttaagggcggaagttctccttttaagggcggaaaggctttagccgcaaaatggcttcggcccctgtcgcgttacagtcacttccggggcggatcggaagttgctttgttttgcttcgagatggctgcggggatgtatttggaacattatctggacagtaagagcaggctggaggtgggggtcggggctgcagagtggtgcggggatcagggatgagaggatctgtagcccttaagttccagtgacgagaaggtcacaattatgaagcggttctgtggcaggaaatattggag

SEQ ID NO: 172 - DNA, 905 bp, Homo sapiens
gctgaattgaagcctcttggtaaacctatgatgtcccatttaatagatgggcaaactgaggctcaaagaaataaatcaggcacataaggagtccttgtccaagcaagccgtgggttgaagcctgggctctgccagtccaagtgaaaccaaagcatctccagaaattcctggtggtgtgttacatcagcaaatgagtaggcaatgtcattcctcaacctgaagtcattggcatcttgcagattccacgaaagaggaagtctgcccctggctccccgaggcctgcttgcaggaatgaggaaggggctgttctgctttcaggtggaaatgttcaccagctaagtgctgggctgcccagaaggcaaacagccccctgggcctgggacacatgctttagtgcccctggtagcatggcaggacatgcagtgcaactcaagaagctcccaaaaccatgagaggctgggaaaaatgctccctggcccagttctaatgtttcccaataaggagctgcccgggcagacacagggggccccacccatcctgagaggctgggcctgggctgcagacacaactgctcggagagtctgcatcctggctctgcagacaggctctagatgatgggctggcggagtgcccatgtggaggtgcacacaccgtgtttagtatgggcctgtacctgctgcagcgtcagctggtctgggcctgtgctcctggtccgcctatagatgccatgtggcccatctgaatctgtgactctgagtctggcctacccaggcctggtttgatcctaccccctggccacgccccttgtgggtttcctctgggtgacgtttccttcctgctcttgttgactaggcgctgttcttgctggctggtgccccagggcctggagaggtctgaagaaacct

SEQ ID NO: 173 - DNA, 960 bp, Homo sapiens
caacaccatcagaagagaggcttctctctaagtttcatttcccatctcctccaaatccgcatccctcccaaacgccggacctgtaaggccagcagggtccaagacacacatcctttgcccagcggggaagattaaagctaaagctcagagagggaaaacatttcctaagctcgcacagcgaatcaggacagaaaccaggacgagcctcggaatccctccattacctccactttcacctgagcatcacagcccgctcgggactcagtttccccacctacgtgaccacaccacactaatcagggtctccttttggagatctgctcttcttctcgaatgggggcgctgcaccatcggtagaacagggtaggtgggggcgccagaggtgaaggggacctgcaggctggggtcttccccgcccgggtcagcggggtccctgcggggctagtctaagcgcctattattaccagcccccggggcggcgttgcactgcgcaggcgcgggcggggcgcgggcgcgcgcgcgagcgagcgagggattccctctgacgtcattgctaggataccaaacaaacactccgccgcgccggccgagctccttatatggctaattgcgtcacaggaactccgggaaggcggggccgggatcccctcccgccgagtggcccggaacgcaacccccgagacccccagggccccgagggtcatgcaagtgaccagatcgagtctagaacagacctcttgctggacagtgcgggactcgatttggcggggccggagatttggggaagtttgtccagcaaggggcgggtgacgtaagcaggggggcgggtcccgggcatataaatacaggctggcgggtctgtgcttcattcataagactcagagctacggccacggcagggacacgcggaaccaagacttggaaacttgattgttgtggttcttcttgggggttatgaaa

SEQ ID NO: 174 - DNA, 904 bp, Homo sapiens
caagtacctgaaaggatgtatgcgagttaatgacatggaggtgaagagaggctcggaagggtattccaggtggagagaacggccagagcgaaggtttggaggctgaaaggcagcaacgtgcggatcctaaagaggcagggtcaggaatcgaactcaagacgctcacaatggaatccagggctgagtccatgcccgcccccacagggatcataattatgtaaaatagcatttttcccatatatggtacttaatatctgtccttgtggtgggatgacatgagactgagagcacagctcgcggggcggggtgtcagagttccagaccttcccagtcggctcccgcagggcctcgccccggcccaggcaaggcaccaaaaccccggcccggagctctccgcgccccgagtcgccgcctcctgattggattccccctgtgtcaatccttgtcctagaacctggctgtccgttggacccgccctagagggcggggctcccgcctaggaagcgcgggggaaggtggagcgggtggaggtggggcggaaagaggatgttgaatccccacccatctggccgcagaggctccgcccaccccctttccacaggccaatacgtctgcccatcaaggccaggcgcggcctgcagtgggtgtagcaggaagggggcgggattgtgccccaggctccgccccggagccggctcccggctgggaatggtcccgcggctccgagggcggggcgggaaggcggcgaggagccgagctgggtgcggtgaggcgcgcagatcaccgcggttcctgggcagggcacggaaggctaagcaaggctgacctgctgcagctcccgcctcgtgcgctcgccccacccggccgccgcccgagcgctcgagaaagtcctctcgggagaagc

SEQ ID NO: 175 - DNA, 2770 bp, Homo sapiens
aacgggaatgtgtgtatgaatcctccctggaatctggttacagtttatgctcccaatcagtaaggtcagagtggggcctgagcctctgcatttccaacaagctccctggtgatgctgatactcccagtccattgaccacactttggataggaagagtctacacttgctctactcaacttctctccattctgtcctcaaacacaccacgcttccttccccaccagctggagggggctctgctcccaggccccagaggtcaaggcagacacagttaaggtgtggaaacctccttattgcccgatggatcctccagagaggcggtcccttactttcagcagggcgcgtgtctacctgtttcatgctgtctcacacacagggtgccacccctgtgctgggcactgggtaagtgctctgtacatattaattaggagtactcatttcaaaaatatgtgtgcctttgataaataaaaacagtatgtgcatgttgtgttggtgtgtgcttccttgattattactgaagttaaacatgttttcatccatgtattgaccatttctctttgtccttcaatgaaacctctgctgatttccttcgctcatttttttcctgtgtcttcgtctgatgagtttctcttctttttgtttgttcgtttgtttgttttgagacagtctcgctcagtggcccggctggagtgcagtggtatgatctcagctcactgaaacctctgcctccaaggttcaagtgattctcctgtctcagcctcccgagtgtgccaccgcacccagctaatttttgtatttttagtagagacggggcttcaccgtgttgcccaggctggtctcaaactcctgacctcaactgatccgcccatctctgcctcccaaagtacagggattacaggcgtgaaccaccacaccccacctgtctgatgggtttctaagaacatcttaaaggacattacttccttctgacgtatcttttaccgagatccttcccagttttttgcttaaggttaatccattttttcctccacaaagtaaccttgtatatgtattggttttttctttgttgagttctcccactgttctgaggcttagaaagtcctttcatacccagacatcagagaaacagatcccgtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagtttcaaaactcccaaggaagcattctggttcactcgcttgggccactggccagagggatgggatactctgaaagattcagctagagtcccgggcccagccctggaccatcactgtgccccctggtgagatgccagggctgggattcagggagaagaaaggaggttcccggacagtcattcctgcctcccgcggctgcgggctccctgcccccatcctgtgcacgaagtgggagctcccgctgtctggcagctcccgctgtctggcagcagctgctctgcaggggacagtctggacggcagaaagttcatccttaaccccagccttccagtcaaggttcccaccagtttgggacacctgcaagtgtcacatcccactgggtgaaactctaagatcccttttaggggatcccattcgctccctcccttccgccaccatgcagcgccgagaaacagagctctgaacgaaccctcagatgtccgtgcgctggggcctttccaggacggcggcgcccagtcgtttctgggtcagggcgacgcctggaactgggcagggtccctggcaccgggatcccgaaaagcagacctgcttctccctgtccagccggttccccttccccttgcagtcggccccctgcatccgcgtcctccctgccagtcgagggtccccagctccaactccaccctcccagctgtgcgttcatagcgaccgccctccctgtagggacgcacggatctggtggtggagtcttggccggcaggactggacaggaaccgaaggggcgaggcgggtccgggggtggtgcgctccaattgggtgctgtccccagggggtggggcctgatcccctatttcccggcgcgccgggatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaaggtgggcccagcccgtttccccgcgtgtccacaaacccagtgcacccccaggcccccgccctgctctgccctgagcgtctcgccgcccgcacagccccctcacctcctcctgcagcgtctgccaccagagaatgctgtggactgagtggccttgaagggatcacagcctctctgaaccttagcttgccttctgaaaaggaggataacgttaccttctgctctgtagggatggaaagaaaatactgaatggagttgacagagttcttgcgtggaatgcacgcatataaattcacaaagcccagaagacctcgggaagaaggacatactgttgtgagaattaagagatgggaagagatgagccaccccagtttgcctcccctcccctggcccaccagagtccggctagaaaactt

SEQ ID NO: 176 - DNA, 2596 bp, Homo sapiens
tcaagatgccaaaacaccactaatggatctttaggtcttggcttacttcatccatttgttcacagatatttattaagcacctgccatttgtcctgctgaacaaatcaagcatgttccccgcagccattgtgtacagctaagcaggtgaatggcacccactggagttgcgtagtgcacaacttccactactgctggtggttcttgtcctcatggagattaaatttagtaacttctaggaagtctttctcgaatctctatcctcttgctcagactggaaaaagtgctcttattatgttttcttttctcttttctctttttttttttttgacacagggcctcactctgtcacttaggctggagtgcggtggcacgatcacagttcactgcagtccccacctcccaagcttaggtgatcctcctactgcagcctcccaagtagttggggccacaggtatgcaccaccacgacaggcaagctaatttttttgtattttttgtagagactgggttttgccgtgttgcccaggctggccttgaactcctgacctcaagtgatctgcccgtctcctgcctcagcctcctgagtagctgggattacaggaatgcaccaccacgcccggttaatttttgtatttttagtagagacggggtttctccatgttggtcaggctggtcttgaactcctgacctcaagtgatccgcctgccttggcctcccaaagtgctggaattacaggcgtgagccacggtgcctggcctctcctcacctgctttaattctttactcaaatgtcacctttttactttgaggtttacttttacctttggaggtttggagtagaggagggatactatctgtctaaaaagaaaaacaacatttagaaatataacagtatgggccgggcatggtggctcaggcctgtaatcccaggactgtgggaggccaagatgggcggatcacttgaggtcaggagttcgagaccagcctggctaacatggtgaaaccccgccccccacccgtctctactaaaaatacaaaaattttcccagggtggtggcgggtgcctgtaataacagctacttggggggctgaggcaggagaatcacttcagcctgggaggaggaggctgcagtgagccgagattgcgccactgcattccagcctgggcgacagagtcagactctgtctcaaaaaaaaaaaagaacggtatgagcaaagagtgagtaaggcagttatcagatgtctactttgccaggaatcaggctacagcaaataaaggtttatacataatattgataataaatgcccagctcttcccctgtaaaactccaatactctaagatttttttcatgaacaccgccccccgctgctccgacccctgcttttttatttatttatttatttatttggtagagatgaggtctcactatgttgaccaggctggtctcgaactcccagctcaagcgatcctcctgcttctgcttcctaaagtgctgggattacaccgcgctcggtcctgaacacacattttgtttgtttgtttgtttgtttacaaaacccctggagaacccgcgtattctaacctgggctggtttttgtatttttgcaaaataacaccccacacattctcgtatcagcgtgcagatttttttgcacccagtttggttgtttgcggccataagcttttctttaagcctttccaacccgtccttctagagaaagtgtcttcataaggaagtcacactgctcacgcctgtaatcccaacactttgggaggccgaggcgggtggatcactaggtccggagatcgagaccatcctggaaaacacagtgaaaccccgtctctactaaaaatacaaaaaattagccgggcgtagtggtgggtgcctgtagtcccagctactccgaaggctgaggcaggagaatggcgtgaacccgggaggcggaatttgcagtgggccgagatcgcgccactgcactccagcctgggcgacagagtgagactccgtctcaaaaaaaaaaaaaaaataaataaataaaaaataaataaaaggaagtgacactggataattaagagacacaccattgcgcctttaacacatattcacacccagcactgtcacatccatcgtgccttgaggacaggcataaatttacggccttcctcctgcgctcccggcctgctcctagcctttgactagagcctgcgcagcatcccagtcccaggctagggcccaccggtgccgcgcagcctcctggaagctgtggggagtagcgttcctccgctccagaactacaactcccagcaggccttgctcctctccacctccctcgcagcgcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaac

SEQ ID NO: 177 - DNA, 2577 bp, Homo sapiens
gcttttctcccaaattagcctgtacatattcacacatcagtacacactgatctcatttaagaaaattggtgcatacctttgtatgcttttaccataatttaagaagaagctgactactttttttaagtcagaaatactgggaaggggaagagcatggtggtggtgcacgcctgtaatcccagaactttgggaggtcaaggcgggcggattgcttgagctcaagagtaggagaccagcgtcggtaacatgatgaaaccccgtttctacaaaaattagccaggcgtggtggtgcgcacccgtagtcccagctatttaggaggctgaggtgggaggatggcttgagcccaggagagaaggttgcagtcagccgagatggcgccactgcactccagcctgggcgacaggccctgtctcggaaaaaaaaaaaaaaatactgcgaaggtaaaataaacatatatttaacatattatatatttgaaacagccattgtcacagtggataacagtcacaggtgtataatagtgaaagttcgttaaattaatatttcttcgtgtttgttgactcgtacaacccattagtgttttgattggttgcatttgtcttttcattcataactgctgaaaactttctccctaactaacctgaggaagtggtaaaagtcaaacttttttccggtatgaggccacccttggtgctgtctgtaattatctagacatggcagccaggatccaacagctttgcgttttaactcatatggtctttcctggcgaattccttgcccccctctgctccccacttagcttgacttcctgtcttttatcatccgcaatctatcaagatcctacaatgtgctcagtgtagggcggaacaaatcactgttttacctcacaatttaaggaaggcagggggctagtttttaagataaaaatcttttaacaaaacataaactccccaaaatttcctacaagccaaacagcattgtcacaccctcacaagctcttattacttacacagccaaatgactcaagattactaacgtttctattcataaggagtttgctggcctcagatcaacacaatcaagccctcccccaccttccttctctctcccctgggagactgacgtttggaactcacgccgcaccaggttttttcagaatgaagacgatgtgtgttcgctgctggaactgtttgtcctgggattttataaacacctcccccactcctttttaaagttctgtttttgaggtgggggaaaaggaggtcggaatctgtttagcctttaaatctcccaattcagaaatatattctaagaatttaatagaaaaagaccaagggctgtgtctgctatttactgcagaactgggtattcctatcagaaatcacctacatgtgtcaccaagatcagagacaaggatgagggaaacagcatgatccctgccttctggagggttacagttgaagcttccgctgcttctgcacttgacctcaaaacaaacaaaaaacccaccgcaaacaacaacaaaaaaatccaggcccacctttccccttggatctttcacttgacagctttctcggcccaaaataaggcaccctacatctgaatgcatccctaaggccttaccgcacccagtccaggaggcagtcctggcagctgccctccaccgaactccgcgctttttcacacacgctcgtggaaggagaaaaccgctcaaacaactggactcggcccgtttcctttcggtaacctccccacagcccaacacgctgtccccagacgctgcccgctcccaccccggtcccttcgtgatcctcccgcgcgcgggcggggcgggggaggagcgcgggggcggccgggaggggcgcggccgggagggggcgccgccggggcgcgagccagacacagagggccgcggaggacgcgggaggcgagcggggagccgaggtcgtgctaggatcccgcgcccaggggccttcgtcgagggaggggcgtggcggcggcagcaggagggcagcaggagctgtcaggctggcggttccgcgccgcggctccttctgcgctgcgcccgcaactctgggctgagaacttctcccgccggcccactcgccctcgccccgcgcactcggcgccaggcgactcccgcaccttgtacccggcccgccccgcctcctccttcggccgcaccactccccctgccggccgcgcttctctccgttacaaaggagggaaaatgagccgggcggcggcggcgcggcgcggggccaccacggcggcggcgagcgcggccgcccccggcaccacgtaaaccgcccccgcccgcccagctgcggcccaggccggagcggagcctgccgtcctccgcctgcctgctgctcgcctccctagacctgcgcgtcgcttcccggcccgccgaggaggtggtggaggaggaggcgccgctttccccgcggcgcgcgccctcgccgttgtctgagctgtgcctggaccagtttggggaagttgtcggggctccgcgtcgcccagatgtgtgacctcattgagccgcagccggccgagaagatcggcaagatgaagaa

SEQ ID NO: 178 - DNA, 2565 bp, Homo sapiens
ggagaataaccgttcatcactgcagccatgaatctgccacactgaatagatatggtctgaaaatctaggaacaaatggaatcactttggaaacctgtaaattttaaagccgaaagggcgctccagggaaccaactacatgaagttctctggaagccacaggatgggaggtttggtgggggtggaggtgaccattgaattttacataggcaaatgtaagacaatcttatccatagacagaaaaatccaaactcaccgagagtaaaaggatgacagttgaaataacagctaattgttattaagtatttgctaagttccaaagcacttttcatagattagctcaattaattctcacaacagccctgtaaggtagggaccatgatcatctccagaagaggctaaataaattgccaaagatcacatatgtagcaagtggtggcagagtgaggattcatacctggacagcttaactttaaagccatggtgctaatgcattcattcattcatccatccattcattcatccatccattcattcaatgattatattggatgcctactacatgctaagaactatgttcaaggtgctgaactacagctgtgaacaatgcaagtacaaatacatgaagcagagttggggagaaagtaagctggagaaataagacataaactaggttagatggtgaacatgattaaggaaaaaactagagcagggaggaaagagaaatgtgcagggggaaggtcaattctgagtgagccaacaggcaaggtctcactaagaaagcggcattaaataaagatttgaggaagtgagggagtaaaccttgcagctatctaaaaggagagcatgagaggtagaggagacagcaaatacaaagaccctgaagcaggggcaaggctaatgagttctagaattagcaaggagtccagtgtaacttgaacagagtgatcaaagaacagagcaggaggaaatgaggtcagagaggtaaacaggctggagtgcagtggcaccgtctcggctcactgcaacctccacctcccgggttcaagcgattctcctgcctcagtctccctagtagctgggattacaggcatgcaccaccacacccggctaatttttgtatttttagtaaagacggtgtttcaccatgttggccaggctggtcttgaactcctgacctcaagtgatccacccgcctcaacctcccaaagtgctgggattacaggcgtgagccaccgcgcccggccaggattcttttaatcaagtatgatgcagccatcagggttggagcattctaggaagagggaacagcatgcaccaaggcaacaggaaagcacataaaaaaggagttgctggaagattcatttcaacccactatcaagtaaatattaaacttactgtataaaaatgttagggccaggaggggtggctcacgcctgtaaacccggcactttgagaggccgaggcaggaggatcggttgaacccaggagttcgagaccagcctgaccaacagggcgaaaccccgtctctactaaaaatacaaaaactagccgggcgtggtggtgggcgcctgtaatcccagcttctcgggaggctgaggcaggagaattgcttgaacctgggaggcggaggttgcagtgagctgagatcacgccctgcactccagcctgggcgacagagggagacttggtcatgctccctccccgccctccgtcagttttaggaataaatacctttttatttaagctaaagtgtgggtacacccttcctctaggattctccatcaaggaataagaagccatattaggacaatttagagggcagttaaccctagtagacatagtggttcttaaaaggcttggggcctcagactgtacacaggcttcacatggaatctgatttgttcctttatcccagtccctcacccagaacccgaatctagcccttcatgttataaaaagggccagaggtccaaagagggtaagtgccttgtgcaaaattattcaactactttgtagaggattttaactagggttcagttagctccgcccacactataaaaggctctttctaaaaaacgaaacatgattaagggcacacggctccagcgttaacaaagctctttgttagctgggaaatgcccccctccccgactcatctgcttatcatctgcatagaattatgtactcaaaagcaggaaaattattgagaaaaccattggtccccggctgcagaccccaaggttgggagctggttcccgtttcctcccagagccggcagggggggcaccaggcaaagtttgcaagacgcgcctccctcccacccctcccccttcctcgcccaacttcccatagccgcggcctcaactaaaagtggccattgacctttcaagctttcgagcagtgatgcaatagaatagtatttcaaagaaaaatgcttatcgaaattttggatccggttttcccgtgattgttaagggtttcttttaaaaagtaggtcacatttcaagtaggtcatatttcgggggcgggtgcgcagacaaggagatgagtttccactaaggcca

SEQ ID NO: 179 - DNA, 2544 bp, Homo sapiens
cgttttacattcccaccagtgatggccgagagttcctgttgctccatgtcctcaccagcatttgctggtgctgtcaacattttggatttgggccattctaaagagtatgaagtggtcattttatcttttatctttttttctgtttctctctgtgtgtgtgtgtgtgtttaatttaaacttaatagcattgaccaatgtgttgtatgcatttacactatagcatgttatatttttgttctgatcatattccttttcacttttccattctttttcttttttctttctttcttttttttttttttttttggaaacggagtctcgctctgttgcccaggctgtacagtggtgcagtctcggctcactgcaacctctgcctcctaggttcaagcaattctcctgcctcagcctcccgaatagctgggactacagtgtgcagcacctcaccccgctaattttgtatttttagtagagacggggtttcaccatgttgtggcctcttccctccttccaagtccaggcagatgctccctctttcccgaactcatcccctacaccccatcacagggacttcctcccgccttgggggtctcagcccattttgtcctgatgacccacatggtgggtcatggttcctgcctgagcctgtgtcccctgtggcccacgagggtggacacggccttctccagttctgaatccctcgttgtccacctgcgcccttgccacggcctctcccgtgggctctcaccatgtgctgggttaaatggggttgaatatagaccatctaaggggctgaagctgctgcttctgtgtgtttggggtgggattaggatgggctcgggcttcctaagtagtgactgtgactccactgggtgacctggctcctgctgcctctcatagcagagcgggggtccccttcttccttgctgggcacagggcacacctctgggtgggagacaggggcctttttcaccagctcccacctgccctctgagaaaagttatgaacacgagcaaaatggaagcactgacatttggcagcagcttcctccccaggcgtctgagccgccagaggcaaacagggagggcgcggggctgggtcgggagagggtgagtaagctagtggccggaggccgtgctcaaccccagatcgggcttttccggtcgagtttcaggcacagtcatgagatttcagattgtgagtgggaacttcaggaccccctgacttcaacggcagaagcggtctcctgcttcacccacaccctcaagtctggtctgccccttaccggccataggtcctgctctcccgtggcctagaagcctcacctgcctcctgcctcctccccaggccaggcaggttgtgatgatgagggattgagaggctcacagctggggatttccctgcccatcaggcgccagctgcggccgcgtcagcagagacttcctgctctgtcccagctgtgtcttgtccacatctcgccccggggagcaggtgtgcagttcctgagtgacgcgagacacacacggccatcctgactcactccacccacttcacagctgcagcctgggccaggagagagggcaccgattccttctatgacgccctggccttggagaagggcaacctgggcagttgctgggagaatacattgagatgacaaaagcaatcatagctaagagctgacattgtttattgagttcttgccgtgccctgggccttgttctggccctttctacttgtacttgttgaagccccacgataaccttgcaaagtgggtttatgaagcacgtttcacagatgaggagactgaggctcggagaaatgacctgctaaggtcattcagccaggaaggggtgaggctgacactaagggccatgatgcgtgactgctggtggacagcattaaatggggacttccgtccccgagagacctgatcccaggaaccgacttttgagaacaagtgccgagtcttggggctggccaccctgaggtcaaccaggctaggcctgggctgcggtcttccctcccaggggacagagcagagcgcttgactcttcactaggccctcccacctctgtgatctctttggctcttcacggctcccttggaaagtagatgttatcattcccatttcctagttggaaaaataggcctgagatgggcagtccctgcccagcatggaatgccagagagggaggagttggacccacaacttcgatcttggcacctgcggcctcccctgccttttctccggtggggatgaggctgctgtgtgggtgtgggggtgactcacacgggccacgtgggtgggcgggtgctgcagctgtggctggtgggcgtggcctgcctggcgccgagggcaggtggctcagccagttctgcctctgacgcctcattccagccatccctctgcctgcaatgagagcttcccgccgcctcagccacagtcccacccgggggccttgggccccagacatgcggtgatctcagggcaagggttgccacgaccacccagaacctcaccaggtgagtcttctgtgcacaagg

SEQ ID NO: 180 - DNA, 2519 bp, Homo sapiens
taataaggtgcaggggagcagtaaaccgagacaagtccacttaatgaacgggtgtccttatttttattgtttgaaatgatatccaaagggattgcagataattagtttgtgttcttatgaatgataggctaaggagattcaaaacactgcttgggccctgcctggttggttccagagagaaggttttcagtggtttctgcttccctggctttattctgaaggtccttctcttccattcagttcttactgcaatcggaggggacatagctgatggctctgtagttccatttgagagcacttaaagatattctccaaagaaacactctctgacattctgtgcacagatgtagagcagctcggggctgagctgtggctgtgggccaggcagtctgagttggagagacaaacaaattagacaccagtcgcctctcagcccagcttttctcccttcagtaacacctgtggagtttatgagttcctctagggaaaatcggagaaatctacatgagaatgatgtcttgtttcctgctgggaggaccgtcaaagagtttataggagaccatcctgcagtctcaatgcgtttattgccgtgtcatatattgggggctgactattgccacattactggagcaccccattcccatccttcctcagctgttgaaagtgagacaggttgaggacgcagtccggagagtgttgcttttttcaagtcttgttttctcaaactttggactcaccagaagtaagtcaccatgcttctgtgttggctggggaattcttccagttagaatttagttgtagggaagttagaagaggagggagcatgggtcagtgatgtctggaatttggggtgttctagtgagatttggggtggggtcatgtccctgtggctggccagggtagtggccctgaagggccaggttggcagggcttctaggagaaggccatctcccagaaggagatggaaccccaggtgggagggtatgtggtgtgttttggatgtgattcagaatggaggcagtgaggcagaaagggaagggaaagggaggccgggcaggaagccagggttggggttttgctcttatagacttgactccagaccatggcccttccttctctgccatggatccttctggaggagagggtatcacaccgcttgaggctctgtgcacaggcgggttctgtgggcatccgcgagtgagtggatggcaagtgagaggggggccatggggatcggaacacttggcatcgtgacctctcagctctctcttcagacccccatgcactactcttctctatgacagtgagaccaccactgcctccgactctttccaaagcccgaggtcagctaggctcctcgtgctactcaccctgcacagaggcagtctttagtcctctttgagtcttggtctattgcagtatcctcctagaagccttccttaggaagccgcaggaatctcaaacacagcctcatcagccctgcctaactcctttggtggcttgacgtggttaatttcaaacaccttagcagggcttaggctgaacgggcccctcgttgccctcctaccccctgtccctgcatacacctcatgctggaaggacctgtgttgcccaggcacacaataggtgtctcgcccttgggtcaagccgatgccttgtatacgttctgcctggaaagccccttcttttcagacagcaaacctgtactcaactttgatgactgagccttccatgaggcccgccaagactgacctgatagaattttccattcccttctctgtttccctccaggccttcttgcccccatctcttctattttgcattacactgctgacctgcacttcctgtgtctcggtgaggttcttcagggcaggaactgtgtctagttcagtttcacccttagcaacaagtggtaatgaaatatttctgccaaggatccaattcagattatgtaagcatttacctttgtttaaggcaaaatcctgattctggaagaggaaagttctttgcttctcacagggcaggcatagaacaggccagaagctgtccatgtgtggcttgggagagacctggctatctgtacttgagccctgagaccccgaaggcccccggctgcatctgctcttggagcttggggtggcctgggtggtggtcgagtaggatctgcagcgtgggatcatcggcagagtcaatgccattcccttgcagatccactctcccgtaagaaactgttctgggctctgagaggaacgaggggaagaggggagatgggtgagcttccttgctgcatttagcaactcagtccctgggggaggtgtagacactgacacactccctgtggccccagggagaacaaacccagagcccagtgagggtgcagtatgagcaaagtgctggggcggggggagggcagaagagggagcagttgattttggcttaagagtaaactgaagagagaacagacacggggcggctgagcagcagtgtgttcatggagaaagaatcaaagcgcacatctt

SEQ ID NO: 181 - DNA, 2498 bp, Homo sapiens
tcctaacgtaactccacaaagccatagtataacgttataatagtaaatagcataaccttataataaatagtttcgccttattgaggtaggtagtaagtgtgctttaggtagatttggttggtgcaaatgtaattgtggtttttgccaccgaaagaaatggcaaaaccccaatgacttttgcaccaacctaaatatcatctcatttacatatgtaataaatactcaatatttgctttaattaaaataggggtagacaagtgaattatatttagaggttctaggtgactgaaattttcacaggggcagaaacccaaaatatgtatgtgcagttaattttttctgtctcttctgtgttgggccatcttttttttctctttttttttgagatggagtctcactctatcgcccaggctgtagtgcagtggcgtgatctcagctcactgcagcctccgcctcccgggttcaagcaattctcctgcctcagcctcccgagtagctgggactacaggcaactgccaccatgctcagctagttttttaatatttttagtagagatggggtttcaccatgttggccaggctggtctggaactcctgacctcaagtgatccgcccacctcggcctcccaaagcgctgagattacaggcctgagccactgcgcccggcctttctcttctttttcatgatatactactggatttgtctgtgcttgtaattattttagctgtttattagtttattacaaaaaaatggtactgtacctttatgggaataattagcacctatgtgaatatttaagttaccgattttggcaaatgtgaagtccaagttgtcttgttttgtttacgtttatatcctctctcccttcttgagaagacatattttcatttaaaataaacccacttggccgggcgcggtggctcacgcctgtaatcccagcactttggaaggccgaggcgggtggatcacgaggtcaggagatcgagactattagccgggcgcggtggcgggcgcctgtagtcccagctaccccagggaggctgaggcaggagaatggcgtgaacccgggaggcggagcttgcagtgagccgagatcgcgccactgcactccagcctgggcgacagagagagattccgtctctaaatacatacatacatacatacatacatacataataaataaaataaaataaacccactcacccccaccccgactccccagctgtagcagggaaggattaagaaggcggggtggggggtgggggaagccctgttaggtagtgctgcgttgggcccacttctgagggtttaatcctagtagggtctttggagttctttcttcggaggcgcgtagctctgcattatttaaaactgtttcccgcaaacccgcaatcccttaggccaaaggcacccctaacgcggaaagtctacgaacggaaatgtccggagttagagagcggcctttcgggcagctgccccgacttctccaaggccggagggccggctgggagcgctgcaagccagagagggcgatcccagcgggacccgcggcctgaggataggcctggagctgccgcctccgccaggcgacgggaaaccctcggaagtgggtttccgcgcgaaagtagcattgcggccaggcgggaaacgtgttcgcgaagcaggagggcccccggggcctttcccgggcgacccgacccgccaggccgcgtggcgggagctttcctgttgagcgcggtggagcgcacacatttccttcagttctttctcggaagtttaggccgcacccacccgcgccccctttccaggattatacaagtgcacgccagggtttcttatttttggtgtgtttttgagaccaaagaaccatatccgctaagcctgaggaggcacccgccccctcagctctgaaacgaggcctcaaaacggcaaccgatgtggtagccgcgcaatcttccgaaacccaaaggctagagggcgtgcccagtggccaggtgcaggcggtggggcaagtaacggcttttggtagccccgcccctccgacccgccctctccgcgcctgcccattttcgttccctcgggtctgtaaccctctcccgggccgcttcctctttaaggcggagcccggcgtggatctcgcgagatccggcttggcgccgtgacctccatgtgggagctccagctctataagtaaacactctgcgcggcgcagacatggcctcttcctatctttgaggcggtgtctgcggcagcgcctcagagtggttccggtcgtctctcctcaagtcggctagtcgggcgcgcgcgctgagagtcgtcgccgcctgtcgggcccggcgtccggtcggtccggtgggcgcgctcgcccgcctgccgctgagggcccgagccgcagggaaagcggcgcgggccgggcggggcgcggcgcccagagctcagggggagacaaaggggaccggttcctctctaggcgccaagatgtggatacaggttcgcac

SEQ ID NO: 182 - DNA, 2396 bp, Homo sapiens
gtcagtgtgtttcctgaccctctggtggggccactctttgcggggccctggggcttcactgggaggagccaagtggggcgtcagtgtgtgctacagtggctggggcagtgccccgcagaggcaggtgcgtgcccacagccgtcagcctttcttctggctgcagggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacggtgggcccccgcgctgcccgcttccctggtctccagtccttgcatggcagaggcctctctcacacacatctgctcattcacgcactcagcagatacgtattgagctccagcccagtgttgcgcaggacacagggggccccgaggttccctgggttactgtgggcagtgcccctccccaccttccgtttcctgcgaggagggaacatccatagagggacccggatgctgtgccctgtgctccccacataggttcaccattgtcatagctaggagtgtcatttgagccaggggccacaccagtggggtggcggggtggccagccacattaggaaacttctgtgggggcccaccttcctcctgccctcgctgtgggattaagttagaccagtaggacacgcagcaacatccaggcacaaggaaaattccatggaaggtgaaagaagcaaagagcaagagaaagacagagtttgctgtttgcctgggatcccacagctggtcaaaggcagagccaggctgggagccgctgtccccagttcaggtctgcagggtgggtgaggacgtctttctcgccacactgcccactctccagtccagacaccctcagactctgcgagtgccaccctgtaacagtgaggggaacacgaggggcctggcctcacctccagcctgcaggggagacaggtgtaaacccacatcccgtggtggggccacgagaactcaggtctggggggcactgcggggagatttggtgatgctgagctgattcgaatgaggtgagaaggagcccagcagctgtgtgggggcgtgtcgctggcagaggggaataaaggtgctgaggtgagggtgacagcatcgcccagggctgactggcactgggagctgtgggcttcactccctcttcctgggtgcacgcttgtgctccaaagccaacctctccctgcctctctagggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaatgcaaaagtctacagattcaaatgttagtctcatgcaacccctccccacccctgccagaaacagaataatgtttgaccaaacactcaggcaccctgtagcccagtcaagtggacacatacaatcacccattcca

SEQ ID NO: 183 - DNA, 2242 bp, Homo sapiens
cacagctcactgctgggattacaggcatgagccacagcgctcaaccattctagatattaaataatttcatgtagttaccccaaatacagattatgttctgtcatgtctgactaaaataaaaatttagcttaaggaaactcctttctgcagacattatttgttctagctctgagattgtatctccatgctgcttactttaggttgcaatatgttcccaacacccacctttcaagtttttaaaatggcatttcaattttttcttcagtttgtatgctcagccacctgtgcgcttcctctacttttctaaagtgaagaaaaggaaaaaaaaatggtttctttctaatataatattaataggtctgggtttttggattaatatactgtaataagcagctctctaattgattacaaatcccactggaacactcccctgggggaatgaaggtcctgttctttttactcttccttttatcctctattccatttcagctgagaatccaccaaactaggattgagtcgaccagtgaaaggattctaggcaagacgggattgcactgatgagttccactgcctccttttcagagagacaaacgtaagcccacagactgattactaaggcaggtgtatttttatctgtgctgccttcttattcaagactctaagctagtcatcaacccaatggtataactgatagctgacgggagtttctggaatgggtgttaagtgtgagagagatgaaggcctagtgataaggtcggctctaaatgtagatttacttggattccaatctacttaccagctgtgtgcccctgggcaagttacctcttctgtgactcaacttccttgaaggagggtgtgtaaaagtgtctatttcacacggttattgtgaggattaaataccaaaagtattaaagctgtggttaaactctcagtaaacattagttatttctaccaaagttaaactgccaaatccttgagtcttgatttgtcctcataactgctgtggcatttctcctcttttaaagtcttctgaacagaagttgacgtttgcattttaaaggaactcaaatggcttacttttacgaagttggggggattatatatacacgtgacccgccagggtatgtaaacctggcggacttcaacagtctgggggtgcctgcgctcaaggggtgaagggatgcttagaaactttctcaggaagaaggtggggccttcaacgagggcggctggctacaaagaactaaactttcacacagcaaaggggagccggtctccctgcgcccgcgggcgtcgaacccaggcccagctctcaccacccaaaggcccgggtgcggctgcagggtgacgaaagcgtcagaccccggggctgctctcagctttgggctttcacccggcactctcccagacaaaggggcttctcagccaggtcgctgttttggtttgtcgtcctcccagcccccaccttcgtccccaacttcccctggcgctggctcggcggcgtccctcacatcgtccctccggccgccaccccgggcccctttgttgtctgccgtctctcccagagaggggtggggggccgcgacattccagggaggagaaaccgaggagtgaggggcaaagacgctcttccatgctctcacccgaggagcgcgccccacgacgctggccagccgttctccggcgacggcccgggccgcgcctcggcgccctcgcccgggtcctcggcacgggggaggggcgtggcgcggccggcgctctctgattggctgcgggcgtcagggcgtcgcgccgcgattgggtcgcgcagctgtctggagcgagagcgcgcgaggtggggagggggccgctggaagctgctggaagtcgggggcgggggatgcggctggggcgccggggcggggacgacgggggcgacggcaggacgggccgcgcctgtgcagggcggtcgggggcggcgggcgcgggaggaggtggcggcggagggggaggtgcgagccgggcaccgcccccggcccctccccggccttccccgcgcagagctccgaccgcgggcggcccaggggcgggcgcgccgctgcatccccatcctcgtcgtcgcccggcacagcgcgagcgggcgagcggcgcgggcggccggagcgccgaggcccggccatggccaccaccagcaccacgggctccaccctgctgcagcccctcagcaacgccgtgcagctgcccatcgaccaggtaccccgag

SEQ ID NO: 184 - DNA, 2241 bp, Homo sapiens
gccctaaaatgtaaggactgcaagcgctatatcttattgatatttgaaagaaaggttatgtatgttttaagggtgttgataataatgtgttcaataaaataagtatgagccataaaatatcaagctaatttggaagcttcttatgctttgcacacaaaggatgtactatcatgattttatgaactctaaggactttagttctaggatgaaccttagaatatatttaaaacgatccccttaatttatcaatgaatctgaggaccacagctattgtctcacatttagtggcaatggtgagacttgaaactaggactcaggcttaatctcttttctccacacctcaggacttctccctttgtaagcaggagtgaggtccatgctctggctttccaaacaaggaaaagggcatatgagtagttcagtgttctgaactacgtatggcaatcagtaggcatttatcaagcaccattttcgttgttttggatgttttttgtagagatacaaaacaaaaaataaccttctttcatgaaggtataatatgcaggttagcgggactacctagccgtccatactgaatgggtttggaaatcccaactcttttctctacctgctctgtgataccaggcaagttaaagtcttgtgtgcctcagtttcctacctcaccgtgttatggtgattaaattaatatatatgtggagtacttgacacacagtcaagcctgcgattactgctgttcatggttttattttctctactagacaccagtaaggcacccccagaactcgctgtgttaagtagattctggttggatatagaaacacaggcaccccaggcggaatgcagatacgcctcaacatgtggattaagtaagagccaggaagcagagtaatgaagcaaaaataagacgtccagagtcaccttttaagaaaatgtgggttggtggttgcttaagaggggaggagacaatttagatgggatgtatggcgtgagcaaagggcaagaatgagcacggtgtaggcacaagtccatggaactgcttggctggatcgggatttttttgtcatagagtgttaagaaatagtcgatcagttgaggagtagaggagtgaagaccttggaaagttgccaaaagcctcgagaatttctctacatgtgtgacatgttctcaggactcaactttttcttttaggtttggaagacccgcagtaagtgtgctttagaattaaatgggtgggaaggggagctaggcaaaacacctcgcacttagcactaaataaagttcgctgttgccctaagagactgaaaaggttactttaacaaagggggcggggttaacttaacgtagatgtttaactcgtatacagatgaacattccagttgatcactctgaagctttttggctaaagcgtttgggtttagagcttccattactcattcgccttgcccaaggcctcagcaaccgacgttcgaaagccaggagaaaaggcgaatgataaagggcgctccacgcatgcgttaagaagccgccccaactcccccgcggcgttctttcttggaacaaaactagcgcggagccacggaactccgcagtttgcgtagacttgaatttcctattcctcggacgatccatgtggaatccgtgagtagtgcgactcctttacgcaactggcgttatccgaagtgaatagctaggtggcgcgtgtacgcccatagcgtagcacccataggcggacggggtgcggctgcgcagggagctgagtggaccttgtacgccgcaagcgtagcagggtgtcagacgcgccggtttctgcgacgcagttagcgcagtctgctttggtgaatacacgatttggtgcagccggggtttggtaccgagcggagaggagatgcacacggcactcgagtgtgaggtaactataaaaccccgatttgtttacattccctcccccagaaccggccccgtgcgcggcggagactgcgagtcccgggacggcgtgggggtagaaagggagaacagaaccggggagtcggggctggttccctcggggatgcgggcgctggggttcccgcagctgctgcagtcggcggcggccagccgaagcagagcgcgtggtgggcagagtgttgggcgccgcggctcctcgtgtgcggtctgggctgctgcgggccgcgggatcgggagccggcggcatccacttcgcgtgcggagcctcgcgcccccctcaccttcctgtggaggttg

SEQ ID NO: 185 - DNA, 2212 bp, Homo sapiens
tcagacttttctggaactcctgggctcaagcaatcctcccacctctgcctctgaagtagctgggactacaggtacttgccaccaggcctggctagctttcatcttttttgtagagatgggacatcactatgttgtgaaggctggtctcaaactcctggactcaagagaggcttctgcattggcctcccaaagtgctgggattacaggtgtaagccactctacctggacacaacattttatttgaaataagaaaaattttccctcactgggaatgctgcagttgaactagttcaaatccataaagaatggaagactgcccagtggtcattcattcacttattaattctagatgttaaattttctagggtgggggaatgtgctcctacattcaaggcattcttgaatgtagccaaactttgtagtttagccaaacttcatagctaatagccaaactttgtagtttagccaaactcttctagcagcaaaacccatgacactggaactctgttcttcacactggtcatttgtaatagaataacagagctttagcactagataggttctgaaagatcattgaatctaatcctctccctttgccagtgagaattctgaagcccagatttgttgatttgtgatcgatagtgtcaaagacaggcctgaaacacagatgtcctgggtcctagaggtgctgtttgcccctctccatatttcttttgttccagaaaacccttctccaaaactggccctaataatcagaggggaaagccatggcccctgccttggggacagcatgggttggcacagaaaagaggtttacaattcagcaggaagtgttgtgcgtgcgcgcgtgtgtgtctgtggaggcgcagggagggtcacctgagcttgccctgggtctggtcctgggctcagtggcaaattcaacgctgggcaggtggcctgaggacaatgacggtgccagctgtgagtcagacttcctttattcataaaatcatgttcctccatgcagtgcttctcaacctggctgcacgtcaggagccacctgggtagctttgtaaaaaccccaatgcccagttggtttgcaccccctgagattctgattaaactgttctggagtccatctctctctttttattatctatctatttatttattttttaatttggcggctcctctgggacttctcatatgcagtaggggttgagaattgctggtttctttggccagatgggaacatgcaggccaatagttacgcacaaacagagcagcagagcaggacggtgctaaggttggaaagggtgagtcatgaaagttcaggaaatcagaataggaaggggtgagaatcctctcatctgggcttgtggggcaggagagaagagcccagtgggcaaggtccagtgagtgtgcttagaactgggaagatgaggggaagggtaagcgctgggcggcggtgggcaagatggacgagattaaacgggagcgaggatttcagcgagagctttggcgacacggaaggctgagaatcggagggagcctgtcgggcgaaagcgaaggcggctgctgggcaggcagccgaatccggctggagagccgagctggtgagacctacaggaagtgaagggagtcgctcagggcgtggcgcaacgagactcttagaagaaactctgaggcagagatggggggcctccgcccatacggagacacaaggaagtccacatgcacacgcacgagcgcgcacatgaacacgcacaagcacacaaacgcctcctccgggcagggcacacgcgcccgctgcacaggccgaggccctggactcggaggggactgcagagccgacccacaacccgggccccgatgcccctcccggccgcgcccctacgactgcttgcgcaacaggcggcggctccagtgggcgcccgccgcgcgctgccggagcccagcccagcccggcgcgcccgggaggagggagcagggagcggggaaggggtgtgtcccggctgcgtgctgggactgcgagggtctgggaggggcgaggcgcgggggcggggccgcggcgcctataaagtcgccctccgcccggacgtaaacaaacctcgcctggctcccagctggtgctgaagctcgtcagttcaccatccgccctcggcttccgcggggcgctgggccgccagcctcggcaccgtcctttcctttctccctcgcgttaggtaag

SEQ ID NO: 186 - DNA, 2192 bp, Homo sapiens
tcagaaacatagcaagccagacatcacgcttcctttcccttgtgtaaggacagtctccctcctggacaggagacacggattgttgtgggggaaggacagacagtaacccatgtggcatgcccagtgacctccctaagaacaggggagctgtgtgatggtggtgaggggataggctcggggattcccctcgcacctgtcacgccatccacgctgtcacaccggcggctccagcctgggctcttcagggaaacaagggctctcctcctcccacttccaagagggaaggggcctcctcttctgtctgaggtgctcctccctcagggctggctgcaggagggctgaggcgggaggatccctggagcagttgtcatctgccctttcttgagggccagctgtgtgccaggccaggcaggggaggctctgatcacccccacacacaaggaactcaacatctggtgactgaggacaagcgtcacagtcccttccctgtaagggctcatagcctaagtgggggatcgaagtacctaaaaacctggtatgacaggcgccgtggggtggggggtgccttctacttgggatttgtgcagtgaattttggtgttacatagttttggaactgttgtacgggtccttgctatttttggcaaatgatgctggtctttcatttacagaggggctgcgtgcaaagtctcctttgaaaaatttatgtgagcaaggaaaaggggagaggatctcaaagactgggttacgtagatcacgttccagggggtgcgcgacggcccacttgggcagggggcccagatgtgggagcagctggctcagggcctcgctggcatttctcagagtcttaatgttggttttctgttcggtgagcaggaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgat

SEQ ID NO: 187 - DNA, 2135 bp, Homo sapiens
gccttgaatttgtgcacttctctgttccttatctgagcggtgcctttctgtagtttgtcttggagtacgtgtgtgtgcgtgcgcccctgtaagcgctgcctggggaggacagatgggagattaggggagacactccccctgtcctcgagggggacagtggctgggaaagatagggtttaggttggaatttcagtaagaaggtactaattacaacgtgcttggttggaagttggtgccaggccagggcttggagagaccatgggaaaatcacctgtctccctgccttctccctgagttagtttgccacagaagatccaacagccagactggtttgcaccgacggttcccaaatgcatggactggcactctgggctgttacacccgccacagctgctcggagaacttgtctccttgcttcgggggagggtcgacattttaattaaactaaaaaagaatgtttttctgaatcttagggcatacagccacttttaccatttttatttgaatttgagttcaggtaaacttaggcaaatagaaaagtgggagagggtgggaagagacaaggtgagcctgcttttcccaatactgggaaaatgaattaaactagacgggggacgtcagagaacagaatgccttgcctttggtctgctttttaatatattttatgatcccaaattttacagaaagtctcaagggtttctgtgttttttaaatggtcaaatatgtgacatacatgtgtacatagatcacagagccccactgtagttttttaaatgagccacatttaccttggggaagagcccctccccccccgccatcataatattgtgaatgtaaagagagattggttcacaatgagaatgtacagtaggctcctataagggtgacaggattatatgcagaatgactttgaagagccaaaattgatttatttatgttaagtagtgctaagaaggaatatttgtcccggagtgaggcatttgagatagagggggaaaagcaaaaaaaaaaaaaaaaaaaaaaaaaaagtgattacatcatcttcccgttcaagcagtattagtagcgaagatgggttcatcagtgaaatattttgcaaagataaatatacctccactctgcattctgatctatagcctctttctttttggaagaagcattttctttgcccagtttttttaggcagtcacattaaaattctcattaataatgttgacagacaattacgtttattatttctgctaataggcatctgcattcctattcagaattttcattgttagtctataaagtctagttttaactttggaatgtttggtagaggaggacatctatacattttcttttaactgtcctttctaatgtggtacatttgtgacagtgtttgaattctgggttttcagtgaattatggaggactaaaataccaggagtagtccgtactgcttctcttatacatgagagatatctaaggactataaaacataacttaagtatacccttttaatgcctttgtaagatttttaaaccaaggaatgactgggctatctataaacccagatgcactaagtggggagaaaagctcggagctgcagcatatcagcttttgtcaacctgccaacagcagagcgtaccatgctgcaaggagtaataaacaaggaattagaaaactcgctgctggagaacagtcaaattaaacacctttttgaaaggatgagcatgtatatattgcagttctattaaatgtagcttcttagtgaggttggcattatgttaaggctggtatggaagagaactgatgaagcaggagtggtctggtgacatttttctgacttgattggctggggcgtgtgatgtaataggtttcagtgcagccccttataggttttaaaatgaattccaagacaccattacaaagaaagccggactcttttcttataactgagctcagccaaggaaactcttgcacaaatgtacaatactgtttggaatatggaagacctggatttagaatatgccaagacagatataaattgtggcacagacttgatgttttatatagaaatggacccaccaggtaatactgcagtattattgtagagagttagttaatttcgtggctttttaatttttcga

SEQ ID NO: 188 - DNA, 2126 bp, Homo sapiens
acagtgggaatgttaggggagttgaccttgaatagacagatgcatgctcagtagaaatgtctatgacaaagaacacaaactggccaggcccagagacttgtgaagagcgagagaggctttggggagagaaggaagagggtggagtcaggaagaccagtgttcaggcaaggttctccaaatagggagattttcctggcttatctaggagggccgaatgcaatcactaggatccttttttttttttttttttttttttttttgagacggagtcttgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagcgacggggtttcaccgttttagctgggatggtctcgatctcctgacctcgtgatccgcccgcctcggcctcccaaagtgctgggattacaggcgtgagccaccgcgcccggccactaggatccttaaaactggaagagggagacagaagagagtcagagaaagggatatgatgacagaagcagggccatctggctttgaagatagaacaaggaggccatgagccaaggaatgtggatggcttctagaagctgaaagagccaaggaaattgattcccttctatttggcagaaagaaacccagcccagccaccaccttgattttagccgatggagactcatgtcacacttctgagctacagaactgtaaaatgataagttggtgttgttttaagccactaaatttgtagtaatttattatggcaacagaagaaaatgaatgcacggcctcatcctgatattcccgttcttaaatccatttcattttatttccacctggacttcagccctaaccttgcctcatctctgctctctgggtccatcttctggcccctggattgttgagaactccaaggggatgtgctattcagttgaatttcggcagcaggcaaagggaggagtccaagaagagggcaggtgaaggcaagggttaagcaagagttctagctctggaagcagactggcttggtactgaacctccgggagcttttgttctctgtggaagcctgagcaaggtatttggcttgtttctttggctccaatgtaaagacagtgataggtgctacctcagaaggttgctgtgaggatgcaatgcgataatgtgtgtaaggtgctaaacgcagcgcccagcagacaggaacacaggaaatgaatggcagagaaactctattagacatttatcatgtgacattataattaatgttcatgtgccatcaggagaccagatccaaggaacggcagaaagatcacaggagggcactcaagggcaacgccgagcacccagggccaggtgcccagccctcctcctcttccccttcctgtcccctcccctttcctgctggggcagcaggggcttagggacaaagccccaggcgatgaggaggtggcttggacagctggtgctcacacacacacacacccccgccctgtctcccagaggcctggcagccccacactctccccctccgcctcctccccacaccccctccacctcgggctgccctttggtggcagatcagggctggtttcccgaggagtggggcgcacgtggcgcgaagcccccgccttctcgctgcccctgagcagggggccgtggggggagctggccggcggccggcatggggttctcacttcccctccccaacggccgcgggtgcaggtgccgcgggccgagtcccgcaggcggggcggactctgtggacacgccctcgtggcgaggccgggctgccctgagggaggaagcgccagagcggcggccggtcccgcgcggagcccggcgcccctccagcccgagccaggacgccgccggccccggtcccggccccgggcacgcagcgagccagggatgtgagcggcgccccgcggcatggcagcctcaggtgggtaggcaggcgccgcgggtccccgggctcccggcccctctctcgtaccccgcatcccttgaggcgcgctcccccgcttgcttctgtttgcgtcctctgt

SEQ ID NO: 189 - DNA, 2054 bp, Homo sapiens
tgttgacctgagctattgcatgtagccaagtggcctgcagcaatctgctggtgggcaggtcttgctggatgcagtgttggcccactctccatgcccaacctgacatcaggtctcaggcttctgccagctctccaagaggaccttactgtggtaaatccaagttatcacagtctttactcgtctgttgagtctgtgggcctgaaccccctcagggtactggagaacctcccttttttttttttgagacagaattttgctctgtcacccaggctagagtgtggtggcgtgatctcagctcactgaacctctgcctcccaggttcaagtgatcctcctgcctcaacctcctgagtagctgggattacaggcacctgccatcacgtccagctaatttttgtatttttagtagggacagggtttcaccattttggccaggctggtctcgaacctctgacctcaagtgatccaccttctttggcctcccaaagtgctggattacaggcatgagccactgcgcctagctaggaggacctccccttctgaaccagttatggtatcccagggccaggaagaagctgaaagccttctgtgggaacaaaacaaagcaaaacaaaaacgcttcatggggcttccaccaaagttagtgttttaaggcacgcctcaggaacagcaacttggaagcaggttgttccaggaagtggttgtaggcagatttttcctgagttcttcccctgctctgagggctcattaaatcttcctctgagaagctccacttttatcttcattttacagatgggacaaccaaagctaaagagaggctaaggctcaaaagtcagagttagctagttggggcatttgggtgtgggcccaggccacgtaacttcatctgttgttctaagcctgaagccaagcccagagttaggtgttctgtatggggagcaaggtgtgaccatcttcctgggaccattagtctgcttgggaggccggtcatgacagtccagggcaaaagatgctgtcacaggatctcaagacaagatgctctagggaagagaaaagggagtgcccgctgtgtgtcaggacttgtgctaggctctaaacctcaggcaggaaagcatgggcaatgagccagaggctgctgtggcagcacagactgcggtacctcgaggctagtaagggacaaagcgtgggaagctgggatagaggctcctcacactctgaaaccagcaggaggaggtgcgagacccagcacctccatttctagaggtggcgtgaccttggctcggcctcccctctctgagcctcagtttcctctccagagtgaactgggggctgcaccccccttctcccagagtgggggacaaaaaaacgaatagcacaccgctgagattccctgtgtgtgcgcaagtgtatgacaagacgccgccggtaccgcacgagggccagggacgcagagaggccaagggcgctccggcctcgtagtagccagcgaaaactccgccgccagccactccgggaacgaagcgcatgcgccaacccatgccgtcacagtcacgtgccccacgctttcggcagaggccctgagaggcagactctgactgacacgtgagctgacctgtcagcaggaagcacttcccctggcgacgagcaaaaagactgttgattggggatagcaccccctcgggggcgggttctttgcagtcctggttactatgacgcccggcccccgccccctcggctagccgccatcttgttgttgatccgtacccagtgggcagcgccgggagctggaccaagcggccggtgagaggccgctgtagcggtgctcagccacctgtgctgcctgccagggggcgggccgaaacctggaggcccggggggcccagctcccgtagggagccgtgggcgctcggtgcccgggccgggcaggtgagtgacaggagccgggccgatagaccggcctgacgcccgcggggagggcggtggcgggcgcggggttggagtgggcgcgtgtggggtcggggctccggtggggccatcactggaacatcgctcgag

SEQ ID NO: 190 - DNA, 2028 bp, Homo sapiens
aacagatgtgccatgggattaagctccagtatttaatggcaggagccctgggtagcttcctgtgtcctgtggctggggcatacctagggctgggatagacgcaatatttctcaaagtaaatcagagtcctttgtcagtgggataaaatgctgattctcaggctcctcagcaaacctactgaatcagattattttggtgcaggggcctggagatttgcatttttaacaatctccccagaggtttccttgcaccctcaagtttaagaaccaccctttcaaagcgtgatttcatcacccaggagacatttggtaatgtctggagacattattggtcatcacgattgtgggggtgctactggcatctagtgtgcagaatccagggatgctgctacacatcttacagtgcacaggacagccctcacgacaaagaattatcctgcccaaaatgtcaatagtgctgagattgagaaatcctgaactccatcatatgaagggctctcaaggaaaagtacaagaagtggactgaagtcagtttgtgtcactaggtggctccttaggctactcaggcagggggctagcgttatgggcttccaggcccagttatcggaccaccaaattttcacagaactgggcagagctcacatgtattgaacccatgcagctgacactcctgaagccaccaatgcattatttgctaagtaattttttttcctctgataccaacacatttaaaatctttattgaattatcgtcacaaaattgcggtcatttcttgggggaaaatatgccattagttctacacaaagtactctttgctcaacttgcactttcttgaaatccagaaggtagatttacattaaaatcatgttggctaagagttgaaaaaagttattgcttatatggagttaagaaagcaaactttggaaattttttttggtctgagtttgtttctaagaagccaactacttctccagctctcctgcaatcctgccaaggtgatgtccagcttgtccctgttaataagttcaacagatcaaccctgtagggaagccaaaccatagagaaaggtggatgcactaaatttttttttttctgaacaaaatgtcagtgtgtattgttctatgacaatagtgttatttgaaattatgcctcgggccttcagtaggtaaagattcttgttcatttgctgcatttcaaaaaaattgtgtgcacgttcccattaagatttatttttcttaaattgaatatacagttaatctatatgcagatgaggtaggtaacaccctcctttctggattgttcgttttagttaaggtgttactcataacaatttggtttcctttccagtcttttgcaaaagtagggcttcagtgcaagatatccttttaaaaatacccttgggtcctgagtgttgaacttttctggctgaaataattttgcaccttccaaatgttttaatgctgttagggagctcttaaaatgcaaggatttaaggcccttagctagttaagcttttagcagaactagagctgttagataagaatagaactcatcctttacttttggagctttggacattgtttccagctgcttccagtcatttgaatcccgaaagcgcccctaatcctcgcggaggcagcctttctggctcccaggacccacccccttgcttctgattggcgaagctcctccgcggcccaagccagccacctacaacgtctctgagaactgatttgaaataagagccaggcggtcctcgcttccctgcgaccgacttttcataggctgggggagaaaaggttgagaaacttgacattgtctcgagcagagtgcgtgtagcaacagatcaaagaaaaagaggacgaaaacgtgctctttgctgcccgtagatttcgccgggttgcttttgtcttgcgggctcctgtcgggttcggtgtttccgctctgaagactgcgacgcgggctccgatgcagctcgctccctgccggatgggtcatgggattctaaacatgaggcaggtaagctcag

SEQ ID NO: 191 - DNA, 2012 bp, Homo sapiens
agccggatgtcatttctgaataagaataaccacagagacatgaatgagagggctctccaaattgctggtcttgacaaagatttgcttcccttgcattcttccccttgatgcaaaataactgccttttattggactacacccagtttgactcacagaacttgaagaaattataacctagatgactagatgaacacagtaatctccatagaccataggagattgcagtggatggcaaagtgttactaaacaaaaggaggaaaggtcagatggaaagctgtacacttacgtccttctcctggatggtgcactccttacaataataggcatcagagaccccaggtcctccacagatcacacagcgcccctggtaagatccatagttacactcatcacatatgcgcaccagagtgcagggacgcacataggagtcacaaatcacacacttgccatcacctgtaaggaagagaatggagtcatgctcacaagttcttcagtcctctgctatctcctgccatggggaaatatactagtctcctgggaaatacactagtctccttttgacagtgactttagggccctcctcttggcatcacaaaacttggtttccccagtgtccatctcaagcccctcaacacatacaaaagtttaccaattaacatatgtgaagagcttagaaaagcacctcggagatgataagcctgtataattgctggcaaagtgctgtgtgttggggaggggtcatgctactctggcgattcttcccgttgaaaactagagagatacagcgttaaatgtgcaagcggcagtggggagttagaggggcctttggctaaagtgcagcattcagtgttcacatacttccaggcacatctactcaaagccctctttgtggcacttttgctggttccacagaaaactgggagtgggaagggtgggttgttgggacggtgtgttccactcacatttttcacacagtcttccgatggctgcaagatgaaagatggtaaaaagtacaattagaataaaggttttgagaaagaggagaagtacatcctcgagctgggggtagggacatgagtaaggactgcagtgagtgagacctgcggatagccattttatcattacaaatttccatatgaaccaaacctacatccaagcaccctcctgaatctcctccaacgccctgggcaagctcagagtttctctggacctggttcagaccccaccccccgatacctgcctggggctcccagcacgcgcacccccgccctcttctcatcagaggccacaaacctgcgcgctcctacaacaccccgcgcctgagaggcgggaaacgtggcgcctgcgaggcaagcccctaaggaagagacgggaacccccgaccccccagctcctaataccacccctgcccagacagccaggggtagggcgcagtctcaccaacaccagcctgcttgcggcaaaagatcaaatcaggatgatgtttagccatagctcctaactaagccggccaccggaagcttcgggaacttccgtccgacctttaacccccattgttcctgcctccacgtcgctgtgattggttctctaagcttccgtcagtttacaatccttgcaccaggcccgtcttgctctcgcgcgagtttttgtcgctgctgggcggccaggtcctggcaggtgcatgaaactcttaaaaactctcccagatttggatggcggagataactaaaatttgttcttgggtaaaacatctttgtgcttggtatctatttctgcaagtgtctttgggcagtccgatttcctcttgcgtgtctgttcgttgcacgtgagctccgcccattgcgttcacagggttctggcgcctctagggaggcctcgccttcaccgtgacgccccactcttccgggcacgcccctgcccaaaggctttaaaggcgccgtgtgggacgtcactttaatgcgacctcatctttgtcagtgcacaaaatggcgccctacagcctactggtgact

SEQ ID NO: 192 - DNA, 1800 bp, Homo sapiens
agctttgtgatggtctcttccagagaacagtttggtcccaggacaacccttccttaggtacccagcaaacaggggccagggcagtgaggggtgaggaatctggagacaggacaggggccatgcaaatctccctggggccctggggaccagccataaaaagagatgagtggttcctccaggttttacagttgagctctccaggttagatgagtagatgcgagtgcaggacctggtcaggcataaagccagttcctgctccatggtcaagtctcgtgttccactcaaataacatggatcagaactagcaacaaagttctccacagggagaaatcatatttgtagagaagccgctgccagctgcttgggtgaggatattttatgtagttttttagttgattaaatttatttttattacaaaataatgcgtgtgactattgaaacgctaatgaggtgtatcaagaaaaaaataacaagtaatccactttcctgtctgaagtaactggttctaatagtttatcttccatacaatttctgtgtttatataagtacatatgaacagttttgaagttttttttacacaaaatggaacgttttttactatgttagatgtttattttaaaaataatatataaatatatagatagaggcaatatataagtagatttatataagtagatttaacccatccttggaaatagttgtatattattttacacagagatcatcattatttatccatcgctcccttgttaatgaacagtctcaacgatttactttgaaacaaatcgtcctgctgcactctgagggcgggcgtctgggtctccatcccggatctggggcggcatcttggggtagaaactgacacaaagccgggcctctgcggtccgggggcggcggccaagctccgcctccacccgcggcagccaatcagctcccggggacgccccaacccccaaccgtctgcactgcagcccacctccccccacacgcctcctcctagccacttcactaccaatttgcaaattcccaaggcgtctgccccagcgccttcccacatctctgtggaagactccccactccaaagtagcctggtgtggaaattgctggacgaaagggtgagtctcgtccaaagctggtttcggggaccagaccaggcccgggcacacggaccaattcaggggcggctcccgatgcagtccgctgaggtgcgggtgggagaaggaggcactgggtcggggtccttggggagcgcggccgaggggggcgcacgcggggctgccaaagtggtcgcgtttttggcctgggacccccttgggttttgggtccagggaggtagatgtctttcaaaaagggttgcctgcgctttctccattgctgtttctatttcagcttctttctaccagtctcttatttctttcatactgcatttcttctccaggaacataaccagcaacatattttattttattatgaaatatatttcaaagctacgcgcaggagataatatgacagatttattatatgctgacattttatcacctttgcttcagcgctccctctcttcctccacccccctttctttctaagaaataaaacacttaaaaaccccttccccccaccaaatctcatgcccccatcctgagaggtaagttagcttgcatcccttaccttgtatattttgtcctttattattaatgtttatttttaggtatgcgtttttgttctgaatttaaaatttttgcacgagattcagtattacagggttttaacttgcggtgctgttagtcctgacattgcaga

SEQ ID NO: 193 - DNA, 1784 bp, Homo sapiens
gggatcactgtctttcctctgaaatggttttaatcagaaccaatctgttatactcaggagcctaaatcaaacacgacatgcagagagacaaacaagaaagcaacaaatgatctgagccactgaacaagaaatatatataaaacagttttaggaattacagctgtcacaacttttcaccatggggccttctctgtgatttagaaaaaactgcatttatttgttattaggatcggagacaagagaaaaataccgacccaaatagccactggggaagagggaagctctgatgccaatttatgtggaggatggagccaaactgactcacacacacacacacaaaagtatgtactggcattttccacacagtccaggtcacttgggagcttagccaaggatattttgagcattcgactacctattgtgaacaaggttgggaactatgaggcgctatgtggccctgatcaagctcagatgggccaaatcctcaaccaaaattctctttcccataaatgtttatctctacatttcccacagaaggggattctaactcagttttgcttctgaaaccaaactatccaaggccaggtgagatgactcatgcctgtaatcccagcaatttgggaggccaaggagggaggatgcttgaactcaggagttcaagaccagcctgggcaacataacaagaccccatctctacaaaaaatttaaaaattggcgcggtgtggtcgtgtgagcccctagccccagctactcaggaggctgaggcaggagaatcggttgggctgggctgacagtgccagaccctgttaaaaaataaaaattaaaaaaactcctaaatttggaaacacatccccagctgagggccgggagatacttctcaaccgtaatccagaaccctctaaaatgggatgtggagaggctgcagcctgtagtcttgcgatgaccttttagcacctgggcatcttgcgcttctgtcattccgcccacacccgctcagctccatccaagagggcccggcagtttggagtgaaagcttagcttcccaacgggtaaatgaacctgcctcccattcacagggcggcctctggctggacacctggggcctactgcctccttgttacacattaaccaagttctggcctccatcgtaacagcgtcagggaagttttttcctggctgacagccgcagatgatgaccgaagacaacgtcttaactgagacgggccaatttggcaaatggactgctttcctccccagtgcgggcaccttcctcctctgtccggcaactggaccccactgtccccagccctctgtcacccccaaacctgcccaccgcccgcctctacccgaccctccctcagggaaatcgggactcagcccccaacgcccccacctgccgctctgcccacctcagcgcacaccgccagagcgcccagcccgcgcacgtgcttccggcgcgcgccgaagtcctcacgcgccccgccccggcctccccgtgcgcacgcgcgaacgcggggtgggccgggcctcgcgtagcccatctcctcttcctcctcgcggtcgcggccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagac

SEQ ID NO: 194 - DNA, 1749 bp, Homo sapiens
gcacttgcagaattgtgattttctaatttattattctttttccatttattagcaaaagaagttctaaaaattgttttttaatttttatttttttaagacagggtctcactttgttgtccaggctggagtgcagtggtactattttagctcaatgcagccttagattcttggactcaagcaatcctcatgcctcagtctcccaagtagctgggactacaggtatgcaccactacgcctggccaattttttgtatgttttgtagagacagggtcttgtttgttgcccaggctggtctcaaactcctggactcaagcaatccacccatctaagcctccccaagtaatggtattacaggcatgggccactgtgcccggcctcctgtctcttttgatatgacactttcattaatggcataattgttaaatgaaccttggttcatttaactttagcgctcatgttcttccaattattattgttgtatcttcttgaaggaagcccttaaggaataggtaagacttaaatggcactattaaagggtgcatttgttgggatagtgcgtttgttttgatatgaggagtttattcctcatgtgaacataggtctagcagcaggaaggcagaaggcactgtgataccagtctcgggctgtagagtgatgggagagcaagaaaaataggccagagaaatagcacaaggggccttgccatctgtattgagcgatttggtgtttttaatgcttaggggatgggccgtgaggttgatagaaaattgtccttgttggctgggcacggtgggtcacgcctgtaatcccagcactttgggaggccaaggcgggcggatcacgaggtcaggagatcgagaccatcctggctaacacggttgaaaccccgtctctactaaaaatacaaaaaatttagccaggcatggtggcaggcgcctgtagtctcagctactcgggaggctgaggcaggagaatggcgtaaaactgggaggcggagcttgcagtgagctgagatgtcactactgcattccagcctaggcaacagagagagactccatctcaaaaaaaaaaaaaattgtccttgtagagaaagggccctcttgattgcaaattgttcttgttgagagagggccctcttgattgtcattttcattggaatttgcagagaaaaactcagcctaagaagctaatattttctaaataaagtttggagaaaaatcacctgtcaagtgctggttaactaaatttcttaggaccctgtaatccttaagcatgcagtttattcagatgtcaaatatctatgttgaatttgaatcaatgtggtgtgtgtgtgtgtacatatgtatgtgtatatatttttatttatatgtatataagaataatttttttcctttagttggtggtatggattggataatgtacatatatataatttgtgaagtgataaaagtgtatttaaataatttatttctgctgacttactcttggtttttaaaatatcacattatttaattggcctcctgttacattattggctatattgaaatctaaggactaattgtagattagtggtctttatcatatcttggtataaaatttggctgatggttgttttgctatgttttaattactgatttctagggccccgtggttatgaatgtgcttcagtttcataatgcctcctgctatggcagacatccttgacatctgggcggtggattcacagatagcatctgatggctccatacc

SEQ ID NO: 195 - DNA, 1724 bp, Homo sapiens
ccccttaagagacagggttcactttcatcccatatacttctgattaaaaggagcctcttatacccaggagaatacattccaggtgcagaaagccaattacctagttattcccttacccacgtaattatagaccttaatccaaattcaaaggactcctgggagatgctggaatctgtaattgtgtaatctctttgatgaagcacagagtgtgatcttttgctcatgtggggctaggtttctgtggagaagctggaaatgctgtggaaaagggcttgccccttttgtgtatatgaactctaatgtagttgaaattcctagaagtcaaagatataaatctaactactaaaattcatttagtgcattaaaatgccagttattaatttacggcaacaactaaagggaagctttgtattattctaggactacaatgcaatttatgctttgcataatcattcagtaaatgacttattgctccagaaataccatcttgctagatcccattctgaattcagtgtttctgagcaatctcatctccaatacagagtgatgacatactcaggattccaagacggcaaaatgacttgggtaatgtagtctagggcctgccagtgagtatgctgagacagaccagaaagacttaaagattccactaatgtagacaaagcaagctgagccacaacttctcggaacaccaacaggatgcaccaacaatcgacaaaaaaaaaaaaaaaaaaggagataaagtttaaagtttgtcttccagcattcccttaccctattttccccttcctcttccctactttatcagtgggaaaagttctcaataatgcaattcttactgagattcttgtgtttatcagagaaatgtttcctctttctttgccaaggaattatatattcccaacagacatggcgcttgaatgctatatttcctttggaatcaagaaaggggaggtgggggaatcaaaaattaaaaaccaaacccaagccattgttcctcttcgaggaagggtgggtggtcagtcgtcgcctgagctccgaacatcaacccgcggctctcaagttcccctcccagtaatgctgggcccagcctcgccgcggccgatccagcctctgccctaggtggaagcgggccacccggtcccttcacccactgaggcccagtcctttcgcctcaacacgaaggcacctggccgggccggagcagcagccgcggggccggcactggggccacggaaccccgggccagactcaggcctgggccagctcggctccggcctgcagggggcgctgcggcggcaccggcgcgaggcccgcgcgtgcggggagcgaccccaggtgtaagtcccggggcgtggggcgcgtgggtcaaggcggagcgacccaggatccccgcgcccgcggcggccgccgagtggcagcgctggactcgcggagaagcttgggtacctgagccgcggtcccgggtgacaccctcagtgacgccaggcgcgttccttcctcttcctctctcctctccggccccgccttcccttccctccgcccacctccctgaagcggagccgccgtcgccaccagcgccgtcatgtcggcccccgccgggtcctctcacccggccgccagcgcccggatcccgcccaagttcggcggagcggccgtctcaggagccgcagcgcccgcgggcccgggtgcgggcccggcgccgcaccagcagaacggtgagg

SEQ ID NO: 196 - DNA, 1587 bp, Homo sapiens
ggcaagtcttctagtccccaaatttgccttgggaggatgacagctgtatctttcttggttctggtgtacagtggagaacagggtcaagatgagtgtggaatccatttatttttttacgtgtttataagcactagaaagcagtgagcactaagcagaggacccctcttgcggaaaaagtgcaggagagctcctgggtgcctctgtatcaccggtttgccttctagccagaatcattgctagaaccctgtcactcagttactttggttcctaatttaacctcttcccaagccttctattgcgttcagttagctaggccaggagcttacagctgtctggttggtgctggctcaatgtgcttattccctggaagatagaaggatcacttacaaaaaaatttacaattaaaataaaaaaattattttttgctgaagcattgtaaggtttttttaattcactcagacccaaaatcgtaaaactaaaatatttcaagacattacttgattcaccccccacttctctttctcccctgtttctcagcactttgcaccagatacagaaaccacgggttatgtccaaaccctggttttggtgtgaccaccgccttccgtgtactgcctgcggctcgcttcgggcccacacgggacaccgaggcatgatgaggacgcagaacagcagaagcgcgccctgcttcccgggcgccagtgctcggggccagcggcgtgtacccggcgggcccggccgggagcgggctggcgatcgcggggctcggcgctcccggctcccgcgccatctcccggcgcccgccaacttcgctccgcccgcggcgtagagaagctcgcagccctccggagcctcagcgatctcctggctcgcttttcccgcagccgccgagcagcgcaggcccggcgactccgggtgcagctggccctgtgcggtgacatcgccgtccggcgccaggctcgaagccgcctggccgcgcccgcggggtcgcaggccgctggtcccgcccggccgcgctcacaaactactcgcggctcgtgacccgggacaaacttctggcggcggcgcagcctcttccacagtcaccctccccagagccagctaccaaaatagaagacgcggccggggcgaggaggtgggcggggggagcccggtggccgctcctccccgcgcggctgacgcccgcttcggcggcggtagtggctgtggccgcggggccgcccccagccgagctcccggaggcgctcgggcgcgggccggcggggcacgggcgctcacgccctctagcgggccgcggcggcgccgggcggccgtgacgtgagcgctcccttcagccggcctgcggggcaccgccagtcagtcggggagcaagagccccgcgcgcagccggcgcgggctcggtcatcggcgcgccgccgcccggggctgggcttggggctgcctgtggagaggcggcgggcggaacgcgcgcggccacggccacggccaccgccacggccacggccggcagctcgggtcccgggtcccgggcaggggaaggggagaggcggcgagctcagcaaccggaaccgagggaagattttggct

SEQ ID NO: 197 - DNA, 1499 bp, Homo sapiens
ggccatgctctttacaatttaccacactttctcctgaaaaaaagtggaagtagcactatccgtagaaaataatgttctaggcaagagtccattaatagtctcgggagataaacagttttaactgccaagagggagaactcacctggagaatttaatgaatttgtaaggactaccatacagttagctagtaataattttatgtgattcatacaattgtgcaccattctgagatcagtgtacttcgtgttcttaacactatctgtaccattagagagcatcagaaaagcttaaaacccatagtcaaggcattcttaaaatagggtctgtgatcataaaaattctttctctcgaagtacttgcaaatgaactggaaaggtgtgtgcccccaaaataaaactaactgtggattaatattaaactgctgggtcaaagatagacggacaactaattaataaacacttaagaatgatgttaggctgttttgaacagggtgggtaaattttgggaattaacactgcaggagaaaagggaaagaaaatccagagtgagggtgggggcctacggcggtgcaatacttagggacattccaaaacttctgaactcctaagttagataataggtatctagaggtgtcaaaacatttcagaaaaactatttttgtggcgtgagtggactggctgcagaagtggcaaaggacaaacttggatgcagggtttggcaaatgttgggtgagccctaatctgtgcctggtgctagggaccctacagcaaagttcctcttttcaaagtttaaaaagttgggagtagacactaaatattattaaatatttaatattaatatgtggcatattagaaagtgctacatggtactaagaaaaacaggtgccagagagtctgcatttgggcttccacttctaaatagggtaatcaaggagaccctcatatttgagtgaagaccccaaactcgagtgctggcggccatgtaggggggacggcagggcgggagaacgagcgtcgcgttagcagaatttacagtacaatggggtccaacggatgcccaggaaggcgaaattcctgcaagttaaacgcacttctaacgcaaaacttaaccaggcccctttccaactatttagcccaccaattttagcttaagtctcttcttccccacgccactcccagatgaaaggaagacacgcctcgttggcctccagagctctgcgtccggggggcggacctctcatagctccgccccgtgacccgcgcgcttgcggaggggaggtcaaaggtcagaggtaaagaagtcatggcggcgctgtgtcggacccgtgctgtggctgccgagagccattttctgcgagtgtttctcttcttcaggccctttcggggtgtaggcactgagagtggatccgaaagtggtagttccaatgccaaggagcctaagacgcgcgcaggcggtttcgcgagcgcgttggagcggcactcggagcttctacagaaggt

SEQ ID NO: 198 - DNA, 1454 bp, Homo sapiens
atatctggaacccctgtcattcccaaaagaggtactttctgtaccttccaatgttcctcctcctccatccacttagaatgccatccatctttgtgattataaaaacgacatcacgttttcttagtactaaactttgcccgtggaaagtctcccattcttcaaggctgggctcaaattccacatccttctcgaggccttccccgtgattcctccctccataaacttaacaatccattttcctgaaccccatcacatctgtttgcagttcacccgcaagcaggcgctttatattctttagcacgccacctggtatctcaaagagtctttgtgcacaacaaccattgcctgaataaacaagaaaaaggaactgtaggtaggagcttggtgagacaagtaaagaagatggagagtgattaaggataatggagtaaaaatatcacaaagggttctcaaaaagcagggagtgaaaaatgagtactaaacaggctcttcgagaaaagttttttcttgggctgcctttgtgcagcctaggggcagctcacctgaaccagaagtcccagccagcctcttccggggtctcgacatggtcacgctgcaggggactttagtgcggacgattctggaatcaacggagatacaagaaagaatgctaatgtcctccaaaacccgcgcagagcgagatggaggcaacgagaggcagcctagaacgtctccaacttttgcgaaacacagacgcctacgtttgagccctcaaatccttccctccgttatctgcgccatttccatctcgcataacctgcccctaaactcttctcggttctgtccttggtccttctcatccaggaacccctatctcagtatgtagttcactgggaagtggctccacagagacacttttgttgggtgaatataagtaagccttgtgttaccttgttatccttgctaattaggatcaactgaatggataatctagatgatgaagtaatttgctggctacagacccaacactctgcagactcgactgcggtccgcctccgctgcgccgcaggctgtgcagcgcgacccccgcggcgcttggtgggcggtgcatctctgcggcgccgaggccccgaggacttctgggaattgtagtcctgtccccttgggagcccgcctggcacctgggttgttagggctcgtgggaggactacaacccccagggtgcagtgggacaggcgttgccgggtcgcaggtcccgccagtgcgagcgcaacggaggtcgaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgaccgtaaggatctcctggcgggcagtaggacaggtgtccagaacc

SEQ ID NO: 199 - DNA, 1422 bp, Homo sapiens
agagacaacctcaattttgcctggattgcacgcgggccgaggaagtcgggatgctccgaagggtttctgctctgggagtgcctctaatgtgggttttctatgctttctctcttcgcaattctcgacaccgtttccttcttcctcgctttcattccctgtgaccggagaacggcgctgaaggactggagaagcccaggagactgggagccggagcgccgggtacccacccgggcctccccgcaaccggagctgtgcggaggaggaggcgcggcgaacggggcggggctcccggaagggggcgcggtccgccgagagaggcggggctggggcccggacgcgcggcccagggggtggggacgaggcaggttcgaaggggcggggctgaccaggccggtcccccgggaacaggaaccctggtggacgggtcccagcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacacctgagccgcccggagaggagcctcggccccgtacccaggtcagtgggctctccccacaccccgggcttgccgcgcggtcggggttgggatccccgtcgggagcattacctagggagtggagcgcccccagagctacgaaccacggggacgtgtgggtcagtgtctctgtgagccccggagcgtgtcccaggctcgaggacggggacccttctccaactccactggccagaagcctgggaggagggcagaactcctgtgggttggctgcgaatctccacccaaccctgcctgggatccgcggacagtccgcactcctgcaggtgccagcgtggccctggagatgcgcagggaggtggggtccctgagttctgtgcggcgcgtcccagccctgctcagcccggggagcagcggcgtggactagggagcctaaggaggttgcggaagctttaggtctgtcagcccaggcaattctctggtggacacagcgtgtgtctagatgcagggcctcggctaaagccagttctgtagtgtaagtgcaaaaatacagcacactttttaaaatctaaagccgccgcgtcccagtagactgcaggatggggacggtcctatttaaaagtgggctccctcctcacctcatcacatcagattccagacccgcagtttttcctcggatgaaaataagattatgtaacaagagaacagaacttccagcgtttggataggattaa

SEQ ID NO: 200 - DNA, 1415 bp, Homo sapiens
gctcaaatgtccgctgactgggggttcgccttaatctgtcctcgccaggagcgctcgccctcgccctcccgctggctcgctcctgggccctggaggggcatgggcccgggggcggttcgggaggggccccaggtgaagggcgcccgcacttctcctgcggcaatcatcgctctcctgcctccacacgtcgcggcagcggcccggccccgcgccgaaacagcagctgtgactgacggagtcacctccccgcgcgcctggccaccccctcctcccccgccgctccctcctgcaccaacacgtcatggaaacacggacgtcagagcctctcagccaatcgcaggctgcggcaggagggaaggggcgcgctggagggggcgggggcagcggcaagccaaggcgctcaggggaaggaagaaagggaggggcgtgcggaggcgcaagtccccacctccgcccctcactccggccaccctttcccgaccgcgcggcaagttctaatcgccaggcgcgcgctcgccagccgagggcgcgctcgccgggtcctccccttaaacgccctcccagtgccgctcagctcccagtcccggtccgagccgcggttcctccgcgcgcgcgcgcgcgcactcgcccgcccccaggctccccgcggatcgcgtcacgtgaccgcgctcagccaaggcggcagcggcggcggcgcgagcttcggcggcggtggcggctgtggcagcgggagcagctgcgccgccagcgtggagcgggaggcgtgtgggtgtggagaaaagggagcgccagaccggaacgggtgagcgttctcctccccctgcctaccccggcaatcttgcaggccacccggtgcagacggggtccctgcccggagctgcgcgcagccccctcgtgctcggccgtccgctctccggtgcccgcgggccccgccccgagtggggcgggctgcggcgctcacggaggtggctgcaccccgcccgcggctgctgttgcggacggcggcgtgaggccggctgagctgcccgtgccgagcgagcgcggcgcgccctgtgtgccgctctgcggagccgaggaggcgggtcctgcggggacgcgggcggccactcggtggctgccgggctctgggcggggacggccgggcgccgcctcctcctccttcgctgccgccgccgcctcctcgcagtgcagcgtgagtagggagccccggctggtggacgccgagcctctcggctccttggccgccccatccccgaggtgcagctgcacctccgcgtggcgccccgagccctgcgagccggctgcggacgcgctgaggacggagcccccatcctctgcgtttcccgctgccccttaacgccccgcgaccctcccgcagcctgcctttccttccccctcggaaaatggttcccact

SEQ ID NO: 201 - DNA, 1383 bp, Homo sapiens
aaaactgaattgcaaaagcggttcctggagaacagaatgtgagtttttaagtgacaagggagagggagggggagggagagaaaattctgaagcgcccagtcttggaggatgagggaggagggcaattccctaatgtccattggaattcggaaggacaggcaggccgggcggactggagacggcggctcgccttgggaccctctgagcttgcgggccccgctgagcacccaaaggccggccctagagtccaggagaagagcgcagcggcgcggagctcccaggcgttccccgcagcgcgtcctcggtcctggaaccaccgcgccgcgcgtcctggcttccacatctgccccatttgcccgcggatcttgactttttcttggcgggcaaggcctcggtctcctccccgcagcagggctgcccgcggctgcgggaccctcctggtcctgatgcctggcagaatcgaaggggtgagggtacgctctctgcagcagaaagccctgggcttaaagtcctatttattatttggcgttgccacttactggtcggtggctttggtagggcgcgtttctgagcctcagtttccccatttgtaaagccgaagtacatagcgctttccctgcagagttagaaatttcgacgatgtgccgcgcgctctagagcgcgctcagcaagcgggtcccaccgtgcccaaggcaggaccgcggcgcgatgtcacctatgcaaagtcgccgcaactcacgggaatcgcagctgtgtgctcaactttcccctccccgccgccgtctttctccccaaactggcttgggggtcgagtatccggggctctcccccgcactggcgcttcccgcgcgggcgccccaggtgtccgttccgttccgccctctgcctggcagggcatccagaggtgtccgcgctcccggagctgggcggagcggggcgcagcccacgtggttcgggcgggaggcgccgggacgtggccagttgcccgcctgccccggagagccaggcgctaaccagccgctctgcgccccgcgccctgcttgcccccattatccagccttgccccggcgccctgacctgacgccctggcctgacgccctgcttcgtcgcctcctttctctcccaggtgctggaccagggactgagcgtcccccggagagggtccggtgagtgcactgagaagagggaacagcggggccagggtggcgcccaggactcggggcttaggctttggggggtgcgcggtgtcgcgtgcagacccactggtgtgaaaacgcccccagccgccagcctcccggcctcggtccaggctggtgaggacagcgcgttcccagccacccagccttagtcccccaggcttcacctggattctttgagcagact

SEQ ID NO: 202 - DNA, 1376 bp, Homo sapiens
acctggagtattcagtggcaaaatcttggacacaggaatacagtaacacaacatattggtctagcaagcactggaggagactgaggcggaattgtccagcgaatcccacaaaaatggaaatgaagaggtctcagtatctctaggtgcccgggtccgatggaataccgatgtacataccttttctaacacagtagcattagtttatatatcagcattacctctcttttgtttcagttgataagtatcctactgtaatccattcattcacactttgcttgttcattgttgaaacaaattctccctggaacaaaattctagtaaccaaatacatcatatcaggggaaacttccttacagcagggatggtattaaagtaaaaagaggaggaagtcccttcttcagctctggcagggacccggctggggaggaaaccttcccgcaaggtaggtgatctgctgtggtgaccaggctaaacccactctacagctgcaggagggactggcatcccttagaggtgaagaggggaggagacccacctcctggaatgtgtccctgtggtctccagatgatttcttcctctaataaggacaattctgccaaaggaatggaatgcttcgtcacaggctcaattactctgtctccgccagcctaccacctataaacaattcctcaaattaggaaagcggggagatttaataaagacataacacgtaaagtgtaggaaaactatttgtatggcattccgagacgactaggtcagagttaacaagtaaggagcaaagtagttaataataccaattctgtttacccatcacaacacctgtgctgaatgtcagggtttaaaaaaatctcccaacctttatctaaaaagatagggctacgtaacaatcggtgtggtttttgtcggtagaggtctaggaagccgcaagagtagtggacgccttgacagctgcccttctcgcgggccccgcggcggcgtgcccgtgtggttgcgtgcgcgcggacggggcggggctgaggagggacgtgcgcgcgcgcggacggggcggggtggagctcggagggcggacgcgctcggggccgtctggtcggcagggggcgctgcgcacccatgccgcgctctgcctgcccccgggtgctgtccgcggcggttcgattggagcagccgccgaagagcgcttggcgccattttgaagcggagaggaggaggaacggcagggctggctgcggaaggggagggggggggagaaggcgattggatgcggcggcggcggcggatcccggagagccccggagtgagcggagtagcgagtcggcaacccggaggtaggaaacaattcagttaacggaaagaaaatgtctctcttctctggctgc

SEQ ID NO: 203 - DNA, 1199 bp, Homo sapiens
acgcttctgctccagaaacaacttacggataaaaactcagcttccggtctttattgtttcgtccccggcggttcttacaacaaatcgctgcgcaatagcggggcatgactcgggtgaggcccctggagaccggggccggcgacggatgcagggcggccctcctcactgaggatgcgccacaggtccaggcctctcgagcccctgcgcctgcgctagcattctgccgggaaagccgcctcgtctgtcgactcacttccgcctcctccggtttaagcaccgccttttcgggggttgaagccggaagtggcgcacagccctagcagcaacaacagttttccacgtgcgcgtagggcgccgggatcacgtggggaggcagaagccaatggggaagcgtttcgtgtaggtcttctgaggtggtggcgccagcggctacctcctgcctgtgaggagctggctgagaggggactgggcgccggcggggaaggaggagcgctaggtcggtgtacgaccgagattagggtgcgtgccagctccgggaggccgcggtgaggggccgggcccaagctgccgacccgagccgatcgtcagggtcgccagcgcctcagctctgtggaggagcagcagtagtcggagggtgcaggtgagggacgaggccggggtcgtggggaggggagttcggagggtccccgtagcccaggcctgtctttgtgagctgacttggcctcggtgtccgccacggtcgccgcagggacaatgggctgcatgtttttggccgagagaatggaagaacggagacagccgcatcacagaatcgtgttttgggttgtggcgccggctttcacgggcgccggattagagcccgggtctcgggcagcttctgcggcggggcctgggcgggcagggaaagtgccagtcgcctttaggtgaaggttggagggtctagcccagccgcccaccgaggctggggaataaggcacgggctgctggctggcggggccgtcttggggatgagaagtctgtacaatacaaaactagtctgctaaaaaaaaatcattagatgtccaccttgagaccgtggaataacgtctgctgaaccagtgaggcgcctccctgtcagttttagatccgccctttgactagggagcaacctgcagttgacgcagcgtccatgggacacactgttgtgttccttaaaccga

SEQ ID NO: 204 - DNA, 1197 bp, Homo sapiens
ctggcctgaatcccacaactggcgccccaccttgtgcacccgcacccgccctcaataccggcgggcagctcctccactgccgcagggttaccagctgcgtgtccgaggggcagagagagaaacagagggggacggggcaggcgcgctgggcccgcccccccgtgcctggggcagcttctcattggtgaaacctcctccccggccgcccgctgcttggaaaatcagcctcggattggctgacagccccccgacgggcgtggcttccgaggagagggcaagaacggaagcgagggcgcgctctcgagaggaggggttgcctaggcgacgccggaggcgcgctcggggggtgggaaagcgagcccggcagctcaatgacaaatcggtggaggacggctggggtccggccccgggagggggcggggcgcgtttaagagctgcgggccgggtgcggacggcggaggcggcgggactggtccctggtaagggcgcggcgcccgcgggccccgggcggggtggggcgcgggctggggagtggggtacgccgcacgcccgcagcctcttgctccctccgtgccgggctgtggccgggcggcggcaggacatgtcgcgccccgaggccggcggagggcgacgccccggcagcggccccgctccgctccgggaggactccctgggggagtctcggcttcctgggctgcctggggctgaggaagtgggggcggcctccgcctctcccttgtagccgcggttccttccctatcccgcagatggctctgcttccacttcctgccgcgggcctcccgctcgggaccgtccacttcctcagtcctccggccgcggcttgggcagggtcagggctgggaagtgttgcaaaaacttaactgccctcggaacttgcacgcgccgtgaactgggcggtgttcctaaagggcttcggtttgctggttttgttttggtcctgtcttgcaaatgagcataaagttgtttctcccccagcctcctcccctttcctttctgataggggccagcggcgaaggggcttctaaggggaagcgcctggactgggcatcgccgtcccggttcttgccgcctgtgggagtgtgaggttaaccgtgctcggtgcagggttgcggggcgcggagcttgctgcgtccacactgcttgtgtgagcagtgtcctctctgtgctcatttccaa

SEQ ID NO: 205 - DNA, 1194 bp, Homo sapiens
tttttgagatcacgctctgtcacccagggtgaagtgcagtggcgcgatctccgctcactgcaacctctgccccgcccagggtcacataattcccccacctcagcctccagggtagctgggactacaggagcatgccacgacacctggctaatttctgtattttttgtagagacggggttgcaccatgtcgcccagggtggtctcaaactcctggactcaagcaattcacccgcctccacctcccaaagtgctataattacagctgtgagccactgtgcccagccttcttcacaatttcaccacaatccgtaaatatatatttatttatgtgattatttgttcactgtctgttttctaagttgtaaactccaggagggcagagccaaggtcaatcttgatatttgccctccctcactcccttccacccactgagaacactgttgggtaatcagcaggtactcaataaatgccagatgaaatgaatgagctagtgcatttagtaatggaagctaccctgtttattgggagtagctttgaatcactactgaaaatctggataagtgctattaaaattaggacctcaggtaggtgcctcaggtatctcagcccataggtccttttcttcaagcctcacctgccactctccacctgtaacgtgtagttttcatccaaataacctgtgctcctggcaatatccctaacaatcccaaactaaataaagaggattgtgacatggaccctaaatgtcgccacgtttgcgtctccatcccggaatatgacgctggtagctcattagctccattcaagcctacaaattgcatcaccctcctcctctgcccagacctgggggctccaacacctttcgctaggtctggctctggcctctgagcgaaccttccgtacagtatggcggctcccgaagccccgcccctggacagagttttccgtacaacatggctgtctacagagtgcgattcccacccacttccgcctagctaccggaagtttctatttgaaacccaggcggccgacttagccggtggcacgacagttgctgcagggaatcttttaaacgagagcgagaaggactgcgggcaggaccggcgggctcctgggttcggctctcccggggcgagggactgggctggatgggaggaaggacggaatgagctgggaaaggaggattttctcttt

SEQ ID NO: 206 - DNA, 1192 bp, Homo sapiens
attggtgaaagagaagcaagctgcctgctcagatggcagggaatggggaaaaacagggagacagtttcctgtttgagatgttgggagatgcttcgagtagtatatttactggaaatagacattcaacttggatgtccctttttggaaatgtgcctgcgtccagggctgggttggggccccaatgaactttggctctgacatagctgttgccacactcagtggaactgaatccatgtttgccttcacccggcatccttcaccccaactctccccgccacaacatacatcccatgccagcctggggaccctcaaaggtgcttcatcattaggtttgtggctgggtcctactgaagtaagtcttggcactcagagggataggaattgaatgaagacatgagattcctctgcgggaggcctctctaggaaatctgtggactcacacgtttactaatgttgctgcagccccgcacccaccttggccttgggcagccatactctagggcttttgtaacctctccatgtgaggaactcaaattagacctgggtttggaggcggtgctccgagctggcctttgggggaggttttgtgcgaggcatttcccaagtgctggcaggattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccgggtgagtgcctgggctagccctgtcctgagcacatgggcagctgcctcccttctctgggcttccctttacctgctggctgtggtcgcacccccactcccagctctgcctttttctcttctgggtccccagggtgaaattctcaccagcccaggggactctggaggcaccccctgcctccaaacacagaagcctcactgcagagtccttcacggaggacggttctgtgctgggcctggaggggctgcctggggggcaatgactgatcctcagggtgagctcctgcatgcgcactgcccaccaggggcctcatctccccatctgcaaaatcagggagagat

SEQ ID NO: 207 - DNA, 1189 bp, Homo sapiens
tgtttgccagactcatctcagaaaaagacattatcaaaaggcatttattatcttcctaatgcgtgtctggcactgggcagacactgtagaatactatcttgattagagtctcaaggattttgtacttaaagtcctttacaaataaaagtattcaagtataatctattataaagactcttttctccactttggggatatacggtgtggcatcgattcattggtcataccaaaactgttacttctgttttggaggaattaacaaggaaaacccaggcttagtaaatcaacatcgaagttcagaagttcagagtaatttgtcttgggaacaaagtcctccctagagcgaagaggcattcacaggagctcttggtgttaatgggattattcaagatatacctgagaccagataaatatttgatgattttgccaagcactagggtttctttgcagtttgtctttggctgacgttttccccccgtggggtttggactttgtggcttcaccagattttgcaaatgaaagaaggctggggtttcccaagagtacacttgtgcaggaaacaacagactagtgaggtttacaagaggggggtgtgtgtgtgtgtgtgtctgcctgtgggatgggggtggcacgggggagagagagatgtgggttacaaagctgccatctagaggctagaggctcctttctgcagtgtatataatgcaagtctgcagccagcagagctcacagttgttgcaaagtgctcagcactaagggagccagcgcacagcacagccaggaaggcgagcgagcccagccagcccagccagcccagccagcccggaggtaaggaaacggtgctcgggcagcagctctgctcggaaagaaggcacggcttctgctcttaagccaagtggtcttttcaaaggccttctttaaaatcgctcagatgggtgcttttgagtctgcgggtctggtttctgaaaacccaggctgcacgcagctgcattgcaaagtgcttttgctaattcggagggcttcacctttctcttcagaaagcaaagggcagttttcttaagtcacttgcagaaggaaatttccatgtgtatttaggaatctggtgtttatttgctgtgtggctatttaagctccagtaagcaggggaactttgcaagaacacagactatccattctgcctgaccaattt

SEQ ID NO: 208 - DNA, 1186 bp, Homo sapiens
gtatctgtggagctggattctgggttgggagtgcaaggaaaagaatgtactaaatgccaagacatctatttcaggagcatgaggaataaaagttctagtttctggtctcagagtggtgcagggatcagggagtctcacaatctcctgagtgctggtgtcttagggcacactgggtcttggagtgcaaaggatctaggcacgtgaggctttgtatgaagaatcggggatcgtacccaccccctgtttctgtttcatcctgggcgtgtctcctctgcctttgtcccctagatgaagtctccatgagctacagggcctggtgcatccagggtgatctagtaattgcagaacagcaagtgctagctctccctccccttccacagctctgggtgtgggagggggttgtccagcctccagcagcatggggagggccttggtcagcctctgggtgccagcagggcaggggcggagtcctggggaatgaaggttttatagggctcctgggggaggctccccagccccaagcttaccacctgcacccggagagctgtgtcaccatgtgggtcccggttgtcttcctcaccctgtccgtgacgtggattggtgagaggggccatggttggggggatgcaggagagggagccagccctgactgtcaagctgaggctctttcccccccaacccagcaccccagcccagacagggagctgggctcttttctgtctctcccagccccactccaagcccatacccccagcccctccatattgcaacagtcctcactcccacaccaggtccccgctccctcccacttaccccagaactttctccccattgcccagccagctccctgctcccagctgctttactaaaggggaagttcctgggcatctccgtgtttctctttgtggggctcaaaacctccaaggacctctctcaatgccattggttccttggaccgtatcactggtccacctcctgagcccctcaatcctatcacagtctactgacttttcccattcagctgtgagtgcccaaccctatcccagagaccttgatgcttggcctcccaatcttgccctaggatacccagatgccaaccagacacctccttcttcctagccaggctatctggcctgagacaacaaatgggtccctcagtctggcaatgggactctgagaactcctc

SEQ ID NO: 209 - DNA, 1163 bp, Homo sapiens
gaagtgatgaaagaatggggttgggaagtaggggacagggacttggggacaaggctgccttgccttttcggagaagccttctcgccatatgcaggaccaccatgtacagttgaacgaatgtttactgcacaagggcaccctatctaatgttgtattgtccataacgtaccatcatagatttgtccatttactctaacaactgtctggcatatggcggtaacaagtagtatttcatcataaccagtatgtggcaatgatattccagcagatggcaataaagagtcttgcagaaggggctcattttcctactctgcacaaaagaacatgtggactagtggaagctctgggcatatagtaagtcctccaatcttccctttccttaaagcctcacgttcctagggcagaaaagggatggggggagctgccgacaccaagtttccaagaagtggaatcctgggagccagaggaaatgtagtatttggagacctgccagatgagtctgaggatccacttgagtgagatccagggaccctgagctagcatctctggcagggccttgcctaggacgctgcagggtgggcttgaggaagatggacaagagaaagacaaaggaaagaggaacttggaggcatcacctttgggccctcccacagcagaggcctcgggagcaggtgcctcctggggcagagccctctccccagggcccggacactcacgggcgatgcagatgggtgagttgctacagaggggtggtttgcattttatgccagccttgatggccttgtagagcaggtagatcgccccggcgcctgtggccaggctgactacgcttttgcggatgtccagttgccccaggtattgggggatgctcttgcccatgtcttcagtgttgccctgggcccaggtgagagctaggcccaaggcacctgtggggggccttccggaaccagaactctggcagggtcaggaaccagggtaccagaattggaacctaggcaacaaaggaaactggggagataatgggatggagggcagtggtcaggaaatggggcagccaggagtgctcgagaacagatggggccaggcaccatggcccacacttgtaatcccagcactttgggaggccaaggcaggcagatcacttgaggtcagcagttcgagac

SEQ ID NO: 210 - DNA, 1163 bp, Homo sapiens
aggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtaagtgccaaaaaggggagaatgggaagaatatgctgtatttcacaaaaagcatctaagtagccatctggaaaagccagaatgaacttcaatggtgcatccaggtgggctggggatgggagaggaacgccttcccccagcctttagggccggccctgagcaagtggtcagtcggcaggcagctgcggaagggggctcccccgagtcggtggtggcccaaagtccaggccgcatccaccgcccggcgcctagcgcaggggcagcagccgggtcgccacaggaggggccccgggtgttcttgccggcttgggggaactttcccagggtcagcccggaggcgccctgcagccccggcatttggctaaacaaagcaagcgctgccggcgcggcccgcccgagggcgccgcgggaagaacctgggcaggtgcgcgccgcgggcgagcgggtacaaagttgcggcgccacctcctgcgctccgcgcccctccaggctctcctcccagccgcctccgatcctcccggccgggcctctcttcccccgttcttcgcctcctccctttctgctccttgcccttcgcctcttcgctactttcgtctttgcaggctcccgcctccccacccctccccggcgcagggccgagccggcgggggcgcgcagggggcggtgcgcggcgggcgcgggcggttccgctttcgggtttcccgccgccgtggccaatccccgcgctgcccggggcggcgacgcgcccaagccgagccgggcggctcctcccgcccccgccccccgcgcgcccgccgcccgggcggaggagaggagcgcgcggccgcgcagagcaagctgagccgagccgagccgagctgggggcgcagagcgcgggaggcggcggcggcgcggagcccaggtgagctggcggtagccgggcccggggcaagggacgcagccgccgcggccccgggcgcccgctccgtttccctctcgag

SEQ ID NO: 211 - DNA, 1160 bp, Homo sapiens
tgcctccaccttttaaaaatcaaactctagaaaaaacactcacctgtttggcctctccggcccctccccctccctgccctgaactgcagctgtgcgcagccagttgcctgttttccttaaaggcctcggggtgctcgtatcttcttcagacgttcagccaaaatttttaaagtgcggctggggggaagggtagcgcactctgaattcatttagctctatcgttgaagcccgggttcctagatcagggcacaaaaacaaatagaaaagacaatttctggaagattggaaaacagctaattttgcaggtgcttcggcatcagtggtggcgatgaatttaacatccatgccgggggggataaggttcaaccgcagatgaaatggttaataccttatacgaaattcacggcgaaaaatcctgaaacaggacatttaaattcactgccgaggcttgggggtggggtggggagcagggatcggaaacgacgctagtggttcttaaatgcgtttttacttgggaatgcccggcagggaaaggaaaggtcatcgtctgtttaatttccacccccagctctggacttccagcattagctcgccgggcctcagctgttgtacacacacggcgaggggggaggggagggcggaggcgcggaggaggggccggctgggaggaatctgggcgtcctgccgcgcatgcgccttgcctgagcaacaagtgggctccacagaggaagtgtaaaggggagggggaagaactggtgcagagcatggcggtgacgtcagcgctccgcccgggcggcatcccgcgcggccaagccggggacagcgcgagccgcagccggagcaggagcgccgagacgcgcctccggaacgtagagtaacaatcacaaccccacattccgggcgagcgtgagcacgagcgggaagggatgcgacccgggccgaggcgccgcgcgagcgccctgcagccaacgtgagcgccgccagccgcggcggcccgggcgccggccaggcctgggggcggcgggagcctgcgtgcgtgcactcctctcctctgctctcgtgcgtcctggaagcagtggccgcggcggctccctccggggtgcaaacccagtcgccgccagcagaacggccgacgctgcggaggggagaaggtcctttct

SEQ ID NO: 212 - DNA, 1159 bp, Homo sapiens
ctgtgacttcagccattgtcatcccagccccaccaccagcaccagaactcccgacactgccatcagcaccaccctcaccatcaccatcattgtaaccagcatcctagctactagctactgacctcttgaccccctgacacccctatctcctcccctgagggtttgagggtgctaggagttaggagtggagtcaaagcttcaagtacataacctagagacaagcagttctcaatgattttgcccatccagaagacacttagcagtgcctggagatatatttggttggcacaatgggtggactgctcctggcatcgagtcggtagatgccaggaatgctgttaaacattctatagtacacaggatggggcccacaacaaagaactatttgttccaaaatgtcgacagcactgaggttgcgaaaccctggctatagatcctatctatcccagcactctgcctctacctttttctggccctcgtccctaaatgcacacattatgcctctggtttgggaacaagacgtaatcttcaccactccatcttacggcaactttctctcttatcgcttgcacctcctggcctccgatgcttgaaccaaaaagtcaataagatgaaagtctgttgcggccaccctcaagaaggaaaaatacacagaaacgatacacgaagcacagggtacaccctgggttgaggtcatggctgcccagggcagggaggcagcgattagactaatcttgggcgtataaaagaggaaagagtgcccaggtcttcactccactgcgactgcagaactcagagctgctcttcctctgtggccagttggggaccagcatcatgaagtggatggtggtggtcttggtctgcctccagctcttggaggcagcagtggtcaagtgagtctgggatctggctgctggtgcagggagcctggatgggagcctaaagccctgcaaagggcaactgggccaggggacaccctgcctgtctctactctgggacttctgctaggggaagggaagtctccctttgctgatgttagacaggacacatgggtggaaggagacacagcccctgccttcaggaaacttcctatcaaagggaaaagcacgatcccttcccccatctgatgaggaaagatggacctgaaacagaggtggta

SEQ ID NO: 213 - DNA, 1158 bp, Homo sapiens
cacccaagtattttgctttccagattgtgtgcgtttccttttcacttcaccttaaagtcagcctgggtttacaacatcggcttaaggcgcaccctctaaggtttcagacagacccagggcaccgcggtgatgacctgaagctgatatctctcggcaaagccaaggtatccgggaggttctccgcgttgtgccaggatttccatccaacccgagagtctcagggcagaggccaggcccccagcgtccgactcccaggggtcccagccccctcccctggctgaccatgcgggctgggacctcccagccggaaaacaccgccctttcctgtcgcctactccttccccaggccgacgactcgcggaggaggaagagacggaggccgattaagaaaattagcattcattaacccggttcacgctccggccccggcggaggggaggggcgcgccgggcggcggcgctggcggtggccgggtgaccggcgggcgcaggtgccaccgcggcctgaattttactctctcgggccggcagctgcgccacttgcgcctcgtcgcgcgtctggggcagccgccaccggcttgccccagctttaggcaaatccttttgaaagaccctgagggagaagaaacgcctccctctgggtaggagaacctgtagcgtctgctgttcgtcgcgtgtccagttgctcagccgggagctccggcatcttcagggcgcttattccactctccgggttttggctgcagctctgaggggagcgagctagaaactgacagaacgcgaccctccccctccgcgcccaccggagcccgggctgagagggacctggggagctgcggcctggccggggcggcgcactcaggtggcctcgcttccctgcgggtcaccgcccgccactcgcacagctaggtcggcctgttgggatcgggagaggtgggcgcacgagttttagtgcgggagtccggggtgcgggcggagtcctattgtccccgtgcacccgggcggcagcacctccgggtccctctttaaaccgagcgtccggcgacctttctttgtgcttagggagtcgaaagcggcatcttctccgagagaagtcgcctactggggggtggcgctggggaggtaacaatgggcgcccattgtcctccgagggtccaac

SEQ ID NO: 214 - DNA, 1080 bp, Homo sapiens
tttggagttagagttgacagggcttactgacagatagaatgtggggatccagggaggtgaagaaaatgaccattcagttcctcctagtgcacctggaaggatggttgggccatttactgagatgggccagaatgacaggtacaggtttttggtgaaggtgcatgtgtggaaatgaagagttctgtataagttagagatggtcatcagacactcaagaaggggtgtcaagtaggcagctgagctatggctctggtactgcagggagggtccagctggagatgtgaatcaggaagtcattaacctacagggcagcaccctccaatagaaatagagcgtgaacctcttaggtgacttaaaatttcccagtaaggaccggacacggtggctcatgcctacaatcccagcactttgggaggccaaggtgggaggatggcttgcgcctaggtaggagtttgagaccagcctgggcaacatggggagaccggtctctacaaaaaaattaaaaaaattttagctgggcgtggtggcgcctgcctgtagtcccagccacttgggagtgtgaggtgggaggattgctttagcatgggaggcggaagctgcagtgagccatgatcacaccatattatttttccccctgctagccacattgaaaaagtaaaaagaaacaacaggtgaacttaattcaaatatttctaccaccatagctacaaataaaaaaaactaattcaacaaatgtacttatttaatccaatatatcccaacaattattgcagcacataatcaatataaacattatatatatgaactatttgacactatttgacatttcttcttccacatccagtgtatctgacatttagcgcacatttgatttgcactcacccactttgaggagctcaattgccgcttaagtccgtggctagtggctgccctaaagttcagcaccgccacggagctttgggtccacccggactgtaaaaaggaagcacttccgttagcatgacccggcctgaagtagcggcggaacggaagtcgcttgtgtatgaacgcagcggcggacctgtgaggggatccgacttg

SEQ ID NO: 215 - DNA, 1066 bp, Homo sapiens
agtttccgaagacctattccgtccccaccctcctccccttcctcggagacacctccacttaacactgccttctcagtccctcgccgcctgtttaaacacaacttccacccctcacaaatcagaaagctgtaatttcaaagtttcagaaacgttttcggaaagcctcctccaatgggaagcgacttcgccgctgagttaagcgtccgaatcctccttcccgcggcagggacaccggcccgggccaggtctgcggaggacgcccccgggcgcgcacacacagcccgaggacgcgccctgtattttaagacgcagggtcggatttcaccccgaaacttggctcccacagccccaggccgaactgtgtctggttctcagcccccgagcccgagttctacgccgcaaagagatggggccccattgtgcctagctggcctcctagcacggacgtgtattttcttttggtctgtcttttgctaaaaaccggcagtgcgcttcgcctccctgcccagccgcagcctgccgtcccctagacaaaaagcggcgaccgcggcccggccacccgagccccgccgcgctgcgcctttgttgggcggtccacagatggtgcccagcacggggccgcgccgagggcgggggcgggaggccgcgaagagggtcgggcgggaggggaggagacggcggagcagccaatccgcgcgcggcccatcagctgaccgcctttgcttacaccaggtgcacgccggctgcggggagcacaaagcggggcgcaccgcgggcgccggcaacgagccggtgaacgaggcgaggcccgtgcgcccgcggctgcaagcgcccgcctggcggggagaggggccgacggcgtcagcccgggcggcggcatccctaggcgcctggggcgccttcctccggacctggccgctcgctgccccgccctctgcaccccacttctccgaccctccttcccagtcctgcctccccctgccctggcctctgagagccgactgagcccagccccgtgcagcagcggttgcctgtgtcgccgcctagtctccggtcttggtgctct

SEQ ID NO: 216 - DNA, 1064 bp, Homo sapiens
ccgggtcagagacctcagcccgcgccaaggcgccccacactttccagcgcagcgggtcgcagcccggagacgccgggcgtccccacctccagcctcccgagctgcagcggcgcccgcggttctcccccgacccgccaggtggacccggactggcgcaccctgctttccgcccgggaccctcccccgagccctggctgcctccgcgccccgccccgcccggagcccgcagccggcgccccggattacctgccccggagtcacagtccgcagcccggacgctcccagggtggctccgcggagcctggagccacattcctaggggaggggtccccacctagagggtcgcggatcacgttacccgcccggaggaggagaccgcgggacacagagtaaacaaggggtaaaaagttgcatttggctcaatttttttttttaaatcgtgcttcgacgctggtggactcggggacacggcgtcctcccagttcccggagcccaacggccccggggcggtttcccagggcagaggcacctctccgggcggcgggtgcggagctggtctgcgcggcctctgaaggcgaccccggccgctcgcgggcttcctggaagcgcggccgcaggagcagaaacgctcacatccacgcgcacaaataaatccgcgagcagctccgcgccgcgccgcgggcggcaaggaaacctcgggttgattcaatgcagacgcggggcgtctgcccgggcaggaacgcggcgaggcgagaggaccgggcgtgggggcagggaggccggggcaggagaaagggagaaaaccccaaagccacgttttaaaaatgcgggtgaattttcaatgccgtcagcccgggggaggggaaggggccagctgcgggcgccggggtcggcagtccacccggggcaactttccgggcgggaggcgcggccggagggggcggcgccggcggcgggaggcgggagtcgggggccggggggagtcactttaaaggctctttcttacccataatgctttgtggggacgttgacaagtggatccaagatggcgtagaaagtaatga

SEQ ID NO: 217 - DNA, 2371 bp, Homo sapiens
atgcagccaaatttgaaaacactgctctaaaagcagagggagatatagaacagagagcacagggatatttccggggtataataaacaggacttggtggttagttatgaattggaagggacaaaaagaatggggcctgggaacaatcctaggtttctggcttgtgtctgggtgaatgaaagaagcatgctttgaggaaagaacaaactacatcttggacagcctgaatctgaggtgcctctaggaattcaagttggggatgttcaataggtatttgttttttaatagatttatttggcctagtgaagaatagaaagtccttctaatttttaggaagacaagaaagccagaagcagcatctctggaaaatattaccgttgtacagagtgtaagaccattttcattccgcacagcttctttattcaaaatcccctttcaagccagtgccccatctgtgctgaaatgttgtttaacatgttgatctattttcttttcttttttttttttttttttttttgagacggagtctcgctctgtcgcccaggctggagtgcagtggcgagatctctgctcactacaagctccgccgcccgggttcacgccatcctcctgcctcagcctcccgagtagctgggactacaggcgcccgccaccacgcccagctaattttttgtatttttagtagagacggggtttcactatgttagccaggatggtctcgatctcctgacctcgtgatccgcccgcctcggcctcccaaagtgctaggattacaggcgtgagccaccaattccggccaacatattgatatattttcaagaaggatattatatatgggtacttaacttactattcttgtgctatctgtaggcttaaagcatcccatatgtaaagtcgctggcagccttcaagtagcatttaaaggtataacagctttaaaacttcccataaatgaaaataaacatacccataattacttcctttaagattcgaggccaaagacacttaaacctaaactgcctagcttgttcaattttctaattggtaaacatttactgggttaccaaagataccaagtacattcggaaagaccatggctccttggtttgtttctaatttaaattacacagacacactaaacaaggactgggagagtgatatatttagttaagtaacagatggcaaatggacattctgtccagcctctatcacattcgtttctcagtattctatgttagagtgatctaaatcttgaagagaataaaccaggaggaaatgcaccaggcccagacggaatttgtttattcaactaagaataccaagactagtgtagattgaaacattcaaaggggatatgactggctgaaaagatatgagacgaaggaacaaataaagctggattaaagtaattaggaatgtattagagatgaaataggaattctgattacttgactgcaaaatagtaaaaaaaaaatgaaataaaagagatgaatggaagatactctccaaaccctcacgtaggcttgctattgtggctaagtactgttcctaacagcctctgcaaagacaggtgcactaagagggcggctgcagacgcacagggtgctgccgtcctctgggaaaggacatttcctcgccgagagctgcaacatcccggcacttctctccctcggcctgccaatctagcaggtgaaccctgagaacacaaaggaatgaataatgccgggcaaactgccaagagccagagtcgccgagtctggcaactcccttcaaccgggcgcagctccagccaccccgacctgtccttggaggagacgctctctgggccacggagaaccggccagggagacaccggccccactgcccggcgcgctcgaggcgaagtcccctccgccagggacaggcgtgggggccgcagtcggggccacccgggtgcagcggggcggctcctgcgcgggcgcggaacgaacgtgcgcaagggaacagccgcgtccagagccgcccgcagcgggcccggtgggcgtgacgccatgacgcacagcacgcgggcggcgcgctggggcggggcggccgggggcgggaggaagaagtgggaggaggaggaggggaaagcgggggctgcgggagggggaggtggtagttgcggcgctggttcccgggagcagccgtcgagccacaactgcggaggaggagttcgggaaagcggccgtcgggactcctcccctccgtcgtctccgccccggttgagaggcgcctcggcgcatcggagggaccctcccccgcgcttcctcaggctgctgtcgccgctgctgggagatgggcctactcgcccgccaccctgcgctgccgccgctctgaggagttaaaggtacg

SEQ ID NO: 218 - DNA, 1773 bp, Homo sapiens
tcaaaactggcctagaagtagaaaaaataatgaattaaagattattttaagttccaattcagaaagcacataaaggtcaacttatgaccacaaactaaatgttaaaagaacttaaattatgtctttcttagaccttacattttaaaatgttagaagatccttaagaaagtgttactcatcagtcttttaaattcctatatggtccaataaaccaccacttagaaaacatgcaggcacattcagaagcacaataatatgggccattaattctcaacagtctatttctgatggaatggagtacaaaactcaattggtatttatgtatgggggaaaacatccgtaaatttagtcgactctttcctaaactactactcagcctcaaaatcttttcggaggcaagctgctagcgggggaaaagaaaactgaaatgagaaaaactcatctccttgtggctgtcgaagcagaaaagctagttgacagtaatggtttagaaatgttggcagctaggatctactaccgtaaacaggttgcctcggttactatgtcacatttgaaagaacttagttaaccatggcagactggactgcgggaaactaccaaattatgtgtaacttcctatttttgtaccttaaaaagactcccttttaagaaaaagcccttaacctcattatttccttctatctgcagcattcctgctctccgcatatccctcaccgtgacatcctcgaggcttatgaagatgccgtctcccattctgtaaccctgctttagccgctacacgggcccctctttcctccccaccattttcctaaacctgccttgccccataaaaaccatcccggtgaagggcctcccctacttcccagcaaggcgcactttctctcttctgcagcagaaagatctgggccttctgcacttactgcttttagcctcctcaggggcagaggctagggacggggacagggccggagcctgggccagggcaggggctggggctggagccgaggccggagtcggagccgagtccagagccgaatccggggccggagctgggaccccagccgagtcccgggccggggtcgggacctggacctgggccacctccacctcctccttctccaggggcagcagctcctcctccgccatattctccatagttaccgcctccgtgccaagcccgcccggggacccggagcggggctcacggcggggtcagagaactgacgtgaatgcccacagggctggatccaaggagtggggaagcaagtggggagggcgggatgcgtgcaacagacaaaagatgaagaaccagtgaccaaatcctgttagtagaaaacagaaagccagaggcagcgattccagatgcccgtccgcttccctttccccgaggcgttacgacgccaccacaaactgcgcagaagcgtactggggacggcgtccaattgggtaagagggttcggtttctacggtgcgtctccggcccaccggccaaccaccaaaccgaacaaagactacagcacccaggatacactgcgcagtctgggggcggggccggagttcaagcctcggaggaagtaaatgcaaatctaagcgagcgctgtggggcggtgagtaggtagtgcggatgcgggcgcagaactacgtttcccagcaggcatacagttggtggggcggggtgtgtgtgtgtgttgggaggcgggggtccctctcctttggcttggggctccggagttgccactgccgccggcgctggtaaggtaggaactgcggggt

SEQ ID NO: 219 - DNA, 1497 bp, Homo sapiens
taagcagttttctggggtaaacgctgtaaggttttaaaatctccaaatgttccctgcatttgcactgtctacatttaggcatcaacttttactacctctaggattagtttttcctttcccaatccatgttgacaaagtgggtcataaagatccgtagatcgtttgcccagatctgccctcaatctgcgaatcagcttcctcgttttagaaaatctgaaatgtaaaagggaaaggggctgggatcgcgtggggaggaggaacgaaatggaatcccgcgtgggcaggcggctggccaggagcacattcccctagcctccctacgcgccagccccgcggcgttgggaagctcctccctgacctttccttcctcctcctcctcctcattctaggcggcagtggcgggcgaagcgtgagcgctgcggtattttgtcccgaacggtgacccctcctcccaggcaggctgcggcggcgtcggtggcagcggagcacggagaagaggcccgggcggcccggcggcctggaggccgcgaaaggtggaggccgggccgcccttgtgcaccgcaggattgacccgggaaggggcagaagctagcgagccccgcccggccgccgggaaggtgggggaagccccgtgcaccccccgccctccggccgccgccgccccgctggccctgcagccgtcgccgctgcctcgggctacagccccgggctcggcggtcccggctggggaaggagggcggcgagcgcgtccggagccgccggagatggcgggagggcactgcggcagcttccccgcggcggcggccggcagcggcgagatcgtccaactgaacgtaggggggaccaggtgagtcggcgggtagcgggcttgcagcggggatgccttggcggcctcctcctttggtgtcgacggggaccgagagtcgcaggaacgagggcgagcgtgggaggccaagcctggaggggaacgtgggggcctccaggcggcaagaacgtcgggcggattttggagctggtgaagcatctgctctgggaagggagaggcagaagggacgcttggaattaccgaggaccaggcccatgtggcagagtagctgctgtcctagaatgccaacctttgcccctcccaacaggcaaggagaaccattacacagccttccttacctcatctcagattagagtgtatttgaggactttatttagtagaaacctggctttgtggtttggatgttggagatgaacttgctttcctttctctttggtcaacgaggtgtcggttttcttagggaagagtgcggtgttcttttccgcgcctaattaggggatttgtaatttgaaagatttctgtgatgggagtgcagtaggtttgcagtacctagttatttattttcagaatttcttggtgcatgggcttgaaggatctgttcaacttctaggacagtgtgtccagaaactgcagtttgaacatttgcttttaggaagctctggatattggca

SEQ ID NO: 220 - DNA, 1187 bp, Homo sapiens
ttgccatagggaaatccatttttcggattggatatataataaatacatgagagaataaggtatgcctaaatgggacaaaccagaatccatgtaaattttgaacctcacctgcaattttgaaagtcctattaatttaaaaaatagtaaataccttaattttcatgatagcttactgtaaggctccctagaggcaatgaaaatgggaatctcaataaaacgaatactaccatacatcctggcttcagagatgaaaacagagggagaggattggctagttatcaacagaagggtaaggaaaaaaagcacagagaaagaacagacaaggcaacaaaagtggcagaactgtaagggccaatacgcatccactgcttcaagtttttcagccatgttccattctccgagatttctggtagtgcttcaagaatactggtctccaaactcttcctgaaaagggctaggaatgcttctgcctgaagatcttacctattctttctgggccccgtgatctccctacatgattgatcaacctactatttcaactctttcaagccttttcacaaatgtcaacttcagtgaggcctctatttaaaaatgagcaccctacgaaatcctttcctcatttctgattatcccctgtgaatttacatctgcctactccgtaccctcagtttatgccccttgaacactcttgccgggcgcttctcctttaaatcttgcctggaaggggcggagctatgtcccagactcaccgagaggagcgttctctaggctccgcccacttacgtctcagtgggcgccctaacgaacccgggatacggtctgttcctagtccgctccggaaatgcaactgcgtacgggctggccgcgtaatcgtgacgacagcgcgccagcgccggctagccggacgccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggtgaggttttcccaacggttgcccagttgcccggtcactaaattctgagcagct

SEQ ID NO: 221 - DNA, 2525 bp, Homo sapiens
agagatcaagtcatttgcccaaggccacagagctggtaactagtgaaactgggatgtgaacaaaatctatctgacttcagggtcattgctgtcacccacaatgcggagagtatacaaaggtttcagatgtggtacctgcctagatgccaggaagatataggtctattggcaagtcaaaacacagagtgaaaaaggaaggaataaagaaggaagggaggtggctgagcatcaaataaatggtacagtccttgctttaagacatcagagagaggagcgggcagggagggcctggctcacagcatttcaggaaactatcaggaaaagcaactcttgagctagggtttggatttgtaggggcacttcccaacctttcttacttaattggcttttaagtttacacagctgtgtgtatatctaagtttctgcctgtgtgagctacagtgttctaataaaacacaggcaatttagtaacatgatgtaaacatacagaattgtttaacaagtaccaggaaaagacatccagtaacaggaaaggacacccaaatctattttggttaccttagtaaagcagggttgccaaactatttattgcccataagctaaatctgtcatgccacctgttttttatggcctgctaagaatggtttttacgtttttcttttttctttttgtcaagatgggtcttgccatgttgtccaggctggtctcaaacttctaggctcaagtgatcctgccccctcggcctcccagagtgctaagattgtaatcacgcgtgtaggtgtaagccaccacacctggcctttcacatttttcaatggttaaataaaaaccaaaacagtaatattttgtgacttatgaaaatcatatgaaattcagttttcagtgtctgtaaataaagttttattggaacactgccgcatgcattcatttactatttcctgtggctgctaggatggcagggttgagtagctgcattacagagcctatggcttgcaaagcctaaaatatttactatctggccctttacaaagtttgctgaccctgccttaaagtgccccagataatctccaccaggcctgatacatattttttttggggggggggggggaaatatgagaatatagaaaaatacgggactatgcatcccccattcagaattgactattgctaacagtttgccatttgcctcacagccatttataagtactaaaaggaataaaactttacaacattccttatgctccctgtcccgttctgtgcttttttccttctttgtggcacactgtcatgaatttaatgtatattcttctctttgactttaaaaatcttgtatgtaagcatgtgtccatgaacagtatctactgcatgggattttaaggtacacacaaattgtacatcatgttgtattctgcaacttgctgttttactcaacattatgtttttgggatttccttatgtcagtacagatccagtgcaccccttttatctattagatggtattccatcaaacaactataatgagtttcatttatccattcctttgatgaacatataggaagttgttcccaggtggttttttttttgtgtttttgttttgttttgttttgtttttgagatggagtcttgctctgtcacccaggctggagtgcagtggcatgatctcggctcactgcaacctctgcctcccgggtttcaagcgattctcctgcctcagcctcctgagtagttgggattacaggcgcgcgccaccatgcctggctaatttttgcattttttttttaagtagagacggggtttcaccatgctggtcaggctggacttgaactcctgacttcgtgatctgcccaccttggcctcccaaagtgctgggattacaggcgtgagccactgtgcccagacttttttttttttttttgaaacagtcttggtctgtcgtccaggctggagggtagtggtgcgatctctctgcctcccggttcaagtggttctcgtgcttcagcctcctgagtagctgggattacgggcaccgccaccacaccgggctaatttttgtatttttgatagagatggggtttcaccatgctggccaggctagtctcgaacttctggcctcaagtgatctctccgcccgggcctcccaaagtgctgggatcataggcgtgagccaccatgcccggcctcaggtttttgccatttccagcaaatgcatgcacgttgagtaacatcagaagaggtggatggccgagcatgttggctcatgcctataatcccagcactttgggaggcagaggcaggaggatcacttgagcccaggagtttgagaccagcctgggcaacatagggagaactctgtctctacaaaaaatagaaaaaattagccaggtgtggtggtgtgtgcctgtagtcccagctactcaggaggctgaggctggaggatcacctgagcctggggaggtcgagggtgcagcgagccgtgatcgtgctactgcactccagcctgggcaacacagagagaccctgtctca

SEQ ID NO: 222 - DNA, 1938 bp, Homo sapiens
gtggttcagaagggatgtgtaggacaattgaagtataataacatcaagttgtttgaattaaggacagaacatactgggtagatacctgctcttacacaaggaacaatagataaagtagaaatcttagaggccttcccagaactggggtcaatcagaagtcaacacggaggattagcttccaagatggagctgctttcgcctccacatccagcaattccactcttagattccaattccactcaacagaaatggaaacataggtccataaaaaaactgtacatgactgtgtacagcagccttattcacaatagccaaaatgtggaaacaactgaaatgtccatcaactgatgaatggataaacaaaatgcaacagaatatgctccagcaatctaaaggaacgaagtactgtacagatacatgctacaacatagatgaaccttgaaagcattacgctaaatgaaagaagccagacacaaaaggccacatattgtatggctccatttatatgaaatatccagaataggcaaacccatagagacaggaaattgattattgtttgctagggctggggtttggagggtagagttaggaagagtgacagctagagggtatgggtttcttttacatgtgatgaaaatgttctcaaattgtggtgattgttgaacatatctggaaatatactaaaaatcgctgaatggtatactttaaatggttgacttgtttggtatgtgagttatatcccaataaagctgttatataaaaaaaaatcatgcgagcaattatctcaacaatcaagagactgtgttaaagattctttgcttggccaaacttcagttaggcttctgaatcttctcccaggtccttgtgtgcacttccttgtaaatgcagtgttaggaagtaacactgccacggcagtttagcaagaatcccccaccctccatatgtgatcaaaattctttactcctacccttagtatctgaccccctggcctgccttcactgggactcctgttaggttggttcagccagaatttcccccagaattgatgtttcctcttagcagttttccgaacacctgctccttgctccttggctataaatctccacttattcctggtgtatttggaatagttacgactgagttgccttcacccctttaacttccgtctttttttttttttcacaatggaggacacaaaacgttgttatttcaagtctttgtggccaacagattggtggtttatgggccagcatccctttttatgcgtaaaatatttaaaacgcagcctgcaatggttggtaaagtggtgaaacgtttagtgtgtgaggtcggatcctggtctggccgctggccctggcgatcctctgaggcggcctgagtttggggcgcctcgtgtcaccgcgcgcccctcctccgggcctgagtcacggtgccgccggagtccccacgcgaggatgctgcggtgagcgcggccgggacgccgcgtcgggctctcggccgcccagcggcgccgcaggggaagccaggccggcagccgcgcgctccccagccggccaccaatcccgccctccccggctcctccggacctcctcggcaggcggcggcggggcctgcctgtgcgctctgcgcccgcccgcgcctaccctccatggcgtttatccggaagaagcagcaggagcagcagctgcagctctactccaaggagaggtgcgcgcccagctgaagaagggcccagccgggggcctagtcggggccggtcgtggggacgccggccggagatctgagggacgggaggcggcgtgggggccgggcacggaggcaggggccggacgcgtgtccagggcctgggctgggggctgtggcggaaacctgaggtcggggtgagaggccgggggcctggtctgggccggagcctgccggggacaggaactggatgac

SEQ ID NO: 223 - DNA, 1493 bp, Homo sapiens
ttgtctttcaccttccactagagtttaagttccattagggcatttttgttctttttattcactgctgcatccccagtgcttagaataatgcctggtacataatagaggctcaatatgtatttaacaaatattaaattaatgaactgtagttatccaaatcaataaatagctttcgtttatttcgctaagagccctcggacattctgatcattcagcgtgttacctatttcaaagtagtcaagtaactgccatcttagagaagccatcttcttgtattctgtgataatagcgaacgcttattgagcacttattatgtgcaagcacggctccaaggtatcataatagtactttagggccttaggtattacaatcggagttactttccgattatatgtacattccgagatacgtataaaaagtatttgttctttatctgaacttcacatttaactgggagtcctgctcttttttttgaaacaggttcttttttttttttttttttttttttgagacagagtcttgctctgttgcccaggctggagtgcagtggcacgatcttggctcactgcaacctgtgcctcccggcttcaagcgattctcctgcctcagcgtgtgaggaaattagaatgcagggaggtgaataatttgttcgagatcttctatgtgggatgatcaatggcaaagatgggtacagaacccgcgtccttaactaaacgatggcactctgctggctcgcttttagctccttgtgttttctttctttttggtggttaacttgttttcgtcaagccctcaattatttaaaaaaaaaaaaagttcttaaggctcaaagtcaaaacctgtcaaaggccaagtgctttatttccctccagtcaaggactgggcattttgcatttgaatcctggatggcgggaagcagcaagcaggtgtcaacaggggtggggaggagacgccggaccccaccagccaatcagagcgcgcagaggcctcccttcccccgccgccgtcccgcgccaaaattccaaacgggctacgcaccgctcccaccgtctccttccgccgagctcagcgagccggaactatgtgaagaaaaagaagtcagcgttttccccaggactctccgctcaggtcctctatactgtcggcctgtgttcctctccacgttggcccggcctccttcgctctacaaatgggaggagagtttcgagcctgctgttctacggtggtggcgtgggcgggacagacggcggagggattctgggcgcgcgcgctgcggccgctggcgcggagcttgtggcgccagaattcggagcgcggaagagccagagctgcgagcgcctggagctggatctctctccggtcgcgcacgccgaggccagtagggagagaagatggtggttctccgcagcagcttggagctgcacaaccactccgcggcctcggccacgggctccttggacctgtccagtgacttcctcagtctggagcacatc

SEQ ID NO: 224 - DNA, 1491 bp, Homo sapiens
aagcagacagagaaagtgtgcagggctggggttctggcccgggcagacgggaacgcggacacatctagcactccgagtccgtcaaggcagcgcgagcgctgcgccgctggaacaagtcaccgcgaaccctaatcccacccctccttaccctattaacgacagaaagcctcgttccgctggtccctgaacaaaaactcctaccctactagtacacagcccacaacaatgcacgctgccggcgctacagcccctaagcaaccggccggaagtcggccccacctcctcctgatgtcacggaaatgaagggcttcgcagaggatgtcccgcccgctcccttcagacgggcgtagctggcaccttcctgagatatgcctgcttgcccccgatttttttctccttgcagtgagaacctcctcatgtggcatctttacttattctcttcttggaaaatccatgtgacctccccgcgcttaaagtgtttccacgttacaggcgacttaaaggcagccctggagcctgacgtataattcgagcgccgatgcagaaaggagtcaggtgtttttttttttttttttttggtttccggttctgtcacctccaggctgagccgggctggcggaagaggcacgtgcgctgctgaatggagctggtcgctggttgctacgagcaggtcctctttgggttcgctgtacacccggagcccgaggcttgcggcgaccacgaggtgagataccgcgtagttagagacagtcggaggcggggccgggaaggtcgggtttggttcctacacagcagaggtgaacattggagcgcctgctgttcactggatgatttgatgaatcaaacctaagagacttaagagaaaagctaaccttttaaaccgtagaatggacattttatcaaaatgaggcaatatctgccttttctagtagacaaaaggtccacgggacacaaaggaaaccggcatttctgcatacggacaaatgagtcgtagattgtggatttaaggatcgatcccataagttgacagtattcagaatttaatgaaagaagatctcgctcttttgctgaatttctgccctggaattttacaaattactagaactagattaggataaatcccttataggtaaagcgataccaattcattatttgttgggaacttatggcgagctgggcggtggagatgcaaagatgctggaggtatggatcttgccttagagacgttgcctacataaggggtggaggactgaggagacgcatagatggagagaaattacagcagaatatgatattactagatgtgtgaatagataaaaaggtcaaataaattatcagtagtcaaataggtagataggactatactcacgactaggaatccgacctcctaacatctagctcacttttattcttgaagcaattctaagcattttctagaaaattgagtacagtacttctttatgaagtcaaggcgtcggtctttaattatcc

SEQ ID NO: 225 - DNA, 1097 bp, Homo sapiens
ttgtgattctgtgtaccgaggacaggaactcctttaaaaaagagtggatcaaccactctcctgtaggggtcgctatgagagtagcagtctggcatccttcctttgccgcctagcaccttgtggcatgacttggcacaatttgcctaagggttgtgagatctggcttgttttggtattttatttttcagaatggtatgagctctaagtccaccaaaaattctgcaagctcataactatgcattcttttactttggttctgtgtatgctgcatatgctgcacctgtgctttttttttttaaccacatatttggtgcgtggttattttagacttctcatcatactccatttgcatatgacaaatatatacacgtagacaccattttagcagcttttgcagcatgcatgatggtggctgaaacttggccttctataggatcccagattattatttaatggggttgtcactcaggacacttactggctttctccagtgctcttaaaaaattgaattgagcatgatgaggtgcatccccttgattaaatgtttttcctcctatgcaatcaccattagctgtttggctcccattctgtattcttctgaagcagccctgcattgcaaatcaatatctttctgaaaagacagtgtgttgtgaattgccttgacagcatatgcacggttactttggctgcaatgctgctgcagagcccggttactctgccttcgtgggaactccacaggcaagtccatcgtgtttggaaaaaaaaattagattttttggagaaaataattgagctgttaaagctattgatactgaatgttagcatgtcctttgagttcttctcaacagtttttggtcttattccactgagattagcttctcttaggggatttctgggcttttttttttttgcttgcttatgcatccccctctcttggttgtagtacggccgtaccatttcagcttgctagtgcagaaagatgtgaattcagttgctgtatgagcctggcctggtgcaaacacattgctagagacatgttaaagagttccaggtgaatcaagcctgagggagacaacagcaaaacggtaagacagagc

SEQ ID NO: 226 - DNA, 2204 bp, Homo sapiens
tatggcaagggccatataagaaagtacagtttgaaattctggaagcacaacaaagtgaataacaccagctaacacgtgcaagtgcttgctatgtactacacgccattacaaagtccttacctatgttacccccatttaatactctcaacaaatctacagggtaggtaatattattgcccctatttccctgtaaactaaggcacaggcaggtcaagtaatttggtcagtgtcacatggctagcaagtaccagtaaacgattattttgttggtaagtatatgagagggcttcctggaatagagaaaatgaaattctaaacccaacacaagatctactaaattagaatctctaaggttggactcataactttaacgagtttcctaaagtgatttctgcacacactggagtgtgaagagccattacctaaaggaattaaaagttttccaaaatgaagaaaaattgtgcaaagaacaatgtcaaaaggtaaaaatgatcatcaaaaatacttaatgaagttttatatttagtctaaaagactgggaaggaagatgagaataaaatttgggttcccaaatgcaaaacaggcttatacaggaagaaataacctttgtatagtcatagtgtttcttaaagaacagaatagcaaaaataaaaacataggacacattgggctcaagtacccacagtgtgttattttctacctctatgttggcctatgtagacatttgtcccttaaaattatcttaaacttgagaccatcctggccaacacggtgaaactccacctctactaaaaataaaaaaattagctgggcgtggtggcatgcacctgtggtcccagctactcaggaggctgaggcagaagaatcgctagaacccaggaggcggaggttgcagtgagctgagatcgcgccacttcagtccagcctggagacagagcgaaattcctactcaaaaaaaaaaaaaaaaaaaaaaaaattcttaaactactacttatccggagaaaaacaaggtattttaagactgggaagggaaagaatcttccttcaatggttttggaaatgaaaacaccatttaaattcaaggaaataagttaattgctgatagattattagcagagtattttcatgtagatgtaaaatgttattttgttctctgaaatagtatgtgatctatatacacttacttttataataatacttcattacaaaaattggactagggagaaggaggagacactataggtacaatgccatttggctacactgaaatctttcccaggcaatttcataggactatcaccagctattgagccttcttccccattactcactggtctaattggggagaagaggaattgcaaagagggcagaagaaagagtctgttctagtaggaggttattggtagatcagacttgctatgtcccctttagcctgctaaattttctcatcattgttaccagattcattgtgacagttacaggcaaatttcatgtgttgttggaaaaacgctcacaagtaatacgctagtttatttctgattaataagactgtttactatatttccattctacgggtacacatttaaacaatccattatttataatgaaattatagtgatactttttatatggttcccttttaataccaggttaaatactctagagatttagggaattaatggaccgtcatccaaatgacctcaaattaagttaaatgacataaaacataggtggagggttttggaattgaaagtaaggattggaaaccccaaattttacactatacaaaagaccaggggcaaggaggcgctttaagtattttagattatatactgacaaaactcacccctcccaacaaacctgctgaacaggtgtttggagtcaaatgcttgacttaatcatattagtgaagattaggaagaagctttaaaatcccaaggctagtgtgcattgctagaattgttaagagagagagctcatatgaaattggttatcgtgggatatttaaaataaaacaaagaacagtttactttgtaagttaagagctgagggaattgttggctaagactgacttgaaataactccagcaattcatgcatagctgctaaccttctacatcttcagcaggcaaaaagatgccagtaatcaatattgaggacctgacagaaaaggacaaattgaagatggaagttgaccagctcaag

SEQ ID NO: 227 - DNA, 1786 bp, Homo sapiens
tgaagaggctcaacctaaagtggctggaactttgcttataaaataatatattacatttggttactaaaacactaggtttcctttaattgaagaatcccagtttgagtgtttctcaagtacagtgagtttcaaaggatagtggtagctagtagtattagtgaaaatagtcataactagcatttattgaatattatttgccaaaacgtgcctaacaattttacatgtattatctcatttaaccagcacaagcaaccctatgagaggtgaattattgttatccaaatttaaagatgaggaaaatgaagctcagaaatgtgaaatgacctttttagtattacacggaagatctgggactcaaaattaacaggctattatcaagaacatttatgaagggaccacattatatatgacagcgttggatgtccagtgaattttgcatgatacggagttgaattagtccctggcttcaaggactttcctttctcttttatcccttctattctgttcacacttttcttctagatactggaactataagcccaaaactacttaacatgaaagactttaggtacacgattccccactggcagctgctttaatggtgaaggatttcttgagtactagcagaaaacataatatataaagagagttgtgtgctagacaaatggactaagaaaccatgatttcttggggttttgttcttgctattttcaagctaaaatgcacccctgggattgcagatggtcataagaaaaattatcaagtgaaaagttaaccactgccaaactcatatgattgaaaattggccattgttatgtttagaatattttttgtgcatttgcaattaagaataaaaagtcagaatttaaaaatgaaaaaaagaaaagaaaaagccacttcaccaaacatttcctaaaattcacagattcccaggggtttgaagacagtattcccaatttggaatgtagtcctgactatcccaaggatcttggaatctcagggttagaagggatcttaaaaatcacccattttaacctcccctcaatgcaggaattctctctaaagcctcctcaacaggcggccaacccccatatccgcctgaatgcttccagagaaggcgagtcgaatcctttgttggacagccctgattgtttttcctgatgttggtgatgggccttgagaaaaagaaaaaaagaaaaaaaaaatctcagaacaattggcccatttagcaaacctcttgcctgtgaaacatggggctatttccatggtgcagctttaaagtactcaggaatgtatagggttaaaaaaaaatcaccatcagctgacgggtattcctgcacgctcccttccaaatactgatacccactctcacactagcctgccaagattccacttagcagctggtccccagttacatctcttcagttgacttcccaagcaagcctcccagaggcatatgtgaatgatgatgcacacacacaaatatttgttaatgaccatgggtttgggaaggtgttagtcatggctagcatcataccctttacagaagaatagagaggctgttgcagccccgtgctttctcctgctgctggccgattgcttgctctgaactaaccctctaacccttgggagtctgtgtgcagcagtgatgtgagctgcatccgggctgaaatgggagctcccgctatggcactggctcaaggagctaatctaaagagaaagtattttggggaagacatcttggttgcacccctcattgcatcttgactaattgcttccaactccg

SEQ ID NO: 228 - DNA, 1487 bp, Homo sapiens
cctctggaaaattccattgtgagtttaaaaggcaaatgacgtctataattctaaaactagttctcccaccgaaactctagaaaggatcttgggatctgcagggtctcccggatcacactttgagaactgctgctttagtcttcctcccatctcctaaggccagagctcctgagtttgcttcccactggccaaggagaaaagagcaaggtcacttgtcggggggctgcagagggaattaccttctttcatttgcaaatgttactgggggacacaccggctcccagtagggtttccgccaaggctccgcgaaacgccactagagggcgccgctagcgaatcccacagcgcgccccgctgcccccacttttgtcctccgggttcacacgggcgcccggaagagagggtggtgcctgggagaggaaacgatgcgccccggggccgcggcctcattggatgagaggtcccacctcacggcccgaggcggggcttctttgcgcttaaaagccgagccgggccaatgttcaaatgcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagagtggggtgattcacgtcttgaggtctcggccggtgtgagagcccagcctgttcccctttctgcgcccatccccggctcggccgccaccccgcccgcccgccccattccgttcccctgagctggccgggccggagcctcattttgttttctacttttttctctcctatgtgcatccccccaggagctggctaaatatgaatacatggaagaacaagtaatcttaactgaaaaaggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagc

SEQ ID NO: 229 - DNA, 1012 bp, Homo sapiens
ggacgttttaatatgtcagggcagtcacatatattaacaacccttccaaaaattccaggtaggctcagggaggataggtaacttgtcattaacgctagaaagttagtgtagtctggcattgtccctaaccgaggttctaaagctcaggctcctttcagaacactactgttaaagggaagccccaaagagtcgggggaggggactaagttttgactggatgtgtctcggttgccgtggagggaacaagaggtcagaaaagccatttggaggcagcgtgtgcgatgggactataaggatgaaccggagattgagtgggaaccagtggagggaagagggagggacttttcaggctaaggaagtaataagagcaattagctgctctcataattcttgagtcaagcagttaatgtaggtagaaaacctggcgtccgcccccccaccaccccccaccggaacttttccgttggagcttgtaggtgttcgccaatttcaccattaggtgtgttagttttgtaacctgaaggaaaaaaaaaactcatgttttaatagcagtggattcctcggacggagggtgggggtcaggccaggagcctctggcacactccgtctctcctacccctcagctcggccgccacctgtgagccgttgatgtgcgggaagggcgctctctacggcgggatcctcgctggtaggaggcaggtcccaggcctggcaagggttgaccccggagggctgggccggggcggcaccccaggagcacctgcccacgaggcggctgcgcggacagacgttccagcccctcccgcctcgccgtgtgtttacgtggagacgaagatggcggcggcggcggcggtgacggcgcttcccgtgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccac

SEQ ID NO: 230 - DNA, 972 bp, Homo sapiens
ctggcgctactggagactctaacccgagacctgggccccacgctgctggttcatggggtcactccagtcacctgcactgatctgtgatgcccctgcctccagggctaggtagagagggcccaggcaggcggcctatcctgatccttggaggaggaggaagaggaggccactgtggcccgtggccctgcccttgggacgtggagcccaggggaggtttgaaggggatcctgggcttgggcatcacgcccacctcctttggcagagggaccccagcacactaactctgggtggctgtccccaccgtgcaggggagggagtccgcagcctcccttcactggtgccttgatgctaggggccaggcctcctctgtgactctgggctacctcagtttccccattttggccagactcaccggcccactggggtggtgatgttttcgttctgttttatttttctaactctgctgaccatgaataaaagaccaaaacactacaggctggctgagcagtgctggtgggtagctgagagggagggggtgggaatggagagctctgcagaggggtggagatcggagccttcagcctcccgccgcgaggctgccacgtgcagggctggggtgcggggcccggacgcatccgtggacttggaggctggctcgggcccgcacctcccatccccagctgcccgcaacccccagtgactcgggatcccccggagagccctcccctctcggcaggagggggctgactcagggagaaatggcagtttagggcctagggggccacgtgaccctcccccaggaatgtggtgacgtcatcggaggcgtggtcgtccccaaaattagggaggaagaggaaaaaaaaaagccagaaaaagttttcttttctggagtcccaaacgaggtgcgggacggaagagggggtgaaggccagaggctcggggcttcaagaccgctgtctggagtcccccttt

SEQ ID NO: 231 - DNA, 857 bp, Homo sapiens
acgcgtactaaccccaaggctttagtaggggcgccatcacttccggtagcttgtacttctgcgcgtgcgccacagctttgactcattacgtggcgtttccttggagacaagaaagcttttcgccatgttttataggggcaaaaccacttccggcctcagtgtggaggtgtaaatcttgtgggagccacgaaatgggtcattttaaagatgtggtcacggtgttcttacaagaaatcttattttcctttggtccttgtgaagatgctgtgatcacaaaggcagcccctggagcttctccgggcagaagaggaggtgggctggactgtcaaagaaagtggctggcttccgtgggcaatccgaggttcctagtggccctctgcagaaagctgaactcccagttcccccaggcctccgtcccgcggcggactcctaggcttcctccctccctgtcgccgccagcctctcgctctccccgtcttccgcccgcactctctgggcagggctgcggccaggacccgcccccgcgtcccgcccgaccctccgccaggggtcacttcccctgtccaggtttcagcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctccccgcggcggccgcacagcagcccgagcgccccctttccagagctcccctccggagctgggatccaggcgcgtagcggagatcccaggatc

SEQ ID NO: 232 - DNA, 1050 bp, Homo sapiens
cccatcactctgaggaagacacttgagcctctcactcttgctccctagaacccaggcaagctcctaaatctgcgaagtgcacccaacgatctgagacctgaaaggtgacagataccaacccaggtgcccatacagataggcaggaagcatcaacgggaagccactagtcagagtctagagtccccgctgcacccctttctgcagagacaatactttgcaccacattacagggacgcggcgggcttctccatcggacccagatttggggagtgttgggaaagaattccagggtacgtcgtaagtccctcaggtgaaatggcttttcctccatcacccaccccccacgtcattcagcaagcaggctccagggagaagtgggctggggctgaaactgagcatccagagatagaagatggagtgggacgtgggcacggagggggaatgtcccagggctgcaggggcccagccaaggaaccggggcactgagaaaggggtctcggaggagcctggaccctcaggggacggagagacggggacaactctggcgatcaggaatgcacgagcgaagggggagacagcttgtgccttccgagacagggtaggagtcttggggacaggatgcgggaaggacgggagcaggggcaaggccagggtcaggatgggaaggacggggcggggtaggggtcgggatagaaaggatgcaagggaacccgggtcgggatggaagaacccagggagaccgaggccgccgaggcagaagcagagcggagacagtcgcggacagtacctctccggagctggccatgtcgccggcgggtccgaaccgcggccgcgggatccgcaaccccgtgcctcccacctgcccggctagggatgctcgaagccggcgcgtccaccgctcaaccgagaccccggcaaggagcgggctctcgtcacttccggcgcccgcctacacgcacttccgttcgtccgcaggcgggccctaggcggccgccatgttgaatgtggctccgcccggggagctgctggagtacgagggagccaagaagg

SEQ ID NO: 233 - DNA, 1097 bp, Homo sapiens
gctctgaaattcgtgttttgcttaacttctttgagtttcaggggcttttcatgcttccagtaggaatgacagccacttcgtggctcttttaggagcattaagtaaactttatcgggcaacactgacagccccgtcatagtcaccgcgacggccagctcacccggtagctctcgaaggcctcgtcgatgggtgccatggcgtgagtctggtgctcctgggactccctgcacaccaggcacactggccgctggtcgtcctcgcagaagagccgcagcggctcccagtggcggccgcacaggcccgggggcacggggcccaggcgccggcgctgcgtcttctcagtcagcctggccagggcccagttgggtcgcagcgcggcgggcgccgatgggtgccgacattcggggcaggggaacgggccgccgcccggcgcccagttgcggtgcaggcagccgcggcagaagttgtggccgcactcgatggacaccgggtcctggaaatagtccaggcagatggggcaggtcaactcctcctggatgtcctcagcttccatgctgcttccctgccgcggagacggagtccgacgtgaggcgcgggagaggccagcaagctgcgagcggccgcggggaggccagacgacttccgaaccgccgtcaccgcctcacgtaaaagggtacaacgcagtttctcttccggggttcaggacccaaaaagaacgcacggacgttgcccggcctgagcgcgcaagaccggaagctgctgggtatccgcgccggaaccgcgagggggttggttcaggcctaggcgcggggcaggacgggaccggtgagtggctcctccaaacagctatagagacccagaaatgcctgtggaaagctacagaggacttgggcaaggcgttagagccggacgttgtggtccctgggggagccaaccggggaggtgcctatgatctttctttccaagtttgagggttcaggtctgtgttcgcctgctggttagaccgatttaagttttagagtcccaggagttctgggcgagctgcagcctaggggcctggaaggccaggaagacttgaaggatctgtgttggtaggc

SEQ ID NO: 234 - DNA, 1091 bp, Homo sapiens
cctcatctcccaccatactgaacacgcattaggtgctcaatgaatacttgtccattttagtgaagattaagaggaatgagacggaaactgacacttgagaggctggcacacgccagaactgcaccacactttgcactcatagctcatttactcatcagcttgtggtcaggtaggcattaccgtccccattagagaagtcaacggaggctcagcaaggacggccagggtcccccagaaagtagaggaggacttcaggtttaaccaaaagcctgtactctttacacatgtaccccatgccttctccaccaaagctcctggcaccgtgctttgcagacagacgacgctcaacacattttgagcagaagcgtggttcagcaccaggaaggacaccaacttttgcagagacgactcttgggatggagaaagacttcccaaatcttcagggtgcggtcaagacagggtaggctagcgccaggggagctagtggctaggccccagggcagctggggccgaggccgagcaaacggccaggggagaggctcccaggagcccgatctgccgctgggcgacgcgaagcctggcggctagagtcccgggcagcccgagcacggcgggaaggcggcagcaacaggatcggcagggatggcggggacgggggaggtccatgtgcaggggcgtgccgccggtgacgcacttccgccctgcctgttccggcttaaaggggccccagacaatcctcgcaataacaacaaaaccggcgcgccagcggtggcgcaacggctctcgtccccgccctcctgctacctgtagtcgcctgggccgcccccggcccagccctgccttgccgccaccctgcgctgtccagactgaggggtcaggcggagagccgggccgcgccttcggtcagcttctctccctttcacccgcgcctcctcgcgagacccggggctgggccgtgccggtcgccgcgcagcaggaagggagcggctgccacggaaaacgcctggccggacggtgtggctggcggccctgcctgggcgcggagggcggcggtggcgggccccgcggccttctctcaggtaccccagtgc

SEQ ID NO: 235 - DNA, 1083 bp, Homo sapiens
cacagtgcaacgacttcaatctcgccaagacctctggcttgagttaagccaggaaaacagataccactctagacatctcaagcatgaaagaatatagctccagggaaggccaagtcctcacgaagggatgcagagctcggtggtaaagagcaccgttttctaagaatttgctttcaacaaaaattgggaacgcccaatcaagttattcgctgacacaaattaaaagagattgatacatcagtatgtgattttggcatttaagtccaaagaattgaatgacattgctactcctccttcacacgggtgcctccgagggtccccgctaaggcctctccctctccaccctatgggcagctgacctgccgggggcctcacctgctggaggagcaactgcaggagaagcacctgttaggggccgcacctggccggaggggctcctgcgggggaagcacctgcccagggtgcacctaccgtgtgcaggctgcggaccacccggacaggtgccccctcggcagggagggcggtcacgggggccggccaggtcggggtggggtcctcccggggatccagacacggccctgtggcctctccccgccccaagcctttcctttctctccccctctctctcttcctctccttcctccttcccacaacaccgcccgctcgcagcgccccgccctctcctggaccgcgcactccctccgcggaggccccaggacgcgcacgagcgcgcagtggacgtcggcgcgcggaccgggcatgggttccccagctgtggcgccccgcgtgcgcgttccgtagtgcccggtagggcactgggcttagctgctcgaggccgcgccctaagaggcggggcatagacaggaagaagactggcgggcatgtgggcggggcatgatctggaggcggggcgggccgggcgtgtgggcgaggcccgaggctcgcggcgccccagctctcgcgagagcggcgcctgatgacgaccgggagggcggggcccgtctggggcgccggcgggtgcgtttgaatctggtccgagcgcgggaaacggcgggtccccgagcccaggtaagagctgcggtg

SEQ ID NO: 236 - DNA, 1061 bp, Homo sapiens
aagaccaaaacactacaggctggctgagcagtgctggtgggtagctgagagggagggggtgggaatggagagctctgcagaggggtggagatcggagccttcagcctcccgccgcgaggctgccacgtgcagggctggggtgcggggcccggacgcatccgtggacttggaggctggctcgggcccgcacctcccatccccagctgcccgcaacccccagtgactcgggatcccccggagagccctcccctctcggcaggagggggctgactcagggagaaatggcagtttagggcctagggggccacgtgaccctcccccaggaatgtggtgacgtcatcggaggcgtggtcgtccccaaaattagggaggaagaggaaaaaaaaaagccagaaaaagttttcttttctggagtcccaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcaggtaaggcagcccttgtgagacagaagagccacccagctgtggcgctcacctctgtcctaccgctccagcctcccgccctggctgcttcctcctgccccttccccaagccgaggcggggggaacagccgcctgcgctctcttgggaccctagatttgggggaggaggtaacgagaggcggagagggtggctcctcaaatatacacccctcctgtcctccgccaccccacctttgatttctcttccctcaacccagcactccagccccaccccagggtcaatttttgcccccttccatctgagcagtgttaccaggccccagggggaccggaggatcgggggccggcgtgggtggggtcccatggagtactccagcacacgcaggtgagacccgggatcgtggggtgggacatgtgggatcccccagaaccgagtctgagggacccaggaca

SEQ ID NO: 237 - DNA, 1063 bp, Homo sapiens
tccgaatcctaagaatgcaaaagatgggccgggtgtggtggctcatgcctgtaatcccagcgctttgggaggccgaggcaggcagatcacctgaggtcgggaggttgagaccagactgaccaacaacggagaaaccccgtctctacttaaaaatgcaaagttagccgtgcgtggtggcccatgcctgtattcccagctactcgggaggctgaggcaggagaaccacttgatccctggaggcggaagttgcggtgagcggagattgcgccattgcacaccagcccgggccacaagagcgaaactccgtctcaaaaaaaaaagcaaaagatactaccaagccctgcggagcaaggtacctcacacttcatgagcgagttaagatgggtttcacaatttttcaagcaaggaaacgggctcggaggtcttgaacacctgctacccaatagcagaacagctactggaactaaaatcctctgatttcaaataacagccccgcccactaccactaagtgaagtcatccacaaccacacaccgaccactctaagcttttgtaagatcggctcgctttggggaacaggtcttgagagaacatcccttttaaggtcagaacaaaggtatttcataggtcccaggtcgtgtcccgagggcgcccacccaaacatgagctggagcaaaaagaaagggatgggggacttggagtaggcataggggcggcccctccaagcagggtggcctgggactcttaagggtcagcgagaagagaacacacactccagctcccgctttattcggtcagatactgacggttgggatgcctgacaaggaatttcctttcgccacactgagaaatacccgcagcggcccacccaggcctgacttccgggtggtgcgtgtgctgcgtgtcgcgtcacggcgtcacgtggccagcgcgggcttgtggcgcgagcttctgaaactaggcggcagaggcggagccgctgtggcactgctgcgcctctgctgcgcctcgggtgtcttttgcggcggtgggtcgccgccgggagaagcgtgaggggacagatt

SEQ ID NO: 238 - DNA, 994 bp, Homo sapiens
tcagtgtgcaaaggataacatgagtaaggattttttgggaaatttttcacctaataggaagaatgctttactcttttatttatcaaaccttcctcatcattaaatggattcagtagtactttttggtaataactcgtgtgtgtgtgtatgtgtgtaataaagtactttgtatatgttcattgtgttctttttttaataagctgttttaatgaaaaagacacaattaccgtcaccattgcccactatataatgacaagtaggggaggggaggctaaaagagcttctacatagtgagagatcttccattgttatacctacgcttgcactttatttcattttcttccacgtttggacaggtcgagattaaatgtgattacatttccgttgagaggcttttattcagcaacaggattcaaaagaatgtcaatgagcataaaataaaaacggtgtgcaatttatatgaaactctgatttaaatggtcctaaccaaaaaaaaaaaaaaagaaagaaagaaaagaagctatttaaagtaaccctcccaaggggagtcaactgctcttcagtgtgccctgagccggctgtgccttctctccatccgctgctcagatattcatgaaccgttgcttcttccagcctcgccttctcgctccctctgcctttctggcgctgttctccctccctccctctggcttctgctctttcttactccttctctcagctgcttaactacagctcccactggaacttgcacaatcaaaaacaactctcctctctcaagccgcctccaggagcgcatcacctggagaagagcgactcgctccccgcgccggccgcggaagagcagccaggtagctgggggcggggaggcgtacccttctcccgctcggtaagagccacagcatctccccggagattggccgtatcccaccgtccggcccccagggtcctgcagcggtgatgcatatgtttcggagcaatgatggaaggagaaaag

SEQ ID NO: 239 - DNA, 931 bp, Homo sapiens
cagatcccaatgacaaaacaacaaaaaacttcagggcaggatatgccgtttattgatttaattatttcatcagttctgtatacatatttattgaataaacatttcaaaaataagggataggaaaaaagtcatttggaagtagaaaagaatgtttcaaattacttatctaaaatggcttcttacagttgtcatatattcttttaaggacttgagatgtgtatttcagagtaatgtgtcataaatcagcgtgatttttagaaaatatattctgtatcatccttcaacaatacctcagataacttctttggtactttactcaggtaaatctctacatgaagctaatagcaaaaggctactatttctggtaattctgataaaagtttctatgtcttaatttctatataatctaagtggttacaagcagctatctaaaattacgtaaaacaagctgtgcaatactggctcatcgctaattaacagaataatgtcggacaaatcacttatcagttttctaatatgcataatgcgagttagtacagcacttcattgcaagatcagaaatgaaagcatttttacataagagacactacagaaataatgcgaactgtaatgctattatgacggtttgcctagtggtgaatgattaaacatttaaaaagtttactttcatcttagatcattccatcggaaagaggtcgaaaatgtacagtaggcatgcacaaaggataccgcctggaaagaaggtaaaactggaaaacaggagggaggcggggcccaattttggcttctccttccgtctccgcccctcgaacgccggcctgcgagtgacgtcacgcgagacttgtacttccgcttccggtaactcacgtttctctttcttcctgtctgcttggaaagatggcgtcccgcaaggaaggtaccggctctactg

SEQ ID NO: 240 - DNA, 1091 bp, Homo sapiens
accgatcttataccttcaagggcagtttaaagattctgctaaaaattagtatgtatctccatcaatattttgaaatatttataactggtggtaagaatagccttcctacatgggatagtcaggttaagattagaaataaccaagcgtatcctctaagatagttttttaaatgtttaaacttacctttaagggaaataagtgggggctgactcacggaaagaggggatagaaggtagggaaagggcgaaggctagagttaagtgaagaatcccgtacgtagagtgacatcatagaggacttttggctggtgaaaagaccagtcgggaatatagccaatatatatcaaccttgccactcatataacttaaaaccgactgcatatgtatccccgtatttcttcttcaaaacactactaacaaataataaatcaccgcccatataagcaatctgcgactctaatacgggtgctaatttatttgttcaggtggtctacaaacgttctgttctgcctgtctattaaatttccacacgtactaggcgctcacatgggataacctgatgcttacaaagcggattaaactcagtggcaaatgttatctgggtattcgtttacacacggagacacccctaaaggatcgcacctgcttgggtcataagaaacagaaaaatgcaaaaactaaggtaattccaaaagacagaaaacgcagaacgcttctttatctgcagaatgtaccgttctcggacggctcaacgtaccaggctcccagcaactaagtcaagatgcctccaactcgagagacaggaccgtcagccactcagttagcagctatcttcttctaattcctattgtactagatgagcgcaatgaggcgggctcttagccgacaaccaaccaattgagtattgtatggaaccggaagagactctggtcctggaattcttgggtattctctatggttccagggtcaagcggcgctaagagaaggcgggacagaggaatgggaaatgacgtgaggagtgcggaggggcgcgaggtttcaagatggcggtagctgaggggttgaccgagagacccagttgaaggcctttac

SEQ ID NO: 241 - DNA, 1090 bp, Homo sapiens
acaattcacctgttgaccgacttctaataggtgaaagattaatctccaaataagtttttaaagaccccagatgctctgtgataattatatacatacatacatacacacagatatacgtacatacacacatatacatacatatacattgtgctactatatgtacggacgcaatatatatacataaaactcggtgttctcagtaaagtatgagccattattcatttaaatactagatatttttcctttttttttaaacaaggagtattttttgaacctaaacctgaacctctaaatagttcggataacaaagttttggaatcatgaactcaacattgttaacaaaccatccagtccaaataaacaaaggaaacccacatctcatttgccaagattctaagaaccataatcctgtcaccaaatgacaatggagacttgatcctttctcagtcctaaatacaaacagcaaagccctctttggtcctcatacctactcgaaattgcaaagcaaggcctgggaaaaacggtgaagaggcaccacttactacaagcagtccgagtagctgtgactgcgaccaccccaatcctggttccaaacagcatccttcccggttctcttcttaaggagcagagtctttcgtcccttcgccccaaatcgctcaagtcattcctaggaaatcccgagaaacacttcacctcacctgtcaaattgcacaaaatccactttcgaatttctcccgcgaaacaacgtgacgtcattaacgcgggacctcaccagatgaggacccaaaacttggcccgcccacctccgcctaagccaaaaaccgccgctttcaaatcgccaatcaaattcttccttggcttcgagtctctcagccggccgcgctctccgatgcccagccctcctggaaccacctcgcctgtgacgtaggtggagcgcgcactgcctccgggcccgtctttctcaattgggaccggaaaacgttgtcgctcatcctatgacgcgaaagtaaccgagactatcaggatccggagacggaaatgtccgaaggccgcagtacttgaccctgtattttgggagtcgaacggagta

SEQ ID NO: 242 - DNA, 1090 bp, Homo sapiens
ttatgcaacgtcaaggacctgtaaatttaaatacacttctctgtaatctggttcacttcagagtacaaattcattgaacaaaaaaatgccttcatcgccatatgcattcacatgaagccacatgggataaatgcatttccactttaaaaagtatctactttggttcagaaatgcccatttaagaaaaacctacactgagataaagtggacatttttcttttaaaactacgtgacaggattccctcttgacctcacgtttctccccgccacgtatttaaatttggggcaaaatttctgattaaatgactgatcaaagtaatggggagaattcttcaacgccggccaaaagtgcttagtctcaaacgctgtgagggagcatttcctaagctttgggcgactcgttaacggaatcttaagggcaaggtccaaccacactcagaatcagcaggaaaatgaccgtttggtaaaactcaattacacccagtaggcacctccccaggcccgaaacagcactcgccctttctgctcagctagcgcgggacatcgcaacgcccaaggccctcctatctcaaaggcgcttgcgcaaaatctccccacagactcaattaaacccttccttaggccggtcgaggcgaatggttttgaaattactgtcgggttacgcctcactttaaaaaacagtaggtatgacacagcacaccagaacgaccactcaccgaggtggtcctaaattcaaacgacagatttaagcttcctctcgtgatttatctcgcgctgccggaagcggaactacccgggtcctttagagggcagtcctttggggaaccttggaaccacggtcagaaaggttaggactgatcatttggctcttgccggaaatcgttccgcccggtgaggtttcggcgtgagacccgaggagggcggggaagaggcgtgacggagattcctgaggtgtagtagcctgaggttcccttatgtggccctatagctgttactgaaggaagtagcctacgtccacgcctacaactgaagtctcttgacaaacacctcacccctgcctccgggatgaaagggggtaacctagacctga

SEQ ID NO: 243 - DNA, 1031 bp, Homo sapiens
ccaaatgtgttcacagaccaaaactgggggaaaagcagggtagtttcctggtaagacgaacagcacatgacaaggcagagatattaaaaagtaaggtacgcttccaggacgagttcattattcctgaagggagaaggcaataagggtggaaaaactgggccgagaggggaatccaggttggtgatgcccctggagggcaggtaattcttactaatttctgtattttctgctgctggcacaaaacgtgacccatacgtttgcaacaaatggtgaaataattcattcctgttgttaagcaatagggttgtagaaatatttgagcagtaaacatgctacagtgaaaggattctcggatttggagtcaggagacctgaagcactcttttgactaatgacctgtgtttttttactggttttacaacttacctgctgcctggccttaccaaagtactgatatattgagtctcttgacccataaaacaggggtaacaactaacaagcgattattaaagagttggcgctagtaaagtacgcaataaaaacagcggctgcagctgctaaattctcctttaggtctttttccatacttgcgaaatgacagggcaacaaatttccttccaaccaccactgagaaagtataccacgtttgcccaaggacaaaaaggccccgcccggcccgcgccacacaggtcacctacgcagaatgcagtcctggggggttccacttgtgtcgctcagcgatggagggcgcgatcgatgacaggccactccagagacggacctagataggttcgcatgaggccgagccgaatttcaccaaaaaccagtttacaccacctcccgatttgtccacacgaaaagccatggaatagctgagggaaaggaaaccggaagtagcgtgggccgtgaggaacgggaaatgacctcagcacgtcggaagtgtactcgtttccaaggcgacggccctgctgcctctccagccaagtggctggagtcgggaggctggaaagagactccgagaaagtaccagcg

SEQ ID NO: 244 - DNA, 1098 bp, Homo sapiens
tacagccaggagcttaggatgactggttccattctttattcacaatagcaatttatttgtggtattgtagtggaaagggcacgtttcctaagttacaaatgtggtttggaatcccaccttccactagttgtgggatgatacacacatttagtgagtatttacttgtaaaatggtaatacttaaaacaccaccccatcctcgtagctgaatctccacccatagtttgtaacttgaggttttccttctttcctactccttcatttcccagtatagtagcttacctattcaattcccgttgaatgacttccagctcagtgagttcgtaattttacttcttagtgtcatgagccactgggatttgtcccaatttcccattttgtatagttcctcacggctcagtttcgaaggcaaggtttccttaatggccaggatcccccttatctcaggtgcagtggcaattcttggctggaaactaaaagatggagttgagtaaaacagtaaacggtgtatcatagatttttataggaaatggcgttagttaagtaatgggcctaaagttggtgactcaggataagtaaatgaaagtattccactcaccttttcatacagaggactacactgaaagattttgcagagggttgtatgtacgtctaaacacctggcacctagtaggtgcatgtcactttggtaaatgaaagaactgaaaaactgcctcaagacacccacatacggccaacgcccgctagcctttcttcctcccacagccccactcacgtgggcctccaaacagcatttattggccggcttcgcgccacgagacgcgatggacgtgatcgccgccctcatcttctgcggcgaacttctagcgggtgacgctgtccaatcggaaagcgcctttccgccggctgggccctccgtctacccccagcggcgaggggcggggccggcgcgggcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttac

SEQ ID NO: 245 - DNA, 1011 bp, Homo sapiens
acaagtttcctgcacatccctaattttttaggcgccatattcctcactcagtactaacaaagtgtatgtggcttctccttagccagactcgattacaagcactgcatgcattactcagtgtgataagatcatgataatccctttaaaaagatcgcccgaatttaagcctggattaggaacacgtgtttacagctctaatatcgataatttaagtggctcttaaaagagcctttggggttgggctttaagacgcttacttggcaagtttacttagcgctggtgtacttggtgacggccttggtgccctcggacacggcgtgcttggccaactccccgggcagcagcaggcgcacggccgtctggatctccctggaggtgatggtcgagcgcttgttgtaatgcgccaggcgggaagcctcacccgcgatgcgttcgaagatgtcgttgacgaaggagttcatgattcccatggccttagaggagatgccggtgtcggggtggacctgcttcagcaccttgtacacgtatacggagtagctctccttgcggctgcgcttgcgcttcttgccgtccttcttctgcgccttagtcacggctttcttcgagcccttcttgggcgcgggagcggacttcgctggttccggcatgttgaaggcgaactacgagcctgagacgagcagcagatcgagaaaacgggaagtaatgggagcaaggtaccaggagtcgtttttatataggacctctcatgcaaataaggtgaagagtgaaagtcctgtatctgattggtggttattagggtgacgtcagaggttagttatacccaatcaacccaatctgcaaatccaaaagacgtacttccattggttaaaactaagctacaaccctaaccaatgacatatcttctttttcgcgcccaatagtgtttataaaaggcgctgcctttcctcgttggctactttcagtaagttgtgaccagtatgtctggacgtggcaagcaaggcggtaaagctc

SEQ ID NO: 246 - DNA, 1099 bp, Homo sapiens
tccactcttttgacttgtgggatagtattatttctacttctcaaatcaactgccccttctttactgaccaataactttcggctgcattgcagtgatttttagttttttctcagcttacatatttcctctacaatctcatgtccccattgcttcaaatactaaatatacgcttatcatcctcaaattttttacttcctgtccagacatttctccttaagtctaggagatgacgtccaaagtttcctaaaagcaattagtctggtgggaaaggaggctcccccatccacccaggagtaatgaggagcgaagttcaggaactgtgaaggtctcattcgtacattcattccttataagtacttacatactcgcgacagtttgaaacctagtgtggcatgcagacatggatgaagcaatgacaggcacgacgagcgttaatgaagggtataagctagcgcgagggcattcaagggaacttcagagcgcaaaggaagaatcccacttagtctctcaaaactttggagtttatccgtttagtcgattaaaaagtgaacggaaagcaaatcccattacggaaggaggaaagttggggacaaataagggattcgtgcagaaggctgcactgcggccggccatgaagagaataagggtacttaagggagtgtgaagagaatgaacaagcctaggtagaaaaaactgaaaagccaggattgacggacactaaaaacccagcatttgttaaaaatccacgtcaacacacacacacacctcaccccgagccagcaccgtagccccgccagcagccagggtatcctgagattgcgggagcgccacgcaccgcccacctagctccgtccaccgtccagctcgctccgcccagctcgctccgcccccttccccgaaagcccctccgcagagccgcgtgcacgtgcgtggcggataccgccccctctgctctcttggccaatgagaaaaagctacgtaactctccaccgcccggtggcgggtcacgtgactgcgtctccccgccctctcaccccgctgcctctaggttctgggaagatggcgaaggtctcagagctttacgatgtcacttgggaag

SEQ ID NO: 247 - DNA, 917 bp, Homo sapiens
tcattgctttccagtgggttaatttagaaacattgtaaagagttgctccagcccaaccgcgaaagaagcgctttacaatgttatctagcgaagcaaacatgaagtgaaacaaacatgactgtgtccagctttctctaagacagtgtagaatggctctgaaaagagcctttgttttccagttttcacaacctcgctccttatttggccttatggtggctctcagtcttcttaggcagcagcacggcctggatattgggcaagacaccaccctgcgcgatggtgactttgcccagcagcttgttgagctcctcgtcgttgcggatggccagttggaggtgacgcgggatgatacgggtcttcttgttgtcgcgggccgcattgccagccagctccaggatctcagcggtcaggtactccagcaccgcagccaggtacactggcgcgccggctccaacccgctcggcataattacccttgcggagcaggcggtgcactcggcccacggggaactgaagcccagcccgagaagagcgggtcttggccttggcgcgagctttaccgccttgcttgccacgtccagacatactggtcacaacttactgaaagtagccaacgaggaaaggcagcgccttttataaacactattgggcgcgaaaaagaagatatgtcattggttagggttgtagcttagttttaaccaatggaagtacgtcttttggatttgcagattgggttgattgggtataactaacctctgacgtcaccctaataaccaccaatcagatacaggactttcactcttcaccttatttgcatgagaggtcctatataaaaacgactcctggtaccttgctcccattacttcccgttttctcgatctgctgctcgtctcaggctcgtagttcgccttcaacatg

SEQ ID NO: 248 - DNA, 1005 bp, Homo sapiens
cagcacaatgagtaaagacacgctctagattcaaaagcaaatccaatgacgcactggggacctcgagttccaaatagttaaaaagctacgtatgccatttcccatgaccttcacactaaaataacttactttatgaaaagaaactaagggaataagtgaacaagctcttttctagtgattaggtgggtggctctgaaaagagcctttggagtcaagcagccggcgactcgagcgagcgagcgccaggtcccggcagggactcacttggagctggtgtacttggtgaccgccttggtgccctcggacacggcgtgcttggccagctcgccgggcagcagcaggcgcacggccgtctggatctcgcgggatgtgatggtggagcgcttgttgtagtgcgccaggcgggaagcctctcccgcgatgcgctcgaagatgtcgttgacgaaggagttcatgatgcccatggccttggacgagatgccggtgtcggggtggacctgcttcagcaccttgtacacgtagatggagtagctctctttgcggctgcgcttgcgcttcttgccgtctttcttctgggctttggtgacggctttcttggagccctttttaggggccggagcggattttgccggttcaggcatggtaagacacagtacaaacgcggcttagccaagaaaagaagtaagagaatgggcgggcctgattcttttataaccaccttatgcaaattagggctccgaaagtcgttcatttccattggtccgtgtgcggaccttgcgttttcagcaatgcgtacgtaacaacaccgactcttgacttgattggccggttctgaagccatattaggaccaatgaaaaactcgttcttgaccccacccctaggaaagcttataaaggctttcctcttggttctctttcaatcttattttgttgcgaggttctgagcgttgtctgtgtttaaccttgatttcagtcatgtctggtcgtggcaaacaaggaggcaag

SEQ ID NO: 249 - DNA, 916 bp, Homo sapiens
caagcctggcaagaacaagtaattaagaggcttgacaccatactcattcaccccaaaggctcttttaagagccaccaaagtgtcaaatgaagggctgatcacgaaatagcgcattagctctttttttgaaaacttgggtggctctaaaaagagcctttggtcttggtttgtttgtctgcatttatttgcttttggctttgtggctttcggttttctttggtaacagaacggcctggatgttaggcaaaacgccgccctgggcgatggtgactttgcccagcagcttgttcagttcctcgtcgttgcggatggccagctggaggtgacgagggatgatgcgcgtcttcttgttgtcccgagccgcgttgcccgccagctccaggatctcggcggtcaggtactcgaggaccgccgccatgtagacgggcgcgccggcccccacccgctccgcgtagttgcctttgcgcagcaagcggtgcactcgccctaccgggaactggaggccagcgcgggacgagcgcgacttggccttggcgcgggccttgcctccttgtttgccacgaccagacatgactgaaatcaaggttaaacacagacaacgctcagaacctcgcaacaaaataagattgaaagagaaccaagaggaaagcctttataagctttcctaggggtggggtcaagaacgagtttttcattggtcctaatatggcttcagaaccggccaatcaagtcaagagtcggtgttgttacgtacgcattgctgaaaacgcaaggtccgcacacggaccaatggaaatgaacgactttcggagccctaatttgcataaggtggttataaaagaatcaggcccgcccattctcttacttcttttcttggctaagccgcgtttgtactgtgtcttaccatgcctgaacc

SEQ ID NO: 250 - DNA, 1066 bp, Homo sapiens
agtatgtaggaaaggcaggagggacagctagggacctttaattaggtccatcaggaaaccactactgactccattatgagctccttgaaagtcgtgaccagtctgtcttggctactatgttctagtgcctgacatttagtaaatgtgtgggtaatgctgagcttctagaccaatggtgagtaatggaccgaggcagtttcctggacaattttattgtcttggttcctggatgggctttacctctttcttcccaaggacatcccaaactgaatgtgagtgactggatgtgactgagaatgacaaaaaagactgtcggcaagtgtgtaagtaaatggactgagtgattttgatcgcatataagtatgaaattcagaatgtatgcaaaggagtgtttgaatgagggtggtgtgagtgtccgtgtgattggaaacatcgtgtcactgggaagaaaatttcgggagctagggaatggggtaaagtgaggagtgtttaagggtgaatgtttttgagtctgtgctagtaacgggttcgtgatggttcccaggaggggacatctgggggatccacggctcctcccgcctcgccgaatgctctccccacaccactccacactgttgaggcagttgacaggagccgcagaagaaacaagggacatcctcactcctgagccgctccagagtcgcttctccccggaactaaaaaggtcaaggagagtgaagaccacgcccggctgcagatcacccccacggccactcaccttgtcatccgccatcttccccgccgaacttgttgcgcaggcgcatccccgcctccctcgtgccgactgccccggccatctttacggagggcgaaggcacttccggagcatttttggaaagggggaggtgctttcctagtggccaagtacgcctctctcagatacttccacgtgaccccctcccgtcgagtctcaggctgcgtgtgagcgcactcacgaccggggcgcgatgatctcactcgtgcgcgagtgcgcgcggcgcatgttcggcgtgtcggtcttcaggcgcctgatgagttcatagttggg

SEQ ID NO: 251 - DNA, 914 bp, Homo sapiens
aatcagtacgggttgcttcaaaacactcacaaatgccatctttgttgtccccaaacaaacctgtgtcccatcctgatcgcaaccgctttaagccgtggctctcaaatgaacccatccatccctatcccgcttcccagatccaacgctctccgcaaaattttacccactagacgacaaagtaggcaaacttacctctaaacgaaccccagaatggcggccgcccgctcgggtggagtcttttatacccggacgccgcccaacgcgcccaaacgtgctagtgaaacgcccttgtcgcgagacattatacgcgaggcgtgaactcattggtcaacccaaatgacaactcgccaactgattggctactctcacttcacctttgctccgcccctttccctggcactctcttccgcctccttcctgcctccctgtcgcgtgcgcgtgaccaggagcctagcacctccctttcctctgcttccgccacttccgccctggagaacatttctcacccaggattggtagaaacctaagagcgcatgcgcactgagaggataccgctaaaaatcgccttcaaaattgcttaaaaggcaaactttaacaatgcgatctaagagtcgtagtgactggccaaaaaaaaccgcaattttggggtctaattcgattgtgacgcagttgaaattagcttctcccccatgccttccctttcacgcttccgtcctgacgcaaacgtggggccgccttccgcactgcgggcttgtccttggccctgccctactcagtttcctgaagcatgcgcagttgcctttccgtcaattcctgtcctgggcgtacgtcaagatggcggcgtctgtattaaacaccgtgctgaggcggcttcctatgctatctctcttccgaggttctcacagagttcaggt

SEQ ID NO: 252 - DNA, 1069 bp, Homo sapiens
gagtgagcaaggttggttgaactgttgcagactaacagttttgcaggtgggcgaaggatcagggaggaaattgagttgagggtgttggtgaataggatataggagtttcagaacccgactacacatctgtcgttgatggtctaaatatttgcatgtttgcaggtccagcgatggcacaatgcctagcagcagaaggtttgcacccactgtgcgacatgagtggcagctctggaaaatcataaaatcatgggaggacttgagagtgcaggctgggtggggtgggactgtggctgcgaaaaacagtgttatgaaactgtgcgcgggacaagaaagctgattttactgattgtatattggggagtactacgggaatcactggagaggccacttcattttctcctatcccaccccatcttttggggttgcaactaaccagtaagtttacacattgaggatacaatggcgaaacggggccgcgaggcgatgacgtcattcgcgggagtaggggggagaagcgaccactgttagggtactgtccataaaggcaatttgaaaatatttcagcctttttacttttatacttccggcccttgcagtttgaggtggtaacaaacgactgctgctcccaaccactttcaccaccgcctgttaccatgggagcgctcgggtagctaggcttggacgactctattctacgtcatcatcaaagcgcatctcaggactgatagctccgccctaaactaagggagagactgtgctcccaagtacgtagcctgcagtgcctaacgcattctcagcaattttgacccccaacagacgccgtcgacagtctcccaagaacaattcccaggagctcggattccaagagccgcccgcgccctcgtttaccttcgctagtcgccctgcagccccgccctgtccggaggccccgccctccatgaatcagctgatcccgcggacccactgggttgccaagctcgcgccggatgcggagcgcggtgctgccggtggagcttcaggtgagcgagtgtgggtcccgggttggctattggctaaggagggcttatcg

SEQ ID NO: 253 - DNA, 904 bp, Homo sapiens
ctaccaagattttgggtgtccaggagcctgcctgaggcctgctgaatatctcctatcccttcttctgtggcctttatccctcctcattttgcaccttcaattgctccccagtcacttcttctcatccatctctttcactcactcctgttctcccatcccattaagtactctgtacacctaggaggcttgtgaaacagcttaaatgcaattaagataaccagagtgtatcctcagccctaaaaaagttacagtctaagctttcttcaaggaaggctgtatcaactgaagagaagtagatgcctgcctgcagtttaagaaataggggccagtgagttggtgttaactcaggacattgggagggacagtatttaggaccagggatcaatgcctgaaggtttcccaaagtgtggacgagacaacctgtaaaactttggattccctgagcaatcttttgatgactaactccagtgcggagtgtcaggagagcgggcaatccgtcttcagtggttttggtcagcaggccacaaacagggttgactattcccagacgggtcgtgagtggtacaagatgagtgatccctccagggtgtgactgtagggatgagctcgccctcagtcccagacgtcgcgactgttggcagtggatcaattcacaacagcctggcgtagcttcaatttcggctccggaatcgccctttgctgtgtcatagacctgaggctggactggaccgctaggcgcaggactgcagggccggccgggtgggcggggcacacccagtgcgcatgcgcagcaccccggcccggaaacagcgcggggtccgctatggcggcggcagccgagggcgtactggcgacccggagtgatgagcccgcccgaggtacccggaatggatggggaggaagc

SEQ ID NO: 254 - DNA, 943 bp, Homo sapiens
cagggtattagcatgagcatgtgaaagtacagtatgtttatcaaacacataaaataagcagttataaataacgtcagaataacacaaggaggccaattatcaaaatgaaaggctagttttgcatgctgtgctttgcggagagaaggaagagggagttttcatgttattacacttttgatagcagaatcctatattttggtgcagaggtggcaaaataaggcggggggtgctggtgcgcagaagctgacaaggttagaatgtgcagcgtttttacgacggactggctttactcatttcctgcctcacttctctcctatctgtataggtttttcttttcgtcctcctctaccagtacgctcccgcctgccgcgctccgcccttgtgcggcgcacgatcggagtcagtgattaagccggctccaagacaaagcggaggccgagcccaggaagcaagcgcgctctccgccccgcctggagggagggcccaaccacagcacagccgcgctcactcctcacccggacgtgacctagttctcacagaggcccggcctcttccgccacaactccggcccgcggtcccgccccgttccgtgaatggtcggccggcctcaggtcaaaaaagcgtttaggtgtctgcgacggagcctccggagaaaggcaagcacgtcgcagccaatgaggtgatagaaacgcaaagcagcgaccaatgactagctgagttgggctgggccggccgacgaatcacgaggcttcgcacccggatatggttatgggctcggaaatctagttcgggaaaagtgtgaggggctcttcacgtggggaaggaacagcaggcgcggaggagggggcaagcgtgtgtgagattcagtggtccatgcgtgcgtttgtcgtgtaagggtcattcctggggtttggagtgggggaacaaatcaatgtggctgttt

SEQ ID NO: 255 - DNA, 926 bp, Homo sapiens
cagttggaggagaaagattccaataactgtaaataaatacggctgagccatatttttaagaaataaaaacgcatacgcttacacacacacatatatattacgtatatatacactccacccgccccatttaccaaaatgaagagcagtacagcttagtagctaagagcacgggctctggagtttactttcttcctgtcctgcagcgattgtggggaagtcaggtcacctgtctgcctctccgtttcctcatctgtcaaatggagttctgggtccctataaagattcagtgacgcgatatgtgaggggcttggaacagtgaccggcacgtaaccgcccacaggttaacagctgctatcacttggtggggtgatggtttgtatcctatcgttattaatacggctgtctctagatgagcaaacatgcgctctcacttcttcccacattcaagaatggggtcccaaacgagagattcgacgtaaacgtccgctcccaactaagttctcaggcgctgacaacgacaagaattcctcacacaaacgtagcgcttcaatcactaaaccgctttcacagccctcgaccctgccgcgagatgtccgccgcccaccgtcaggtcaccgcctccctaacgacttcggctgcccgggccctgcccctgaacctcgcacccctcctgcctcgttcaggaagctccgcacctatccggccgccaccctcagcacagccacggcagccgactcggcgttcctactgccccggaagtgctccttcagcgcagaggcgtgccggtgtgtccgagaaaacttccgagttaagccgccgctgaggccggaaggagctagacggcggtcgggtaggtgacggcttggttggggtcgctgcgaggggactactaggagcgccgaggcgtgagtcgtagcctgtggctt

SEQ ID NO: 256 - DNA, 911 bp, Homo sapiens
acatcccgatttggtctacaagaggaaaaagtctcgatgggcaggacttgctattgtcaaagggagcttggtaaaactgagacatcgcgatcgccggcatttcctgacttccacgggagttttaaaaacacacaagcatagctaagacaggactcgatattgcgaaaccaaacttggtataagagctcccaacactgctaaactggtcatcgctaaacctttaaaaaaaaaaaaaaagcattcgctggtacccagatttccacaggagttaaacatttcctgcgcagctaaagcaagtcttaccagtaggaaaccggaacttgctaggactaagaaacttgaggctaggctgaccccatggttgttatgattagaaatccgaggccactggaaacccggagctgctgaccaacgagtcacagggtaacttcgccttcgcatggggaaacgggtgagttcctacggcctagatatcgcagccagggctagaccggtgtttgtcttaagtcaggacttgcttgggctgagaaaatacattttggctattcccctacttggacagagggtggaaatcccaggcaccgcgaaatcgaaacttgctaggactaagaagccaacgacgcgcgaaaccgtggggtcctgcgacagagacgccggcggcgccgccacaggactgcgttctggaggccgagccggaacccgtgcggcggcgctgggaagagactgtgcccctgcagctcccctgtcaccggctccaaggagcgtcgggctccccccgcccagccctgcagcacccatccggcaacgccagactcggcgcaacgggggcagctgcgactttaaatctctcagatccgcggcctgagggctgccgccaccgagaaatggaggcacagagctgtgaacaagag

SEQ ID NO: 257 - DNA, 977 bp, Homo sapiens
agcctccttacacaatccctaccacattacactgtttttattttctacttcattaccaccacttgaaattatctttattaactgttgagtaatcttccaccacatgctggcatttataaaacctgtgagagcactgctcccctagtttccctagcgtcaattattatggaattactagatgaaggaactcccctgccctgtttcctgctttctttaaattgtggacatacacaagcacccaaagaaagagtgatcctgattccaaagaacatccccaccccacccctcaactaatccgacccctcctcggtttcccagcgggccgccccgcctccgccgccacgcacctggttctgctggcttccaccagggggctcgcttcgtctgccgggaccttctcctccgcctcccttcccgccccgcctaccccaccacccacctgcttcccactctgcttccactagggggcgcgtctctgagggcagggcctccgtctccgacgctgacttcctcagcgcagccagcactgtctccggtggcaagtcgaccagctcctcccacacggattctgtgtagaaatccacggtatgtgcattggaaatggacagggcatccctcaggaactgcagcagtccctgcaacttggcacgcagcgtgggcaggtccggggtcaccgggagagggcaagaagccgccatgacgctcaccctccgaggctgtaggtggcgcaaacatggccgtgaggcgccagctcggcccaaattagcacaggcaggctcagtagagctccgagccggattccttctgagcgattgattgcttcggcttggtgacgtattttgtgggcgtccgtcgtggtcttctgatgacgcagttagtcggctgcaatggcgccggtgaggcggtccgcgaagtggcggcctggtggtattgaggcgcgtggtgaaggggtttccactgtcgggtacaggaataag

SEQ ID NO: 258 - DNA, 1015 bp, Homo sapiens
cagatggcggcatttacatacagctgggagccccctcttgaggccgagctcctcgccctggcgtctggtgcgtccgcgatgcggggtttgggagggtggctttgtcttgcggagggggaacacacacacgcctgcacacaggggtccacaaagagccctggatcttcatcgtatccacacacagctacacccgtggatctcccaaacccagtctcattcacacaaaccagcgcacacaggggtctacaaagaactccggatcttcatcgtattcacacgcggctgcatccgtggacctctcaaacccagtctcattcacacacaggcgccctcagccattcaccaccttgcacagcctctaccacacccgcacagagcacaaagtcacaggtttatacgcctatacaggatctcccataaacacacacgcacagagaagcagccacacagccacacaatctcaaagcgtcacacaatcacgaagtcgtgtacacttctagtgtcccactcgggtgtgcgtgcagaatcagaattgtttacaacctcataaatgtgtcaatcacacacaactccaggcgtatgctgagccgcacagtcccacgtggactcacaatgacaaagtcatgtgcaccctccggtagctctggttcataccacacacacaaaatcttaaaatcatgtacaacctcacacacaggcttagccccctaaccccaccccaccctagccacacaaaaagtcgcgggatcacccacgcatgacctcgctcgtgcccacgaccacagacggaatctcgctgttgctcctgcacgctccccctcccctgtgaccgccccccccgccccgcccttggtcccttggggccgggtagctgcctgaaggggcggggccattctctcagatataaggcttggaagccagcagctgcgactcccgagacccccccaccagaaggccatggtctccccacggatgtccgggctcctctcccagactgtgatcctagcgctcattt

SEQ ID NO: 259 - DNA, 1010 bp, Homo sapiens
gagaaggtccaaaccacaatgaggaaggaagacggctgggggaaggagggagtggacggaaaaatacgtacagttgagagcagaccactaattcaaaaaaattagcacttaaggaaagtgagaactagaaaaataagttgagaagacaaaagtcttgcaacacaccccctacccctacccaccagaaaacttagacttgaatggttctcagcaagagaaaagacattgctgtagaatggaacttgttgtgggaggtgggattaccacggaaataaatagaagacagcctccctttccaaagagccaaaaggaacccatttcgtctagttaagagacgaggcaaagcggtaaaatggtgacaacacgtcctggtgagtggttctgaccgtgaatggttggaaaatgctgtgggaatcagaaaggggaaccgtctgggagaggtggtgtcaccgaaggcttctcggaggaggtggcctctaactcgagccttaaaaatgggcgaagaggcgaggccggggcctgccccgcgcggagtactcgggagccgcctccctcctttcagagctctcagtcccgtccccgggcctcgctttctcctctcgcctcgctcagctcagccgggcgcaggttcctagcactgacgacagcgagcgatgacctcagcgccgccaaggctgcgagggcgggggctggggtggcgggggcggggaaaagcgccggagcggggccgagcggagcggctccgggccccgcccccatcctctggccgcgaccaatgagcgccgccgccggctgcccccctacctccctggacctcctgaaaaacgctgcccggggaaagtccgggcagagcccgagcagcggccagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgag

SEQ ID NO: 260 - DNA, 1008 bp, Homo sapiens
ctatctggctctccgttcaatgtcttcccgaaacttcaggtcagcggttcctaaagtggtccccggacaagcatatctcaccaaccagctgggaacgtaaactgtcaactctggggactcatcccagacctactgagtcactaagtgggggactgagggcggcaatccgtgttgtaccatgtgcgtcgggtgactgtgatgcacgctcaagtttgaaaaccactcctcgagggctactgctaagcacaaccctccgcacagaagtgatactgttctgagcgcctaacagccaacttgcagggtgtagggagctgagagcgggtcccaggcctgtaagagtcaggctctgccccaatttcgctttctcatccaggacaccttctcccagtcactatctcctacgcctgctccttctgggtgactttaccctgagagggcccgctcccgcccatgtcgccctacctcagtgtcagaggggacgtggtgccggcagggaggggaactgcccaaggagacgggagtagatgtggcgctggcccggagcccgcccaacaggagtaaaacgcttcggacccacacagacccgctccagcgccaccggctccggcccgggcctgagcccgagtaacccactcctccgccccattcggccgccatcttcgggccgagcgtcgttaccatggagtgcgtgacgcctctgcgcccgcgccggccccgcccctcgccgctgggggtagacggagggcccagccggcggaaaggcgctttccgattggacagcgtcacccgctagaagttcgccgcagaagatgagggcggcgatcacgtccatcgcgtctcgtggcgcgaagccggccaataaatgctgtttggaggcccacgtgagtggggctgtgggaggaagaaaggctagcgggcgttggccgtatgtgggtgtcttgaggcagtttttcagttctttcatttaccaaagtgacatgcacctactaggtgccaggtgtttagacg

SEQ ID NO: 261 - DNA, 917 bp, Homo sapiens
tactctggcatcttctccctgtctctcattccataaattgagcagtgtgctagaagtcgtggtgtcgtttgtgaataattacagacccctacgcaattcgtcgagcttgtgcctcaagtgatcgcctgagggcttgcaagtagtttagaaaacagaggctacagaggaacggcttctaacagacttcccagttcccagccacgtcagctcgtaagcctgtaacagcgctactgagccgagccagcacgcaccacacggcccggggaccccccaaaaggacactgagtgaaaaagacgcaccagagggcgcccctgaagggggacctcggcccaacagacaagacggctggtaacgctcttacctaactccactccgcctccgcctcctggcgtcccgcggccccgccccgtcccgccgcggaggctcacgggacatgtagtacgccgcgcgccactcctgcacttccccacccccacgaccgaacctggcttcgctaacgccctcccagctccctcgggcctgacttccggtttcctcgcgcgtccctggcgccgagcccgcggacagcggcagccccttttccggctgagagctcatccacacttccaatcactttccggagtgcttcccctccctccggcccgtgctggtcccgacggcgggcctgggtctcgcgcgcgtattgctgggtaacgggccttctctcgcgtcggcccggcccctcctgcctcggctcgtccctccttccagaacgtcccgggctcctgccgagtcagaagaaatgggactccctccgcgacgtgcccggagcagctcccttcgctgtggaagcggcggtgtcttcgaagaaaccggaagcccgtggtgacccctggcgacccggtttgttttcggtccgtttccaaacactaaggaa

SEQ ID NO: 262 - DNA, 910 bp, Homo sapiens
agtctgtgctagtaacgggttcgtgatggttcccaggaggggacatctgggggatccacggctcctcccgcctcgccgaatgctctccccacaccactccacactgttgaggcagttgacaggagccgcagaagaaacaagggacatcctcactcctgagccgctccagagtcgcttctccccggaactaaaaaggtcaaggagagtgaagaccacgcccggctgcagatcacccccacggccactcaccttgtcatccgccatcttccccgccgaacttgttgcgcaggcgcatccccgcctccctcgtgccgactgccccggccatctttacggagggcgaaggcacttccggagcatttttggaaagggggaggtgctttcctagtggccaagtacgcctctctcagatacttccacgtgaccccctcccgtcgagtctcaggctgcgtgtgagcgcactcacgaccggggcgcgatgatctcactcgtgcgcgagtgcgcgcggcgcatgttcggcgtgtcggtcttcaggcgcctgatgagttcatagttgggcggtggtgtcagcggtttcgctggcgttcgtgggcctcccccggacccacacacggaaacacgcaaccattcggggatccagacgcccgtttacacgcaccacccctgggcgggctgtgcggctcaggccctcccccgggaccggcccgtgtcccgccccgtgtcccgccccgtatttgtgcggcgccagctggccccgcagcctgcggcgcagagaggctgggcttgcaggcgcagtagctccagaggtcgcgctgggctgagagtgcgggccggcagaggctggcggggagcagccggggttatgctgggcaaggattacatgctggccatcattctggtcaactgcgat

SEQ ID NO: 263 - DNA, 1042 bp, Homo sapiens
aaaaacaaagaatgaattcgggcccttaccattcaaaatgtagtccatagagcagtgggatcaccatcacatgggaactagctaaatgcagatctcaggccccacccaaacctactgaatcaatctgcatatgaaaagatccccagattattgttggaaaaaagtttaagatgtacttttagaacaaaggcaactgaaatgggggtaagctcggatgatgtgaggatccagagtaaacatgtaaggcactccctattcgctgcctcatttgcacctacaagaccaattactgggaaaggtcatttgaactaagcaccatctggagcaaggtggaggaagagagggtttttggactctttcttgtcaaagagatttaagtaattcgttttgtctactatactagagataaattaaggttccacacatcaaaagctcacctactccagggtcttcatatccgacagacagtggtaataatctttctcggtgtccctccaacttccttctgctataaataagatgctttctcactccagtaaaagcccttagcctagtgttagagtcacggtgaatgaaaacagcttaaaccatggctaactgacccattaaacaaaacaaaacaaagcaacacatgcataacaattatttgaatccagcaccagaaactccccgagggccttacagcacctttaactacggctcctttcccgccctaaactcccgaggtcccgcccccgaccgtgggctaaggtccggcccccgtatttccgggcgagaagtgaccacgtggttgtcgcctataacaatccggccctgctcccatccactggctaaagcctgagagcgacagttgaatacaccaatgggaccctggaagagtctaagcgacagccaaaatcaccattcaatgtcagctaggtgcaaggcgggactttaagtacggaagctgccccgggacatgaggaaaggaacaagggaaagagccggtgaaggggcagaacaggcaggtgagagtctaagagggctcagtaatctgaagctt

SEQ ID NO: 264 - DNA, 907 bp, Homo sapiens
tggtttgaggtgtattccattcctgtgtctgcttttcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcatcttgtctattatgttttttatggttccatcgggtgggggttttctgtcattagagtttgccctgtcactacctgtgctatggagggtatcaaagctataaaggcaacagcccgggttacgtggtgtggtttgcatctcgctggagttggatgggatatggtacgtctctggaggcaggttttaggtttcgcgggttattaggggccaatgctggtaccgcccctttccaggagggctgccttggcgactaccgcttagaccatgtcgtgcctttgggttgggttgccatagtgacacgcaaagcgtgctgggaacgccctgcggcatgtcgcacgcgtacttcatacaccatagagtatggttccgggtctgctggctagagcgtcacttcttccgcaggaagcggaagagcgatcgggtaggcggctctttgtcgaagctagaggaccggcaggcggcagcagcaactacggcggcggcggcaggtgagggaggcgggagacttaggtggaggcc

SEQ ID NO: 265 - DNA, 2297 bp, Homo sapiens
ttcatctttccacagagctttccattaaacagaggcaaaattaaaccatgtcctttttttccatggcactctgaacccttctcatcatgtgatctattagaattacttatctatgtatctggcccacaccactgagctcctggtgaacctatactgctccccttcataaaatataaagcaggtggctcacacaaaatacactctcaacaaatgtggaatagaaggcatgattcatgattatttcattctactaaatgcatgatattatttggactacgcactgtgatataccattaaaaataagtgatttttaaaaaaaaatttccagaattaggacagatgcactgtgactcacgttattattattattattattattattattattattattattattttgagtcggagtcttgctctatcacccatgatggagtacagtggcatgaccttggctcactgcaacgtctgcctcccgggttcaagggagtctcctgcctcagcccacccgagtagctgggactacaggcgcgcgccatcacgcccagctaatttcctttgtatttttagtaaagatggggttttgccatcttggccaggctgctctcgaactcctgacctcaggtgatccacccgcctcggcttcccaaagtgctgggattacaggcatgagccactgcgcctggcctgacctacattcttaaaagggctgtgttactgaaacaatcaggaaagaatcatatctccaggtgaaggaaaatgaacaatgctttttctcttcctcaagtcaagaaaaatccagttctttagttgacagtacatccaagttagtcaaattaagtagcttcctgtctccgcttcattttatctacttgtcatgattaaatatcctactaggttgtaagtgggccctcaacgctgacctttttatcttgggatttgagaggcacagtctagagcactactcttcacctaaatgccagtatgccaccagtagaaattatcctttaggctaaatattgttcttcccagaaaccctcttttcaaggatcagtttaaacctaaattcatcagagaggaaaacagcagatttcagagtcagatgaagaattcatatccacctggctttgaacattatcggctgtgagatggtgtaggtaaaattttaagtgcataatttggcaataataaatcatcaataaatattaatgttgatgaggcccctgggccacataaagaaatagggagtgaggggatttgaaattctggccacttcacagaaatgggtgggaaggggctcttgattgagatagaagcccatcctacatgaagcaattcctcattgagttctctcgtcctttatccttgttggaaacatcaggcaaagtcactcttggtcttaaagtacttttacatctaaatacggaactcttctatttaatccctgtctgttgtagatgttaagtatacaaagaggttgtcagagtttgaaacatctggacttctgtcaggtactagctccggaactccagtcctgctcgccctcaaaaacggcttgcagctagaggtttaagttccacttcctctcagcgaatccttacgcacgagggaggcggggcgtgtgtcctccgcgcgtggttttcgggtagcaccttctggggcgccgcctgcctccacccacggccgggccttgacgtcatgggctgcggccccctcccggctgagcctataaagcggcaggtgcgcgccgccctacagacgttcgcacacctgggtgccagcgccccagaggtcccgggacagcccgaggcgccgcgcccgccgccccgagctccccaagccttcgagagcggcgcacactcccggtctccactcgctcttccaacacccgctcgttttggcggcagctcgtgtcccagagaccgagttgccccagagaccgagacgccgccgctgcgaaggaccaatgagagccccgctgctaccgccggcgccggtggtgctgtcgctcttgatactcggctcaggtgaggattcaccggcgctgaactgctgggctctcctcccatggcaggttttgcctcttgagtttggctcttgcttctctaaaaatcgccctttagttcccccgaccctgcgccgcaggaggtgatcactgtagctccctccctaggaggaaaagagaagggcagatgtctcaaacgtccaggacaaggtgtcccagagaatcgctgtactttttctttagttcagctgagaagacgggagagatcatttgaacctaacccttcgtttca

SEQ ID NO: 266 - DNA, 1387 bp, Homo sapiens
tttcaccaaggctctgatatcgtgctggtttccgaaagccccagccgaaggtgtgcagccaaagggtgacagaaggtgaggcacgtgcgggggcgcgggtgctgaccgccgcggtgcgccctccctccgacgtgcggtgtgcggggcgcagacaaccagcggccggcccagggctttcggggagcgaagcagggctcccgaggcaccgagcgagaatgggaatgggagggacccggtgctcccggacacgcccccggcaggtcccacgcccgggtcttctgagacctcgcgcggcccagcccgggagcggcccagctatataagtcccagcggaagaccggaacgcagagggtcctgctggcgcgagggtgggtaggaggggacgcggggactcggcccccaacaccgcgctccgtctgcagccgccgcctctgcaccgccgctgcccggcggtcggttcaaaaaacagaaatcgggtttgctgcccggcggacaggcgtgaagagcaagggaaaggaacttcctccaccttcggggctggagcccttttcctctgcatctccagtctctgagtgaagatggggggcctgacagcctcggacgtacacccgaccctgggggtccagctcttctcagctggaatagcggcgtgcttggcggacgtgatcaccttcccgctggacacggccaaagtccggctccaggtagctaggcagaggggtaagacaaggggtctcaggacagaggggacgctgttgcgtgcattccatttattctctgctttggtgtaaccactgtttctaggtagggtaggtgaccttccaaagcagtctggccttgtcccagggctggtgctttaggatgggaaactggaactttttctgggattagctgaagaaccaccagggccacagagaatgggttgaccatgactactaccaaattctcccaaaatttagggtgcacttagtattttaagagctgagaatattggcctctcctgagtttactagtcaggtgctttttcctttctttgattcttcgggggttctgtcctatcctactgccctaggggttctggagagttcctggggagggggatattcaaaatgtgcattgtagccagcctccctccatctgcgcgtgagcgaacacacacacacacacacacacacacacacacacacacacacacacacggtagagggaggtggatggaagaggaatgttgctgagaaaagaaacggaaaataggaacacagggggaaatcttggcttaagagtgaactcaatttcgctcccttctgttctgcacctttcttatttccaggtccaaggtgaatgcccgacgtccagtgttattaggtataaaggtgtcctgggaaca

SEQ ID NO: 267 - DNA, 1153 bp, Homo sapiens
cgctggctaaataaatgcactcttaattcgtctcaaagagtggcgttttctctaactcgctcaggtacaacactgtctctgtaaatttcataagaagtgtgtgtgtcttagtttggatctccccaaacagaccttgagacgaggctttgggtgcaggtaattgaaaatggagctgatctcggagtgcacgagtgaggaagtggaaagtgtgagacaaagaaaaacaagtaaagggtgggtgattgagctggttgctgctctggtcaatgagggcccacttccactaggggctctctgagaaactctgcagaaccacggttctcaaacttcagcaagctcttgggcatgccgggtcttactatgttgcccaggctggtctcaaactcctggcctcaagcgatcctcctgcctcggcctccgaaagcgctgggattacaggcatgagccaccacctagagcctgctgattaatttgaaaatgcccggccccagactgggggtcctgatccagtagccttggagtgggccccaagaagggccgcggtgtgaactgcatctcagaactacggcgctccgagagggcagcgactcgccagagtcggtcagccaggccttgcctaaaagcagagaaggcaagagtgcccgggagcgcctggcgaagcttcgtggcttccagcccgcccgggtggcagcggcgtccgcgtttccagggcaacgagggtggcgcggttcgatgacgtcagggcgcccgcggctccgccccgcccatgggacggacggaggccgagaggcgtggcgggggagcagtggggccaggccagagacagctgcgctgtgcgggcagctagtcccagtactccgagtcggtcgcgggccgacaggcatcccctgagcgcctgctgggtgagttggacggtgcagagcagcgaggaccggggagcccgaaggtggaggctgcgttagcgccaggggcgcggacgcgacggggcgggagcgggggcactgaaagtgccaggcccgggggtgtgggggctgtgaggattcgcgggcgggggggccagggttacccagagcaggggccaggagggccggtggcccacgtgctgggcattcggaggactttacacattgaactaggcagctgttcacgaaag

SEQ ID NO: 268 - DNA, 998 bp, Homo sapiens
gggcatctacaaccatcaaaaagtgaaagtgctagttgagagttccatttctgacccggtgccggggaggaggaatgatttgcaatagtcagacccgctcagctgttcaacacgtgtgtgtttgttttacacacagagtagtttctgctgcagcgcgcgtgtgcatgatggatgtgcacttcgctgggttataacgtgtccagttaagaaacccacgccgtacgtgtaaagaaatcaaaccttatccccggaaccatctgcatccctgtgtgaaacacgcacccagtaaatgatgcggggaggggggattagcctgggcgcagaggaccggagcaacgtaaacagctttagaacctatgcaagaggaaagtgcagctgcacctcagggcgtcttcgggctggtgccagacgccttctgcaccggctgccaggtcactggagctggtcagaagctggctggcggagccttccctttcggaagagctgtcctctcccttacccccctcgccctggctccgtgcctcggggcagcctcggaggcgcgccagcagcactcctccaactctactccacccgagcctgacagctgggcggtcccgcctgacccgtgggcaggccgctgcaccctcccgcagacgcacgccctggcgagcggttccgctgcaaaaagagaagcccccaggccggggccggccgtgcggcggagtttccattgtgcggccgtgcgactggccgaggaacgcgcgcgcgcgcgcgcgcacacgaacacacacaccctccctcgcacacgcggaaccggctgggccaggggagggaggaggagggtgacgtagcgtcccatggcgtcacattgacgtctcgcattccaggcactctatggagaggccgctagggctcctgtggcataaatgacgtgccgagagagcgagcgaacgcgcagccgggagagcggagtctcctgcctcccgccccccacccctccagctcctgctcctcct

SEQ ID NO: 269 - DNA, 998 bp, Homo sapiens
caggacagaggtcagaaggaaaaacactgcagtgttcaaagctggagctagaaatgccagccgtcaaagaacacagaactcagtggacggtgatgatgtatagggcgtgcactggccaaccccatccgagaggtcacatctaacctttatcctcagcaaagccactgaaggtcgctcaatatgtgtgacccgcaactctgaggccctggtgagaagctgtccaggaaaacgctggtgcgtgtgctagagggttccttttcactaagggagaattgtcttccagctccttgcagactgacatcgcaaagtactttgaacgttgaaaagaacaaaaaaagcaaacagtcacacacacacaaaaagtaggcgggaggagggggaaagaaaaagggacagagagagagagaggtatcagcaggggtggttagtaaaaaggggcccggagacagaaaaccttttgttcccggagttcgtttcatgtagagattgtgaggtgaatggctttgaaacgaaatgggtttatgaaggagttgctaggtcacaggaagcgcgactgtcagactgcttttgtgaattcagtttctttaaaatttgggttaatcttaaaaagaatgtatctccttttcctgttctttctctttctgtcttcttttttggcgggggcgggaggacagagtaaggttcaggacggttccccactttctgttttattttccaccgtctgataaagcaaaaagaagcgatcacattacaagttctttgtcagtttttcagaattaggggtgggcagggcctgagcattaccttgtcccactagccaatggcggggcggcatgcaaatgaggtccgcgatcagcctgcctcagtcacaacagtgagctcagagacttgagggaggcgctgcgactgacaagcggctctgcccgggaccttctcgctttcatctagcgctgcactcaatggaggggcgggcaccgcagtgcttaatgctgtcttaa

SEQ ID NO: 270 - DNA, 815 bp, Homo sapiens
cctgatagttggtctggctcctagaaattcagattttcttccctccaggtgagattatgcgaagaaaggaacactggcaaaattatttccctgattttcttctctcaggctgtctttccctcccctttaagattgtgtactccgtctcaaaaaaaaaagaaaaaaaaaagattgtagacccagcctataaattcataggatcaagaattcttactaacactctttctaacaaccttaaatctctgatagtagcacccacttgacttcgttttgtatggatagatttattctaatctctctgtagattgttttaatcccaagcagatgcgagagcataaaatagtgtatttgccctccctccaggcttttctggtagtattttgtctgtgaaactaagaggctctagctgctattagaagagggaaggagtaaggatgagcttttgaaaaaaaaaaaaaaaaaaaaacccagggtggagagagtggaaggatgtggttttaagagaggggggagggagggcgttattgtctgtggggcgggggcgggggtagttctgataacacagaattccgagagatcacaagattgcttcaggggggtggggtggggtggggtggggctgggggcttgtcgccctttcaggctccaccctttgcggagattataaatagtcatgatcccagcgagacccagagatgctgtaatggtaagactttggatccttcctgaggacgtggagaaaacttgctgctgagaaggacattttgaaggttttgttggctgaaaaagctgtttctggaatcacccctagatct

SEQ ID NO: 271 - DNA, 1173 bp, Homo sapiens
tccttcactgtctctttgaagccttccagacaccaccccaatcaattatcccatcttctgtactaaggacacacatttctatgcgcccactcaaaaaactatgaaacacctaacaacctccctaggacatcgcagaggaactagtacccttaggactttttcattgacccgaggttctatgaatgcttttttatctaatcatatccgtccactatcaaaacactcttaccttgcacgactatttccctcctgggagttgtaagggggcaatgtgggctagttttcgggatgacggttctgagaaccacgtcgagctcacgctgcgcctctggctgcgatcccgccccggagctggtgaggaaggccagcaactccgaattgccacgggcgagactttgggagaaatcctcccaaagcgaatccagatctgcggcggggaagtcgccctcccttccttcagcatggccggggtgcccggagtccctcaggggcactgaggcggcttccctctgtgcctcctcttgctggcactggccctgggcctcctcaagttcgcaacatgccgtgccctgctcgggtcctgatagcgacctgggacccgggccccctccgggggaaccctggccgggtcccggaccccgctccttctgctccgagcctgcgctagtcccggggccgcgggcctccgcgcagggcagggcggcgctccagcgggcctccaggcgggcgccgcaaagccgtttgtttgccacctgcggcctctccagccacacttcgaccgcagcccagaagccctgtgggagaagcgcgcctgggtagctgatcccggtacggcccacctcagccatggcagccagcaggtgtacagccctggcagcggcgcgccgagatgacgcagcccggtggcgcggcgcgttgacgtcatggaggcggggtgctgggaccggaaatgagaatggcgccgctggagatcctttcctgcttttggtttccctggcaggggttgaactgtggagtgtgtgggtgaggaatttgacctgtgttttattcccttttgagagaattctgggcgtggtatagttacagaatcaaacatcagccagccagcgggtgtggaacgcattgtcctcagtactgattaccgataaaagtcagggagcctaagtttgtgaa

SEQ ID NO: 272 - DNA, 929 bp, Homo sapiens
gtcatgagattcccttcctccttccctggaagagggccatctttgggcagcagccctcccaggccttgagaaatcccggatgaagcacgcactggctcagtatctccctcagcttcccaaacactgttgcctcatggggggtcagcgttcagggtgcagagagccccagagaggtggctggggtggggaggatggggtgtctggtcccagcctggagggaagggggaagccctgggaagcagggcctcctgttctgggggcagggctgggtgtgtgcctggcctcctgatggcagcaggtgctgtaccaccaacctcgggctgaagacagggagaggaattactgtaagggggagaggcaggtgttctctggtcagctggagatctggacttgggaagcacgtgagtgaggatgacagcagtggccaggtgtccctccctcaactcggcccctacatccgcccccagtccagacccagcttcctgagcactcagccctccctctgggtacacagcagccctggtgggcagaattccttgtgtttacctcgttgtctgggtgatggtggtgattgggtggaactcccatgccagatatactgccaaggccaccctgaggggctgccaaccggggccccatgagtgctagagctgctggtcttgtgacgtgggcacctgtctgccaggcctgggcacgggcccagggtcacgctcatgctggggctcccgtcagctgactattttgggctcttgctgacctgggccaaagtcaggtccagtcaagagggcccaaagtggctccccccatccccagaggccggctctggtttctgctatataaacagaggaggacacgccggcttggaggcagcaccacatccagagctcgctcagctgctgcccagcctcggctgtgaggataggctggct

SEQ ID NO: 273 - DNA, 1473 bp, Homo sapiens
ggggagaacttcgtagcagtcatcctttttaggaaaagagggaaaaaataaaaccctcccccaccacctccttctccccacccctcgccgcaccacacacagcgcgggcttctagcgctcggcaccggcgggccaggcgcgtcctgccttcatttatccagcagcttttcggaaaatgcatttgctgttcggagtttaatcagaagaggattcctgcctccgtccccggctccttcatcgtcccctctcccctgtctctctcctggggaggcgtgaagcggtcccgtggatagagattcatgcctgtgcccgcgcgtgtgtgcgcgcgtgtaaattgccgagaaggggaaaacatcacaggacttctgcgaataccggactgaaaattgtaattcatctgccgccgccgctgccttttttttttctcgagctcttgagatctccggttgggattcctgcggattgacatttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaagtaagttctctgcacaggaaattggtttaatgtaactttcaatggaaacctttgagattttttacttaaagtgcattcgagtaaatttaatttccaggcagcttaatacattctttttagccgtgttacttgtagtgtgtatgccctgctttcactcagtgtgtacagggaaacgcacctgattttttacttattagtttgttttttctttaacctttcagcatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctc

SEQ ID NO: 274 - DNA, 901 bp, Homo sapiens
tgaaatgagatcacgtgaagtggggaaaagactgaaaaccacagaagcccgcgcaaactttactgttttaactgttaacacccaaacaggctcctgggcctcgccaccagccagcagtcctcgcgcaagaagggcattgctagctaaactgaactagcgccttccctccgtcttgccgcgggcgacgggccacgtacggagagctgaggactcactggcagagcggacaggagacacccaagcccaaaggccacaggtccaaggcctcacggcgaggctgacgcttctgctccagaaacaacttacggataaaaactcagcttccggtctttattgtttcgtccccggcggttcttacaacaaatcgctgcgcaatagcggggcatgactcgggtgaggcccctggagaccggggccggcgacggatgcagggcggccctcctcactgaggatgcgccacaggtccaggcctctcgagcccctgcgcctgcgctagcattctgccgggaaagccgcctcgtctgtcgactcacttccgcctcctccggtttaagcaccgccttttcgggggttgaagccggaagtggcgcacagccctagcagcaacaacagttttccacgtgcgcgtagggcgccgggatcacgtggggaggcagaagccaatggggaagcgtttcgtgtaggtcttctgaggtggtggcgccagcggctacctcctgcctgtgaggagctggctgagaggggactgggcgccggcggggaaggaggagcgctaggtcggtgtacgaccgagattagggtgcgtgccagctccgggaggccgcggtgaggggccgggcccaagctgccgacccgagccgatcgtcagggtcgccagcgcctcagctctgtggaggagcag

SEQ ID NO: 275 - DNA, 802 bp, Homo sapiens
gatccggcaataatccacttttaaaaataaggaatggggggaataatgcagttgctgtgaaaaccaaaggagaatgacagtaacagccacagctgccccacagcagggactgggaacttctgggtgggcatgcagcacacctcccggcctgtgccttccgtctcttctgtgtgtctctaggccaatggcagcaattgactacaagtaagggaatccctcgcctccctgcaagctcctcccctttctccccgagccccgccccctgcagcccctccctgcaagagtggggctagggcccggcaggtgtggggttaagggagtctgtttggggcccccaggagcagcagcctaagcagtggctgcagcaactgcaacagcagcggctgtggcaggcctggccccgggccagctggcgggaagccccaggagggagggagggaggaggaaggggaggaagaggggaaggaggaggaggaggaggagaggagcagtcagcaggcccgaggaggcaggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgag

SEQ ID NO: 276 - DNA, 945 bp, Homo sapiens
aaccccagaagctctctgtatccccccactcctcttccatccagggcttgcctcctgcttggtcacttcccacccccaacaggccggccttcaaaagcgagctctaggcagcgtgtgggacctcacgcctgtaatcgcagcgctttgagaggccgaggagggaggatcacttgagaccagttcgagaccaacctgggcatcatagcgagaccgcatctctgcaaataaaataaaataaaattagctaggtgtggtggcgcgcctgtagtcccagctactgggaggctgaagtgggagaatcgcctgagcacaggagttgaaggctgcagtgagctgtgactgcaccactgcaatccagcctgggcgacagaacgagaccctgtctctaaaaacaaacgcgcgccctccgccgtcaggctggatggagggaacccagggagacgacttgggcctgaagcctcgccaatttcaggtgaggaaacagggccgtggaggagacaatgtggcgatcacaagcaagcggcggcccgaaggaggaggctagaccggcgggcgcacagccacagttctgcagtgatccccgggaaggtgggcagccggcccggtgacctgcagggtccgagctgtagaagccgcagccgccgtctccaggcgactccgccacccccggaaccacgcactttcatttctctgccgggcgacccagccgagccgcgagggggcgtggccgggccgggccgtaccaagagcgcaaatttgcagggggaagcgcggggctccgggaatgcacgcgcggctcgagtgggcggggcggcggcccaatggccacgcccccacccccgcggccggcgaaggcggtggtagcgcctcagtggtgtgggcctgagccctgcccaggtgcccgcagagagcagccgggctgccagcggtgagtgctatctttcg

SEQ ID NO: 277 - DNA, 1004 bp, Homo sapiens
catcatcagcaaggcagaacttagcgccgactgcatgctgagcgtgtgacaggtctggctcggtggaaaactcagaacaactcatcctgaagcagtttctaatattacacccatttccctgacactgccgctgaggaggggccggggagaggctggatttgactgtgagctcctgtgtttgtctcagtgtctggcggcaggcctgggacgcaggaggtgctccgtggaggtggaatgaacgaacgatcgaacgggtcaatgaaaagatggatgagcagttttaccgctccaggggcagagtgagaccctgagggtctcagctgcatcctacctgagaacagggcctggaaggggctgggggcttccttctccaactccaagtctttcttctcgaccacattctcgggagcctcctccttgcgggtgatacccggggtgggcggtggggaggcgggcggcgggctggtggggtgggagctgggggtggcggggtaggcgtaggcgggtggcttggacacgtcctccagcttctggatgaccttggccttcagggcagccacaggggatgcgcggggtgatggtggcgggctcacggccttgccgtaggtgcccgcggggccggcggccaggccagggggcttccgcggcagcagcccggggccggcggtggccaggccagccttgcccgcagcctccaggccccgcttgctccccttctcttccatctccgcccggtgctcctgcgccttcaaccgctcctgctgggaaggggccggcaggcagggtcagcacggcacgagtttccccctccccgacgcccgcacctgccctgtccccccaagggtccccgagtccgaggagaacctcatgcagggcctggggtccaggctgcccaccccgtcccaggccagagacagacattccatcccagcccatgtgtcataagcacagcgttccacgcagaaccccaaaaggcagcgctgggggtgaggagctctggtgag

SEQ ID NO: 278 - DNA, 941 bp, Homo sapiens
atgctgggcaaacagagtagttcaaggtccccagtgcagcaggtcctactcatttcagaagggaactctgcagaaactatgcccatctgggcagagcccccactccactggcctgagagccacgaatccggcgcgcgtcctccccaccttgcccgccagggggcggcaagtccctgatccggggtcgcctgctgcagagctggtgggagatggttgaggggcgtgggtgggtcagcgttccttggggacccgtgaagcctgggcttagggctcacagcgtgggtccccagcacagacaggaggcggacagcttcccgtgaactgcaggggagtcccgggacgctgtcctccagcgaggtggggaccggctatgtccctcagttccccctcggtcctcgggccacagggacattagactagggggtcagttctgccagccctgcccaggcctcttctgaccagaggagctgcgacggacgcggagttcaggccccttggcgaccgcggtctcctgaactcggccccttccctgctcccatggggaagaaccctgcccctagaacagcctcccctccaggtgtcttccctacgctacccctccgccggccgggaactccgccaggcctagagacgccgacccggccctttctagctcctccccggctcggacctggttcccgccctcggccgcccgccagttcccgaggcgtacacgtgtagatcccgtcacgcccggaagtctcgcgtttctcaaacgcctcgcgcagtcgcccttgcgctcagggaaggggcggggcgaacggaagccgggaaggcgattcatagctcgcggggtacgggcgcgcgtgcgcactccgcagcccgttcaggaccccggcgcgggcagggcgcccacgagctggctggctgcttgcacccacatccttctttctctgggacct

SEQ ID NO: 279 - DNA, 1098 bp, Homo sapiens
actcctcaaacctggcattgttaaggaacgtacccccagatcaagcagtaagaggtgaagcgagagctagaacaagggcccagattctaggaccaagcggctcttgcaagaaaatccccttgtggcctgagaataaagttttaaccagcagcaagggcgcgggccgaggcccggccaggctggaggacaggcctgcggaggtgacactcccttattctccagcagctcgggaaggcggcgcccgaccgccacggcccgcaccctgggagcagggcgagggcgccgacgaggggccggggccggggccggggctggcgggaggcctggcccgcgccgctcccgcctccttccccactcccacttcccggcccccaagcccgggcccgtgaggtaatgtcacgggtggcgacgcgggtctcgtccactgaccacacatttcttgccgaggaaagtgaagagggactcgttctcctgcggggtgagcaacagggaccccacgttggtgaccctccgcggcggcggcggctgctgctggacggagctcatggtttcgccggcggggttgggagtccagggccgtctcctccggcgagtgggcgagagctcgttccccctctcggtgacaggggcggggagaagtggagtcagaggcgccacatctcgcagctcctccggagcggggaggaggacgaggtcgagggaagcaggcgctgacggcgagccaccttcgcgccgcgctgagaaagggaagctcccggcacccgcccggccaggctagggccggatggtcgttgtcctcgcactccggcgactgcgctaaactcccaactcctcccccaaccctcccgcagcggcggcggcggccgcacaatccaacatggcagcgggggcgggcgagaccacaggacggagggcgcgggggagcgcgccggaaacgcgcggctgcggcccgggagaaacccccccactcggcggcgggcctcgcggcgcgggcccgaagccacgcccccttccggccgaggcgcggaccgcgcggagctaagtggaatcccggttggcttggggcgcaggcttccaacttcgtactctggcctctgg

SEQ ID NO: 280 - DNA, 1015 bp, Homo sapiens
ccttctcaactctgatcctgacgcctctgcctgcagcatggtttcccacgggtcctcgccctccctcctggaggccctgagcagcgacttcctggcctgtaaaatctgcctggagcagctgcgggcacccaagacactgccctgcctgcatacctactgccaagactgcctggcacagctggcggatggcggccgcgtccgctgccccgagtgccgcgagacagtgcctgtgccgcccgagggtgtggcctccttcaagaccaacttcttcgtcaatgggctgctggacctggtgaaggcccgggcctgtggagacctgcgtgccgggaagccagcctgtgccctgtgtcccctggtgggtggcaccagcaccggggggccggccacggcccggtgcctggactgtgccgatgacttgtgccaggcctgtgccgacgggcaccgctgcacccgccagacccacacccaccgcgtggtggacctggtgggctacagggccgggtggtatgatgaggaggcccgggagcgccaagcggcccagtgtccccagcaccccggggaggcactgcgcttcctgtgccagccctgctcacagttgctgtgcagagagtgccgcctagacccccacctggaccacccctgcctgcctctggctgaagctgtgcgtgcccggaggccgggcctggagggactgctggccggtgtggacaataacctggtggagctggaggcagcgcggagggtggagaaggaggcgctagcccggctgcgggagcaggcggcccgggtggggactcaggtggaggaggcggctgagggcgtcctccgggccctgctggcccagaagcaggaggtgctggggcagctacgagcccacgtggaggctgccgaagaagctgctcgggagaggctggcggagcttgagggccgggagcaggtggccagggccgcagccgccttcgcccgccgggtactcagcctggggcgagaggccgagatcctctccctggaaggg

SEQ ID NO: 281 - DNA, 962 bp, Homo sapiens
aagagaggccttttcaaagttcgcaggatcgggcctttttgtgctccactttggaacaaatcggaagctagggccttccaggtgcgccaccgccgtcccgggaccgccgcggccgcaagcgtccgcactgcggccggggtgcgcggcctgagaaaggcccgggcaacgacgctccgggggcttgccggagccctctttgaagtctcccgacgggctcccagcctctcataaggcagctaaggccgaacaccccggtgaccataggccagccacgcggtcgcccggggacgcgcgtgctccgcagggacaaagggtcgggaaacttgagctccggccagtcccagagaaacccgggctggtggtcgccatggcaacggagtccgaccctccgaggcctgccgccctggcgcggcagtggcttgagtgacccggcccgctcttggcgggggcgcccgcgccccggccccggcagtccctccccgcccccaggccgcggccgcgggagccggcgactgaccctcggcagctcctgtagtcacgtggcgctgggaacccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagaggtacggccggggcaggggcgcggggccaccgcgggcccgcggggggccgctccacctgcggggcgcgtgaccgtgagtgtgcgcgaccgtgtgtgagtgcgcggggggggacgctgctggatctgcgggggtgggggagcgcacctgcgcacaggctccgcgagctgcgccgtgcgtgggacccgaaatggctcactcgcaagaacgggacccgtgtgcccgggagcgtggacggaggacacgcatcagtacaaaagg

SEQ ID NO: 282 - DNA, 1097 bp, Homo sapiens
tcccaattttgcacattttatccaacttgtcatgagaactgggcttatgcttcaactgtagtccttcaaacaacccttcaccgttcttgtcagaggaccccttcctcctgtgttatttaccagacttgccaacacccctcccccacaaaaaaagcctgaccagctttacccctatttcaaggagtgttcacttcttttcattaatctgctgttatatttgtaacaatttagaaattataggagttgaagttctggtaaaaaagaatgatgcatgagggtttttgttgttgttgttgttgtgtgtgtgtgtgtgtgtgtgtgtgtttggttagttagaatgagattctaaagacctgggaaggatacttatgaagttcatttaaagagaattactatttccaaagttcttgatttatgaagcaggcattcaatttcaagatgtaaaataatagtgtaagttggttggggtcgggggagaccatcatcatatgattatacagattttcccaatttttttcctcaatgaaatagcttattttaaaaatataaaattagaatccctataaagaacactaccaattttctttcctgaaagaaacaataaaatactttgtaaatagaagcaacttcatgaagtaacagatgttttatgtaaagacataaaactgaacctgaatataacgagacgtgtgtgcgagtagtaaaagttgaaagttggacacactcattgagacatatctatttgattccaatgtttttctaaaaggtagagtaatcctagccagaggtttcactggctcagtgcatcacccagtagtgtctcagaagccaggaagggctttccattagataatgaattatgaaatgtctcacactggaaaaaccagtcatccgctgatgtcatgctgattccaaccaatcccaaacaaagccccagccctcctctgtttcagtggtaccaatgtgtggtgtacaaataagtagtacagtataaaacttcacagtgccaataccatgaagaggagctcagacagctcttaccacatgatacaagagccggctggtggaagagtggggaccagaaaggtaatgctttt

SEQ ID NO: 283 - DNA, 1093 bp, Homo sapiens
taaacaagaggatgcctcagctcagtccaattgcgtgcagaatgcactggatgctgtttccacagaacgatgaagtctccaataatctttatgggctctgtctctggttggtaattgtctttgatctactggaagatagaaaatcagatgagctctccaaatccatctgttaccctggtacggatggctctcagataaagttgcttaaatttactgcttagagaacgttgagggaaatatggcagtgcaattagactcaaagatgtcaggtttccctgagaatggcactgcaactcagaaacctgccctgtgagatcaaaggctataaaggagggatttttttaagtagccaactccaccctacttattaaaaaaaaaaaaaaaacaactcaccaaaccaaacaaaagtatttccatacagaaaatttaccaagccatttcaatctttaaaatggtaaaataaactgcaaaggagaactgcatgatttttttcacatacccctacatttcctttcacctcttactttcttgatcagaacaaaaagtaaaaataaatagaaatatttcacaaagtttcgatttttttttttttaaatgctggacttctgcagctatagtagaagattgaaaaacctaacctttttacgtgtaaagtgtatggcggatggagggtggagaacagggcatattgaccttttccaggcaggctaagcaatgatcgtcctctctatatgggttgttatcaagatttcctctgacccacgagcaatgaagcaaatgtctttcagtaaatgccgcgaagatatgccacggttaagagtcatgcttttgggtcatggaaatccccgagtgggtttgccaggccactgattaagaggaagtgtgtgtggttattaccgctggagttcccctaagtcctaaaaggaaagcaccagtgcacatgcaaaccactgggaggagtgcggaacgcctggtacagataggggtggggatttgggtgacgcatttaaaagacagcgtgagactcgcgccctccggcacggaaaaggccaggcgacaggtgtcgcttgaaaagactgggcttgtccttgct

SEQ ID NO: 284 - DNA, 1034 bp, Homo sapiens
tgacagggaaggaaaacctatgacacataaagacacctaagcactagagaacatcttttttatgtccttagttctctggcaggcaaactccttctcatcctttaaaaccgcacattaatatcccttcctcgtgaagccttttaaaatattctccacaagagtcagtcagtccttttactgggctaatgccatatttggttactctcttcttgtagtgtttatcacattatattgtatatattggtatatgattctgtctgtcctactgcactccaggctcctcaaggacagggacaatgtccctgttttattcatcctttgactttcaatatgtagcctaatgtccagcacatatcaatacatgtgtaacaggccaggtgtgatggcttatgcttgtaatcccagcactttgggaggcagaggcgggtggatcacctgaggtcagaagtttgagaccagcctggccaacatggtgaaaccctgtctccactaaaaatacaaaaattagccaggtgtggtggcgggtgcctgtaatcccagctactcaggaggctaaggcaggagaattgcttgaacccggaaggtggaggttgccgtgagccgagattgtgccactgcgtgccagcctgggggacacagcgagactctgtctcaaaataaataaaataaataaataaataaatgtgtaataaatatttgattgcctagcatgattcaggcagggaggtaaatacttactcacattatctcatttaattttcacaacagcctcctgagtcccatcattatcatggtttataggtgaggaaattgagactagggtggtgaagtcacttgcctcaagatgaacagctggtagatcacatgcgtggtggcaccgggtgtggccctggaggactcgtgctagtggatctgtttttctagtgattcttttgttttgtcccttagagtgatgatgcgggtgtgctggttggtgagacaggacagccggcaccagcgaatcagacttccacatttggaagcagttgtgattg

SEQ ID NO: 285 - DNA, 930 bp, Homo sapiens
tcttataaaggcttccgggtcatggcacctgggaaggggccctcgctgcaggccccttctaaggaccccctcttcccacctctccccaccctctctctctcaggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctcccctgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacc

SEQ ID NO: 286 - DNA, 941 bp, Homo sapiens
gaacccccaggaatctctaattgagtctgacaagaatgaaattcatctctttttatccttagctgttcaggtggttgctgcttctggctgctgcaggggccctaagcagttcctggtatgtgtagggagctgggttggaagcttaagatgctgagtagctccaagctcagactttcaagagccatcaggtggagcaagaggaacttctttatcaccaagaaactcatatcaataacttcagcagtataggcagtgagtgaggtcacagggagagggctgaatttcacttccttctgtaagaccagttgtaccagtctcaggttcagagctggcaggagcgggaggctgtggaatcagggatttgaagtcgtggagactagtgaggagacttagttgggagaggctggacctaccctctaggccaaactttggtgggcagacagctcaactctgctcaaagagagccgagacggcagctgcaatgactagcttgggtctttatcccctctcccaggacacattcttaccacactgcagagcctgtttgttgtgttgtgcaagcaaggggtggagattagagtagatgggcagcagggcggggcttagaggtttggagggaacctggctgtcctaggattgctggcttttgtttttgctgctgagcctggagctcagctcagactgagataagaatttccttgggacaatgactctgtatgtgtgtgtgtgtgtgtgtgtgtgtgtgtgtgtgttgtgagcactgtatgtatagccagtcacagcacccttgacagcaacttacagaggctagtcttgtttatattttcccaggtaccctgcatgcatatagctgctgattctactcctgctattgctcacaaccctcagagtcaaactttgtgaccggcctaggtcagaaaacgtgatcaagaaaaagggtg

SEQ ID NO: 287 - DNA, 950 bp, Homo sapiens
caggccactgaccttacaagactacttgccccagactcctggggctggatgggaattgtagtctccctaaagagttgtacgtatctttttaaggcctagtttctgctttcaaaatacgaaaacataacactccagtccataactgttgacaagtacaagcgcgcacaggtctccaatctatccactggatttccgtgagaattgtgcccgctctggtattggatgttcctctccataagactacagtttctaaggaacactgtggcgaagacctttcattccgcaacgcatgctggaaataattatttccctccacccccccaacaatccttattacttatatttaccgaaactggagacctccattagggcggaaagagtgggggattgggacctcttcttacgactgctttggacaataggtagcgattctgaccttcgtacagcaattactgtgatgcaataagccgcaactggaagagtagaggctagagggcaggcactttatggcaaactcaggtagaattcttcctcttccgtctctttccttttacgtcatccgggggcagactgggtggccaatccagagccccgagagacgcttggctctttctgtccctcccatcctctgattgtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaaggtagtagagtcccgggaaagggacagggggcccaagtgatgctctggggtactggcgtgggagagtggatttccgaagctgacagatgggtattctttgacgg

SEQ ID NO: 288 - DNA, 923 bp, Homo sapiens
cagaaactccagttccctaagcaagtaatagaccccatttggctaggagggctggataaatactgagaaagggggaagatgaagccgaaaaggtaggctagggcctaatgtaactcacggacttcagaatgcagactgtaggaatccactaaaggtttcttattaaggcagaaattactgcagtcttaacttgacatagtagtttctcaacttggtagaagcagactatacaaaaagtaactttacagttggctacgtgacttagacaaattactctctctgacctcaactcttacaggtaattgagaggagaattctatatttggacaatcgccgtgattaaacgagtgtatgaaaggcgtctgaagctagggggcgctagataaacactgatttcccctttagggaaaaagaatgcaggctttttgtttacatagagttggcaggcatgcgttatccagcaaggccggaacggaagacactctcagcctcagctgcaaccacatctgggtatgcagaaaccttctaagatcccagcgtttccagggagatgctccatttcccctcacttctccggacctgtcgctagaccatgaagacctgactgccctctaataaagtgcctagccagcactcttagaccgcccaaccttcccagctcttccttccgaggcggctactcgatgacatcacatccacttccgcttccgaaggcggcctcttttcattcctcgggaccgctctaggctgccaccacgccggctggccccaaaaactcgatggttgttgggcggggtcgtgacgtccttggcgtggctgcaggggaggccgcggcggggaaaatggcggacgggaaggcgggagacgagaagcctgaaaagtcgcagcgagctggagccgccggaggtgaacacaaccccagc

SEQ ID NO: 289 - DNA, 910 bp, Homo sapiens
tgccagtgtgttgtacttgagaaaaattataaactatacttttacctccgagatagggattgttccttctgccaaaatgcctttgaataactgcaatatgattcttagggaactttctggaattgctgtaaaaaatcagtacacgcatcttatccctgcatcttgctttttttctcccggattgcccctcagttcatttagtgtacacagcactacaaaaaacaggtttccctgcctcttaccgctccattctttcctccctgcacaaaggagaaagcggactgtagtttaaaaagcaagtagcagtgctacagcaggttgtctgcagcaggagagatggccttaaaggttgtgaacgtctccttatggagtatcgagaagctgcacagccacctagaaacgtccacagagggattgggtctgaaatgtcacccaattcagagactgtgaggcagtgacaggcgagtggccctcaggcagagagatgctgagagagctggtccccacaggcataacttccaggatcctcagttggaccacggcccagagagaacccaattggggcggacgctttttgatctgggaagtgggcaagattctttcagccaatccgttagagaggtgctggtgacgtcactggtcgcgatacagccggcctctgacgtcatcccgcagcgccggaagcggtgaggcacagatgagtaacgtgaatttgtccgtctccgacttctggaggtaaggcggtcgtcagcctatctcttctgctggctgggctcaatgccgcgggtgagcgttcggccgaggctgctcctacccttgagtgatgtgccttgaatgacgctgctttcatgcgctgctctcacggctgctttctccgtcctcccctgttactaccttgggctgtttcagc

SEQ ID NO: 290 - DNA, 1073 bp, Homo sapiens
cagactttcaagagccatcaggtggagcaagaggaacttctttatcaccaagaaactcatatcaataacttcagcagtataggcagtgagtgaggtcacagggagagggctgaatttcacttccttctgtaagaccagttgtaccagtctcaggttcagagctggcaggagcgggaggctgtggaatcagggatttgaagtcgtggagactagtgaggagacttagttgggagaggctggacctaccctctaggccaaactttggtgggcagacagctcaactctgctcaaagagagccgagacggcagctgcaatgactagcttgggtctttatcccctctcccaggacacattcttaccacactgcagagcctgtttgttgtgttgtgcaagcaaggggtggagattagagtagatgggcagcagggcggggcttagaggtttggagggaacctggctgtcctaggattgctggcttttgtttttgctgctgagcctggagctcagctcagactgagataagaatttccttgggacaatgactctgtatgtgtgtgtgtgtgtgtgtgtgtgtgtgtgtgtgttgtgagcactgtatgtatagccagtcacagcacccttgacagcaacttacagaggctagtcttgtttatattttcccaggtaccctgcatgcatatagctgctgattctactcctgctattgctcacaaccctcagagtcaaactttgtgaccggcctaggtcagaaaacgtgatcaagaaaaagggtggttccaggcgggcccagggaagaggtgtggagagcccctgaacattcaggcagtccacatttggggagtgaatgtcacccttagcagtgctttattaccagggttgtatgtcatcagtatgtggtccggccagctcaaataagaagggggagtatggtaggaagaagggaaggggagtccttccaggtatggccctggtggggcagcagcccagatgcctgcgttgccccctcacaggagagatggagccatctcagtgtgtggaggagctggaggatgatgtgttccaaccagaggat

SEQ ID NO: 291 - DNA, 944 bp, Homo sapiens
caacctgaggaggagaacatcaccgttaggctttaaaaactcacaaaataagaaaaatcacctgggatccttaaaaagttcacaaatgcccacatcctaccccagttctaccgaattaggttctctcactttgggcatcagatacgtttgtttttaaaagctccaagatgtgtttagggcacattcctaactaaaagttataaagttaacgaacacaatctttaccatcttccacgtatgttttacttatcgctctccctcatcaaacaacgagcccaggggaaacaggcagtggctgagcagccgctccctcttcgtccatccctctgtctatcactatagccggcacggagtctttcagtaagtttaggcaaattaatcgaaataacgggaaggagattcttcattcttagtccacagtctctaatgctctatctcaccccggaccctggaccattcttcggggtccggtgcttggagcacaatgaccatcttgttccctcccgcccagcgagggtacagcattccgggcagacacccgattcccccttccagcttcgcacttgggccttaccagccgcgctgcccaccgcctcgattccagcctcgccatcagactcgggctctgaatcttccgcgtaaactgcgagagacgacagaacattcttcttccccgccatcttattcccacagcccgggcgtggctcactcctatgactcaagacgccgacttccgggcggaaaggcaggttctttcggatcccaggagacccccgcgccacactggaaaccaatcaaaacggcagtttcctgcgcctggctccgccctcatgccagcgctcgcgctacgtcatcactgcgcgacggatataagattgcgtgggttctgcctaaagctgaattcccagcgctttggcttctctgagttggggttgtgtataggg

SEQ ID NO: 292 - DNA, 1168 bp, Homo sapiens
tctccatttctcccttctcagtgtaacttggtggctcaatctgccacagggcccatgcacttaaagtgcacttcccccagaacttcacataatcattcaagtcggtttcaatatcctgcacttttcctaggcccctatctaaaacagctcctcctcaatcctagtcacaatgtactattgtaactaggaccgtactgttacatcatcttcatagctcttttcatcctttgaaaaataatttattttttaattttttattgacgaggtcatgccctgtcggccatgctgggtgcagtactgccataatagctcactgaagcctcgaattcctgggctcaagtgattctcccgcctcagcctcccgcgtagctgggaccacagacacgcgctaccacgcccggctaatatttcattttttttgtagagatggggtctggctgtgttgcccaggcaggtctcgaactcccggcttcaagcgattctccctcctcggcctcccaaagtgctgggattacaggcctaatccaccggggtgcgacccggccgaaattatttttatttattgtcatctgtttcacccagtagactgtaacctccactaaggcccctgtctgtcacgatctctgctaaaatccagaaaataatgcctgtacacaggaggcgatccaaaactatttactgaatgaatgactgaatgccttggctactcctctaaagaccaaacggattctatccagcccaaaagacacattccatctggccagtcgtagccggaccgagacagccgagccccggagtcgaagtcccgccctgcagggtcctcaccgtctgaaaccatggctgtcccagcacctcagcgcagagcaagtggtggtcaggggagcgtctcaaatcctgcgcagcccaacgtccggcgccgccaagtgacgcacgaggtgctgtgactcgtgccagccccctaatctgcggaagtggagtgcggggagtgcgccggaagaggggtacggaagtgcgccggaagtggggtgcggaggtgtgcagcgcgctgtcagactggctcgcaggcggcgcggccggcggacccgttcgagacagcgcgggcggctcgggtcccctggggctccgcagcaggaggacgccatggacgacaagggtaaatcaagacagg

SEQ ID NO: 293 - DNA, 1054 bp, Homo sapiens
tgagcgtcaagagtaaaacgtgatgcattcctttccttccaacctagattctagtagtttagatcagtatcattgtttttacttcaaggttcaggaaacgctggaaattgctagctaatatcacaggaaaaaaaacaaaaaacacgaggttgacctcaccctacccgcggtaggtaaccatgtatgaatagagactcccaggcataatcaaattacctctgtcaagtcctcgccctaagactatttttggaaactagggattttccagattactgaaagccgtggcggtgtcaaaggccgggcaggagtttcgcaagcggagctatgaaagcagccactctcgcggtcattcctatgcctccgccctacttccccatactggcaaaaacacgctccccggggagctttcatttgggaaccgatagggtccacagccctgtgttcttcaaatactgtaaagcagccctctccagattccttgagggtcactttatattacacattcgtccacacaggacaacaaagtcaccacttccacccgccaaagcgcgctcaggtcggccgccacttcccttggtacacgcggaacgcaagccgcgccgaggctaaaggaagaggccggaatgcagggcgaaggggcgcagagatgctagccaatgctgccacctctattttgggtataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagggcggaggcgcggcctggagggactagttggcgcgcggctgcccggcgtggtgacgtcagggcggaagcgcacgcggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctg

SEQ ID NO: 294 - DNA, 1028 bp, Homo sapiens
gaggaatgggttacaggagacctctggggagatgtgaccacagcaatgggtaggagaatgtccagggctatggaagtcgagtatggggacccccccttaacgaagacagggccatgtagagggccccagggagtgaaagagcctccaggacctccaggtatggaatacaggggacgtttaagaagatatggccacacactggggccctgagaagtgagagcttcatgaaaaaaatcagggaccccagagttccttggaagccaagactgaaaccagcattatgagtctccgggtcagaatgaaagaagaaggcctgccccagtggggtctgtgaattcccgggggtgatttcactccccggggctgtcccaggcttgtccctgctacccccacccagcctttcctgaggcctcaagcctgccaccaagcccccagctccttctccccgcagggacccaaacacaggcctcaggactcaacacagcttttccctccaaccccgttttctctccctcaaggactcagctttctgaagcccctcccagttctagttctatctttttcctgcatcctgtctggaagttagaaggaaacagaccacagacctggtccccaaaagaaatggaggcaataggttttgaggggcatggggacggggttcagcctccagggtcctacacacaaatcagtcagtggcccagaagacccccctcggaatcggagcagggaggatggggagtgtgaggggtatccttgatgcttgtgtgtccccaactttccaaatccccgcccccgcgatggagaagaaaccgagacagaaggtgcagggcccactaccgcttcctccagatgagctcatgggtttctccaccaaggaagttttccgctggttgaatgattctttccccgccctcctctcgccccagggacatataaaggcagttgttggcacacccagccagcagacgctccctcagcaaggacagcagaggaccagctaagagggagagaagcaactacagaccccc

SEQ ID NO: 295 - DNA, 1040 bp, Homo sapiens
aagttgcagactgcctcattttcacaatgggatctttctatccaagaagaaatgatcagaaaacaactctctgcctcagacaaatggcgactgactcatttatacattcattcattcaacattctgagtgcctactatgttccaggacctgaacacaccgctagagacacagggatgaacaaaacacaatccctacccacaaaaagctccttgcctagtggaactactacctttttaacagcagtaactttaatatcttgagatttcttgagaggagacccagtaaccaattttcaaagccaggctcacagaccagcagcccggaggtcccagcccagctccaccacatccagggcagtacctcgcagctctcagtagatcggatcttgtctcccggcttagcgccggggaactcaccgcgcactaagagcggaacgtgaacttcagtctcccctcgcgttcctccccttccttgctgacgtcatccaggagagccgcagactggaaacaacgctactaacggcacttcctcatcacgtgacgagtcacgcccctccttccgcgtggtccctccccctcaggccgcggtcgcgattacgctctctacggcctgcgaccgcagggccgttgcgggctggagacacggcgccgactggaaccggaggagctctaggccaaatggttgggccagccaggatcccaggacccttcgccgctcgagaccggagagaggaaacgaaacaggcgggaacccgtgggggagggagggaactagcggaaggtgtcatggcggccgcgctcttgagtcacgtgcccagggcccgccttgctacttccggtcacgtgccctcagactcctcgcagccagcgatggaggcgagaccccctagtaacagaggcggtggctactgctgcggccactgggtttcggcctcttcccagcagcggctctaagaagcgcagcggaactcgaccggatccaacccagttagttacttcctgtctagagttgtagcttccacctggtaagtttagaccga

SEQ ID NO: 296 - DNA, 1077 bp, Homo sapiens
acggatggaagggaattacttgtagcagggccagtactgggggcgtgcactcagggaccacggagtggcactcagcctcgaccccacgcgccaggcagcccggcgacccccacgcgcggcggggtcctgcccaccccacccggcggcaggtggacagtgttgctatgaagagaaagcctcgattgtccctacagcaaaccgccacacgccagacctctgctattgtgcgccctccatagaaatgcaaacgagcggcgtgcgccggccgcaatctgctcgtccccgcccgcccccgtctcccgcgccccgccgcgctcggccaagggcggggaggtggggtgggatcttccagagacggctcaatgtacacattgagtatgcctggcaggcatcaccagcgcgctcgggacgctagtggtcagctgcagggggctgtgcccactgccttttgcaagcctctaactggcgctacctgtttttaccttaatttctggctccaatgcaacagtctcatagacttcaaattaaagaaaagaaacaaatagaaaggtagcaatacaaaatgcaaaaaaaaatccctttgcttctataaaggtgcttttcgcaaattgcagcatcatataagcaaacaaggtttttgtgggttgggttttttcttttttttttttttttactttttccttttaaggacttcaaaaaaaaaaaaaagccaggcgagatgaaatctgcaggctccagtctgcctggtaacaccccaacaaaagcggcagatttgaggcattgtcatcccccgcacccctccccacgtggccttctggcacgagccgctggctcgccgcctcatttacatcagaaagcgggtgccggccaataggcgcgcagcctcgcgccagctggcggcgccgcacccaccagcctatataagggcgcgcagcgtagtaggggcgcactcgctggtggtgggcgcgccgtgctgagctctggctgtcagtgtgttcgcccgcgtcccctccgcgctctccgcttgtggataactagctgctggttgatcgcactatgactctggaagaagtccgc

SEQ ID NO: 297 - DNA, 1057 bp, Homo sapiens
tcagaccttttcctggaatgaaggtagaaaagtatcaacaataaaggatggagaaagccccgtaaatgataacctttgccccagagggaaaggatgggcagcggaggggaaagtaaagggtggcaagctagaaaaattagacatccagtgtgggagggctggcactggagtgggttgccacagtagggaggggactcagagctggaggcaattcctttggccgggcttgtcctgcgacttaccgtggggcagcgcaatgtggagaggcctggtaaaatggctgggcaagggtgcggaggggacataactggcaggaaggagtcatgattcgtggtcgaacagagtccagaccagctcgacctgtgagcaacgaacggccctgagactcgcataccccaataccggtagtggccgtgaagggcaaagaaatgtgttctgaggcgatcccagcatctaagctgcgactggtctactcagagactggatggaagctgggaagagaaagctgcttcccgcttcggggtgagggatggaggaagggagaacaagcagtagagaagaaaaagtttcagatcccacagccccggggggtcactcctgctggacctactccgaccccctagggccgggagtgaaggcgggacttgtgcggttaccagcggaaatgcctcggggtcagaagtcgcaggagagatagacagctgctgaaccaatgggaccagcggatggggcggatgttatctaccattggtgaacgttagaaacgaatagcagccaatgaatcagctggggggggcggagcagtgacgtttattgcggagggggccgcttcgaatcggcggcggccagcttggtggcctgggccaatgaacggcctccaacgagcagggccttcaccaatcggcggcctccacgacggggctgggggagggtatataagccgagtaggcgacggtgaggtcgacgccggccaagacagcacagacagattgacctattggggtgtttcgcgagtgtgagagggaagcgccgcggcctgtatttctagacctgccct

SEQ ID NO: 298 - DNA, 1100 bp, Homo sapiens
atttacggggctagaacaggagaccacccccgtttttttgtttgtttgttttgttttttgtttttggtgaaacgtagtctcgctctgtcacccaggctggagtgcagtggcgcgatctcggtcactgcaacatccgcctccagggttcaagcgattcttctgcctctgcctccagagtagctgggattacaggcgcgcatcaccacacccggctaatttttgtatttttagtagagacggggtttcaccatgttggtcaggctgatctcgaactcctgacctcaagtgatccgctctcctcagcctcccaaagtgctgggattacaggcgtaagccactgagcccggccaggagacctctttaagaagactcgagatgtcgacaatcccagtggatggataccaactttaaaaagaaaagttcaaaaggcctatgtgcccattagctgggaggggccaagaaatatgggagtcccttatagtgggggtaaaacggcgggtaaagctaggtgggcggaacagcagcttctgggggagacaagcggcaaagaggctcacgaccgactaggggcgaccaaggctgatagccgttggggccgttgggcgccgggagctggcgccccgccctctctcctctcccccaccctccgcacctcccaccaccctcggtgtcccctgcgcgtgcgcgtgcagacaccggttgccaaacattgcatcatccccgcccccctttcctcccctccccccccgctacactcccctccgcgcgcgcgcatgactcacccacctcctccgtgaagcctcgtgacccaaagccacttccgggtccgacactacgtcgaccccctagcgagagggagcgacgggggcggtgccgcggggctcctgagtggcggatgcgagggacggggcggggccaatgccggcgtgccactttctgattggtaggttttggggtcccgcccctgagaggagggcaaggccatggtaaaagattacagccaggcgctcccgaggtcagagacttaagtctaaggcactgagcgtatcatgttaaagatgagcgggtggcagcgacagagccaaaatcagagctggaac

SEQ ID NO: 299 - DNA, 926 bp, Homo sapiens
attttagtaaacgccccgacaatgttataataatttggtgggttattgcaaaatggaacgccaagacaaaataaagaaggaatgtagaaaactctcccgtggctgaaaaggctgtcacaaaggttagctgttaggagaagcgccgcgagcgtgacattcccccaagaaaggcggaggcagccaggcgagaaggcacagccccgcagggcaggtaactgaataccttctccgctgcacacccaggcatgcgcaatccagaccctggagttgctaaggccccaaggcagagagaggctcaggctacggagaaagccaatcagagggctccaagactgataagttagccaatccagattcgagggtgaatcaggtcctcagcatgcccatcgccccacccgcatccaatcagagagccggctactttgggcggacttttcaaaacagcgaaaacaaaacaaatcggggacctttaaaaggcgtaatgagaccagaaacgatctccttccgcccctctgtcttcccccgttccccaacgcagatcaatcgcggaataagcccgacgcccagattccgctctccgccctagcgccaggcgggaggactggctcggcaaagccaaggagagctagggaggccgcgagagaggctcgagacggcagcttaggggcgggactcttttttaaagtccgtggaggaagtgcaggatccctccgcggggagtcacgtgccccgcccccttgggggcgtcgaaactcttaacaaaaacaaggggctcggggaggtttccgctgaggcggcgggggtgcggcggtgggctggtcttccgcggccggcgttgcgccgcggcggagggtgggcgcgcggggagcgggatggagccggggctgtgaggccgaggcggcggtgcctgggaggaagggtcggat

SEQ ID NO: 300 - DNA, 1035 bp, Homo sapiens
tgaactcactgattctggtgcattacagctatgaaatctctatgtctgcagctttctctcccaccataaggaaatctgtgatttctattttggcaggagatgtgaccaaggactcctgaggaatgaccctatagacagacccagccacgtgcctagtagtgatcaaaaatgcaaacccaattaaagcactgtcttctgataaagtcactttctcttgttcaatccctaatgttcattctcaaagtgttccaagacgccccagcaagctgcagagcagatcccaccctgcccctgggcaatcaacgtttcaggttactccttccttaagttaagtggcagagagaaacgggcgagggtctccccattgcctcagttcacagaccagggggtgtcgaatgagtcctacagcaggacagcaaacaagaaatgaggcgcggggtcagggaacgcgctcaaaaaaggaagaaaaatcccactcttcattcgaaatcaggccactgcactccggcctcgtggcgggcgacctcctcctgccagggaatcgccgctctggcctcgggctggggagcccgtcagggtgggtgagggagcgccggcgcccccgccgggccgccgccaacttcggctccctccctccgtcgcaaagccctcgagcccgcccggccgccacgcttcagcaaaaggtcgtgcgcagcggcccacactgaagactctccatctgctcccacacctgccccagctggccgctgctatgtggcccgagtgcgcaagaagccggggccgcagacgtcagcagcgccccggcttcgagacccttcggcagcagccgtgactgccgccggcgggcgctgacccatccccgtgccagtctgcagccgaccaatccgcgtcctcttgaggcggggccggagccgcgaggccccgcccccaagccgaggcctcataaatgctgcgacgcacgcccagccgcaaacagccggggctccagcgggagaacgataatgcaaagtgctatgttcttggctgttcaacacg

SEQ ID NO: 301 - DNA, 967 bp, Homo sapiens
acgcgtacgtagtatagagaggtgtgatcaaaaaaagaatatagggagcatagggcttcgtctgcatcaaaagatactctccccatcttctatagccttaagttttgcgaaggtaagtttctccccgcttgaaagcgcccccagggacaagaattcatcttgaccaagcctaaggccgtggcatgcaaggtgttgagtcaccgggtacagcggtcttgcgacataaatattatttgatgacgaaggtactcggggcccaggtgccaaggtaaaccactggcaaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatc

SEQ ID NO: 302 - DNA, 1183 bp, Homo sapiens
tgtctctctgaggcagtgacatccgggctgacgtgaaagatgagaaagagtcaggcaagtgaacagaagaccagacagccagtgccaagggcctgtcgcaggaatgagcttggtatgtttgggggacagaaagaagggcactgtggccgaagagcagtggatgaggagagagtggccaaagaaggtgtgtaaacaacctgagctttgttttgagaagaacattggctggtatagaaagaaagactttggaggcaaagtagggagcctcggaggctgctgccattgtccgggtaagctgatggtgccgagaccaggtgccatgactggaggtggtgagaaatggtcctatgcaggagacctggagacaccgctagcttgagtcctgaggtggggaggaagggagagggagggatggagccaggctccaaggttttggcttgagcagctgagatggggtggcaagggagcagaggtagggctgacgatcaggagcgggtttttgggccgagtcctctgcagtgcccatctgacacccactggatgcgcagagtgggcagctggctatgagtctggaactcagagaagctgttcgctccggaaatacaaacctggggctcatagccatataaatgtcatttaaagccacgggactggatgagatcattaaggcagaaggtctaggtcgaaagaagagggccaggaccactacctgtaaaatgagccaatgacacctacacccacggggctctcgcgaggtgtcacgtgaacgcacccagcgagccctggaaccaggcagagaatcgcggcagccccgggggcggggcttccagggggcggggtcatacgggggcggggccgagggaccaagcggccgctcctggccggagggcggccgggtcggtgacgtcaccgcatgactgggtttttatgaatgaaaggaatcctgtgagtgagtaattccgggaagctcgccttacaactccgcgcggcctcggccccctgcgccgcccgccccacaacaaaactcagcgcagcgctcccgggcgcccggttcagagcgacctgcggctcagagcggaggggagactgaccggagcgcggatcgggacagcggccgggacagcggcgagacgcgcgtgtgtgagcgcgccggaccaagcgggcccagaagcgggtgaggaac

SEQ ID NO: 303 - DNA, 1029 bp, Homo sapiens
ctcagctttccattcagaggtgtgtttctcccggttaaattgccggcacgggaagggagggggtgcagttggggacccccgcaaggaccgactggtcaaggtaggaaggcagcccgaagagtctccaggctagaaggacaagatgaaggaaatgctggccaccatcttgggctgctgctggaattttcgggcatttattttattttattttttgagcgagcgcatgctaagctgaaatccctttaacttttagggttacccccttgggcatttgcaacgacgcccctgtgcgccggaatgaaacttgcacaggggttgtgtgcccggtcctccccgtccttgcatgctaaattagttcttgcaatttacacgtgttaatgaaaatgaaagaagatgcagtcgctgagattctttggccgtctgtccgcccgtgggtgccctcgtggcgttcttggaaatgcgcccattctgccggcttggatatggggtgtcgccgcgccccagtcaccccttctcgtggtctccccaggctgcgtgtggcctgccggccttcctagttgtcccctactgcagagccacctccacctcaccccctaaatcccgggggacccactcgaggcggacggggccccctgcacccctcttccctggcggggagaaaggctgcagcggggcgatttgcatttctatgaaaaccggactacaggggcaactccgccgcagggcaggcgcggcgcctcagggatggcttttgggctctgcccctcgctgctcccggcgtttggcgcccgcgccccctccccctgcgcccgcccccgcccccctcccgctcccattctctgccgggctttgatctttgcttaacaacagtaacgtcacacggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgag

SEQ ID NO: 304 - DNA, 933 bp, Homo sapiens
tttgagggtggtgaaacttgaatctctcatcaactgtgcaatagttatattaacttggatggctatgagttttgcagaggaaagctgggcttaaatcccaatgctagacctggtggctagaccttgattgccaccgggtctagcattgggatttaagcgacctctaaaaaaaaaaaatcacggaatctctctttggccttccttttttgtttctcagcagtctaccaagctacgaagaacctgaaaatcggaggtcgtgtaccttattttttctgagagcttaagctgagagcacagcctccccaggagattagcggcagagatccgcgcgctgggagaaaggctagccccagggcgccctaacttccaactccgggagcaatccaaacccggaggccggcgggggaggggacagctgtagggggcggtggggatgggagtggatgctcccgggtcagctctggcactcgccagctgagcccagcgccagtctaggtgagccccacggcggtgagggacgctcgccagacggcccagaggagttagatgacgtcacctccaggaggactcgctttttcattaatgaaaccggccggcgcgggcgcatgcgcggcaggccgccttccctctcgcttccccctcccctttcccagccgcgctctcaatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactc

SEQ ID NO: 305 - DNA, 941 bp, Homo sapiens
cagtccttcctgtttgcctctccagcgagtggccccgcagcctcccctgcccgctgcctggcttcctgctcttaggagcctctcttcccagccccctcccacagcttgggcctcttccccctcctccctcccacctccagccgccaggtccccagccgcccgccaggcttgggcctgagtggcagaggcgcctgcagctgccaatcccaaaaatattctctgatgacacagctggaggacaagagcccagactggctccactggtctaagtatagagcaggcaggaccacctgcccccggccctagccccggttctagccccggttccagccctgcccccaagggctggccggccagcagctgcttattgaaaggggccccagaaggtctgaggggtgatgcactttgtctccctgacaaataacactttctggggctggccggctacagctcccaggctcctgtcccacctgatgtcacctctggatgtgtctgtgtgtgtgtgtgtgagagagtgtgtgtgtgtgagaatttgtgtgtgtgtgagtgtgtgtgtgagtgtgtgtgtgagtgtgtgtgtgtgtagggagaaggtgttgtatgtttgcatgtgtgagtcaggtcgcttgaggcgaaatccttcccagcccctcccccacatccctggcgggagtgggagataaggctcatggccacagacatctgcgtcagagataggaggtctcaatgccacgggcaggggcaactcggactgtggggcgtggaaaggactggggaagactggatgagaagggtagaagagggtgggtgtgggatggggaggggagagtggaaaggccctgggcagaccctggcagaaggggcacggggcagggtgtgagttccccactagcagggccaggtgagctatggtgctgcacctactgctcttcttgctgctg

SEQ ID NO: 306 - DNA, 918 bp, Homo sapiens
tcctctggttgcctctaacaatcaggtacccatagcaagcgggaccggggcaacttatgttctttgcagcgagggaccttagcaaccaaggtgcgagaaacacgcgatcattggcaacttggcaagtggatgtggtaaacgaaccctgaacacactgcgacccagaaacccaccagcctagcgatacagatcgctaagcaacagccctcagaatcccactccccgaagcgctccctacttcccgccccaccgcggccacccttgggccccggggcctgcagcattcagccaggccccggcgcggcccgaccctcctacccggatccccgactcacggtctggctctgccatgggcgcggtgctgaagcccttgaggctgtcaccgaccgctctgtcccgtcaccaaccactgtgtcccgtcaccgactgctctgtcctgtcaccgactgctctgtcccgtgacggcaccagaaatgggagtggccgtgatagggcacagaactacaactctcagcagacattgcggccgcagacgcgctttcgtacaacacccagagcgccccagttaggtaagaaagcgcgcgaggaccggactacgagtcccagaaggcgtggcgtcagcagccatgttggtaaagggcgcccggaaaatgtgggaacggctagagagttgtagtcctcccgaatactctgattggtcaggatgcagtacgagggcggggtgtgagcgattcagcatattatcattgggtgaatcagggggcgtggtggggaatttcccgcagggcggaagctccagaactcccggcaaagcccagctacaggcgggcgactgcggggggcccctgaggcggcgggggccatggctggggtcgcgtgcttgggaaaagctgccgacgcagatgaatggtgcgacag

SEQ ID NO: 307 - DNA, 929 bp, Homo sapiens
tacactaacatcccacgctctgaacgcgcgcccattaatacccttctttcctccactctccctgggactcttgatcaaagcgcggccctttccccagccttagcgaggcgccctgcagcctggtacgcgcgtggcgtggcggtgggcgcgcagtgcgttctcggtgtggagggcagctgttccgcctgcgatgatttatactcacaggacaaggatgcggtttgtcaaacagtactgctacggaggagcagcagagaaagggagagggtttgagagggagcaaaagaaaatggtaggcgcgcgtagttaattcatgcggctctcttactctgtttacatcctagagctagagtgctcggctgcccggctgagtctcctccccaccttccccaccctccccaccctccccataagcgcccctcccgggttcccaaagcagagggcgtgggggaaaagaaaaaagatcctctctcgctaatctccgcccaccggccctttataatgcgagggtctggacggctgaggacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaa

SEQ ID NO: 308 - DNA, 914 bp, Homo sapiens
aggaatagcattatttcccggtgggagtttgcttgctcacactttcatggcaaatgtagatattttaaagccaccttaaagaaaagtctgggaaacaggaaagcattgccctgaacctctccgccccaactcgctcgagtcggtcttggtagggacgacttttctatcggcagagttgttcatttttctctaaacttcatcttaggcgcctatttgctgcccccaccccagtagtgtggttctgggcaagtcagtcgcttcgcctggggaacctcagtttccccgcctgttagtgatgaggaaatgaggaaaaggggcacaagagtatgcaaaagcacaggaagcccctttcggttcaggtcggcggccgaggggcacggggaaggggactcggggagggagagagggaggagcggcgaggccaaggcaggtggcacgtcgcccgttctcccggccgctcgcatcccggaggtcagcctcagctggcagcgagccctcctcctccccgctgggcctggagcgcggcgcgggtccggtccctggggacgcgccaagagcaggccggacagcagggcgggggccgggccgcgagccagcgcgcggcgagcggacccagctccgaggctgatgacgtctccccctctggctcggcggcgcctggcctggcagggcgggtgacgtcaccgccccgtcacgtgatcaccattcaaacaaacaccccccctccccctgcgcgcgggtctggcccgccccgtcccccagaggccgcatataaacgcgctccccgggccaggctcgctgcgaaggacatttgggctgtgtgtgcgacgcgggtcggaggggcagtcgggggaaccgcgaagaagccgaggagcccggagccccgcgtgacgctcctctctcagtccaaaagc

SEQ ID NO: 309 - DNA, 1100 bp, Homo sapiens
ccttctgataaaaacggaaaccacagtgtagggggtggttttgaccagggtttcggagtcagataaactcaggtttccaccttgaatttctcatcaatctgacgtggcaggttattcatcctaaggttcagttcccacctgtgtaaagtgggagccgcaagtcctccgagagtgacgatgatgtgcgtggagtgcccagcccagattgaagcgcggccaaggcgggtcgctatctgggcaccgctcagctccagagggcgccactcccgcggagcctgcgggatcggggcttcccgggagcagcgcgatcagcaccacgactcggggacacagccagggcccggtttctacaggaagcgcctcatttggagcctttttgtgatagaatgatcattagtcctaagcccattcagaggttcaagaatggggtcggctcaatttcagggccttattacccaagcccggctgcccttcggtgccaccagcaccactgctccgtcgctgcggaattccaaaggcaggtttggcgttagggccttggccccagagaggacgccgagcgctccacggaaagtctccgcccggctcccagggcgcacactcgcgcgcacgtggggccgaggccctgctcccggggcctcagggccagccggcgagggacccagccgagtgacagcaggaggcggagggaaggttgggccggaaggtgtcagccccgccccgcgctccctcgccgcctccgccctcctcttctctcccctcgtgcgttccctctcctctccctccgctcccccaaccctcctgctgcccccttccctctcctcccgcttctccccatcctgcctacctcccttcccctcctcttctctctcctccccttccctcccctctctcttctctcctccctcgtttcctcccctcccctccactcggccgtccctccttcctcctccctcctccctcctcctcccgctcctgaagagcgcgccgcgtgggggacggcccggttacttcctccagagactgacgagtgcggtgtcgctccagctcagagctcccggagccgcccggccagcgtccggcctccctgatcgtctctg

SEQ ID NO: 310 - DNA, 1044 bp, Homo sapiens
ctcacatttagcatcgtcaccacgcctattttggccgccaccaccaacgtccagtggcaacctcgctctcggcccagccacaaccagcccgcccgcgctacgtcatcacggcgcgtcgcgcgggaagtcgcggggaaaaggtaagatgccccttcctaattccctcgcttccttgcttgctctccagacaccgccgacccgaagggctcctaagtgactggacagggacggaggggcggcggctatggcatccgggacgacagcgacgatagccgaggcaagaaaaagcttgcaccgcagccctgtcgggaaccgccggcgcctgccttttacgtaggcgcagcacagctggcgtagcacgccgacgcaccgccccgtcgcctgtgagctcgcggtgtggctcagcccagctggcgtagcacgccgacgcaccgccccgccgcttgtgagctcgcgagaggtgtggctcgcgcgaggggcgcggccttgaggcacggtcccctctggaggcgggatctgggcgggcagtcgagagacgaggcccaatggaaaagaaaagcctgagcgctcgcgtccccacaggtcgccagaaacttggtggagcgagccaagggcggagtttgagaaaggggctgcgtccaatgagtggagcggtgagtacagcgcgtcgacggcggaggcgggaagggggcggaggccgaccgaaggcggctagggactggctgaagagggttagcgaaacgttagcggtcgggtctgggcagggggtggagctggttgaaggaacggggcagtcccctgaggagcggggctggttgaaacgctaggggcgggatctggcggagtggaaggtaccggtccggcccgataaggggtggagttaagtgaatcgttaagggtggagtcgaaaccggggtcggggccggggccggctgagtgaaagggtgggtgattatcccgggagataggccgaaagggcaggttcgtgaaggaatggggtctgggctgggcttagagggtctgggaatggggcttaggagagta

SEQ ID NO: 311 - DNA, 1026 bp, Homo sapiens
tccctttgggtagtaaagcaacaaaccccacacctcactccgatcctgggcttcgggcgggaggactttctctttcatcttccaagcagggggttgcccacgttcttggggaagctataaaactgatttaatggctttagatgaaaatcgatcacgctaatgcatacgctaacgtctcaggaatcgcatattcagaaaggactggccgggccgaaagcgcacggggagtctggggctaggaggtgtcaggccccgctgggtgggcagcagcgctccggtcccctctccacttgggtaaccgggaaaaacctacggggctgtcacgcggggaagcgcgaaggtgccaagggatgaaagctcaaacccgagccctggcctcctcagccggctatttcctttggcgccgcccgcctagcggcggggtgcagcggcggcacaggtgccggtgtcgggctggaggcgcggcgcaggctgggcccgcgggtagacggcgaaaggcgccgcgcgctccattcacaaagtccgggcgctgcccgccgctggcggcgggtcggaggccgcctccctcttcctctcggcctcggttttatgaatgggcctgatggcgagcacccggcgccctgtttactccgctctttgtgacgtcgagttcccgtgaccgggagccagcggccgcgctccattcaagctccggggagggggtgggaggaggggcccggagggggcggggagtcagcgcggggggcgggggacagcgcggggggcgggggacggcgcggggcccggaatggaacggggcggggcctggcggggtagtacctagcgccccctcccccgggagcgcggaggagcattaataaacctctaagccgaggagaaaactctggctggggcagtgcgctgagcgccggaggagcgtaggcagggcagcgctggcgccagtggcgacaggagccgcgcgaccggcaaaaatacacgggaggccgtcgccgaaaagagtccgcggtcctctctcgtaaacacact

SEQ ID NO: 312 - DNA, 1089 bp, Homo sapiens
gtaaaagggaacggagagcctaagttgcgctcagaggagccgcctccctaagaaggctctgcatatcttcacctccaggaaggcctcacggagttgggggagaggggagtccccgcagccagcccagcgaggcaggaggccgtgcgccactcccgagaagctccttcctgcgccccgggggagccacttcagtcagaccctgagccgggaccccgacccgccgacccctgacgcgcgcgccgcgaaggccgggcacccgagggcccttcgcgctacccgggcccggggccgccgtcggctgcgacaaagggtcagagaacaagacgacccctctgcgcgcgtcccccgcaggcctcccggatgcgccgctgtcccggccgcgcccaccccgacgctgccgctaccttgtcctcgggtggcgcaaccggctcatgggccaccctctgcctcagctctgtcatcctgggaaaatcggcccgacgtcgccgcgagctagcagcgaagccgccggagcaggcagctcggcgcgggcacgcgcggactcccacggccggccccgccccgcccgggaggcgcgcggctctgagcggctcacagttcccttagcagcccagcagccagccctggagctcggccccacccagtgccgtcaccgccctttcacccgggccgagcggggtcagccttccctagccccgacccgagagctccctctcccgggagcagggctcggagcgagtgcgcacgcgcagcgccaccatcacggtccggaatatccaccaatggcgcaaatacgccagggaggcagggcgacgggggcggggcggggcggagcagagtcgagaggcgcgcattggacggcagcgtcaggggcgggaaaaggcgtgcgtttcagtgtgcgattagccaatgggagctcccgcttaaccgcggatggccggagctggcgccctggttctggaggtaaccggttactgagggcgagaagcgccacccggaggctctagcctgacaaatgcttgctgacctgggccagagctcttcccttacgcaagtaagtagacgttatttaggtcgaatggaaaggcc

SEQ ID NO: 313 - DNA, 1003 bp, Homo sapiens
tgattaggccacaatcttcaatgagtaaacatattcctgtgagtagccgtcgcatcgtcgcctctcgggctgggaatccacgaccggccccccatccccgctgtcgcctttgttcggagcccggcgtctcctccaggttgccccgggttgcggttccggtgggtcccgggtgggagcgggcgggttatggccctgtggccggccgattgcggccggctgtgcggaggcagatgccgggcccctcggggctgcggggtggcggttggccgccggaggcaccggcttttgagtccctcccgagcccggagcgacgggggcggcgcggtccggcttctgcggcggccgggggcagtttcggcttccgcagcgggccgggtgggtggcacaaaagccgctttgtgaccgccgcctccgcccttggccctttggtctggcgcgacccgtccgggcatggcaggctccgcggcgtcccggggcctctttgttcggccggaggagagtggctgcactgggagcgggagacgtggcccggggtggggcgagggctgcgcgtgtcactgcggagccggatacggggagggcgcggcggtggcgggttcgcctccagatccgggcgggcgtggggtaggccggacagccaggcacgggtggtaacgatctggttccagagcttctcggagctccggggtgggcgcgggacagccactgggtgcagctacactcttgtgctcgacggccgggacccgagcctcagacaaaatggcctcggcgcccgcgcctgactgaaggcgcggcgcgaacccgtgattgcggcgcggagagggggcgcagcgggcgtgctcgggcgcacacagccgcgtgcgcggggcggcggccctctggggcattccgcgagctgcacccctgcccgggccagagtggggttctgctaggtgagaacttcggccgtccgccccgccctcctcccaggctccacctggtaattcgagctgttccggattta

SEQ ID NO: 314 - DNA, 1000 bp, Homo sapiens
agtcacacagaaagaccaccctcgtcggcatccccacacacagtccgacacccggcgcgccggcctccccgcctgacacactaacgcccgtcgtctccgcgcaacttgttatgctccggctcgagcccttgacccaaaaccctcagcgaaacggagagccgcagagccggcctcgggcggcctttgatggctttgttattgtttgggtttgaatcgatacgcccctccccatccttcctccctcgcggccctacacccagctcccgcctcccctcacgccccgcgcccctccccctccattttggcgccttttccttcccgccacgtcgtggcggcgtagagaccattctgaccgcgagagctgggcggggcgggggcggggcgcgccgagttatgcagatcaatcggcctctggttggctggagtagcgctggcaggggcggggccggggcgcggccacagagcgcgcggggcgggggccgaggggagtcgcccagtcccgccgcttccccaccccctctcctccctcggccggcccggcagccctgctccccgccttggcctcccggagaggccccgccccgtccccgcccgccgcgccctccccgcgcgccctccccgccggcgcgctcctcccctttactcctggctgcggggcgagccgggcgtctgctgcagcggccgcggtggctgaggaggcccgagaggagtcggtggcagcggcggcggcgggaccggcagcagcagcagcagcagcagcagcagcaaccactagcctcctgccccgcggcgctgccgcacgagccccacgagccgctcaccccgccgttctcagcgctgcccgaccccgctggcgcgccctcccgccgccagtcccggcagcgccctcagttgtcctccgactcgccctcggccttccgcgccagccgcagccacagccgcaacgccacccgcagccacagccacagccacagccccaggcatagccttcggcacagcc

SEQ ID NO: 315 - DNA, 998 bp, Homo sapiens
gggtcacacttggggtcctcaggtcgtgccgaccacgcgcattctctgcgctctgcgcaggagctcgcccaccctctccccgtgcagagagccccgcagctggctccccgcagggctgtccgggtgagtatggctctggccacgggccagtgtggcgggagggcaaaccccaaggccacctcggctcagagtccacggccggctgtcgccccgctccaggcgtcggcgggggatcctttccgcatgggcctgcgcccgcgctcggcgccccctccacggccccgccccgtccatggccccgtccttcatgggcgagcccctccatggccctgcccctccgcgccccacccctccctcgccccacctctcaccttcctgccccgcccccagcctccccaaccctcaccggccagtcccctcccctatcccgtccgcccctcagccgccccgcccctcagccggcctgcctaatgtccccgtccccagcatcgccccgccccgcccccgtctcgccccgcccctcaggcggcctccctgctgtgccccgccccggcctcgccacgcccctacctcaccacgccccccgcatcgccacgccccccgcatcgccacgcctcccttaccatgcagtcccgccccgtcccttcctcgtcccgcctcgccgcgacacttcacacacagcttcgcctcaccccattacagtctcaccacgccccgtcccctctccgttgagccccgcgccttcgcccgggtggggcgctgcgctgtcagcggccttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcagcgtctgggacgcaaggcgccgtgggggctgccgggacgggtccaagatggacggccgctcaggttctgcttttacct

SEQ ID NO: 316 - DNA, 1003 bp, Homo sapiens
gtgaaaatgatcaggatccaagcgctttcagcaacttctggcgaccctcctctcccctcccgtctcttcctgagcaatcacacgcggggtggagggagggagggaaggaaggagggagggtgaggaacgcagacctccccacacccccggcgagcccccggacacagccccaccaggcctccagccccgtatccgcacaaagcctctccagaaggcgcgctaggggaggccctggcggcacagcagagcaggaggcgccaaggagttatttagccatgcgggaccccatccccctccagtccccggaggccggcaccgcccccgcccccgcccccgcccggccggggccccacgcgcggacacggggcggggcctcggggcgggcgggcgcctggtggcccgggcccatcacgccacccgggacgtgccttggcggaggcggcgccggggagatcggtcgtacacagcggtcccggggcggggtgacccggcccgggcgcgcggccgcccccatgacgtcaacccacaaggcagcgcgctgttgtggcgtttaccgcgcgtcgccggggcaacggcggccgggcgggcgtcggcggcttggccccgcccctccatgcaaatgagcgacgtcacccgcacccaatggcgaacgggggcggtgagctcatcgcgccgagccgaggctataagagggcgcacaagtggcgcggcgcaggagccgccgccagtggagggccgggcgctgcggccgcggccggggcgggcgcagggccgagcggacgggggggcgcgggccccccgggaggccgcggccactcccccccgggccggcgcggcgggggaggcggaggatggaaacacccttctacggcgatgaggcgctgagcggcctgggcggcggcgccagtggcagcggcggcagcttcgcgtccccgggccgcttgttccccggggcgcccccgacggccgcggccggcagcatgatgaagaaggacgcgctgac

SEQ ID NO: 317 - DNA, 796 bp, Homo sapiens
gagctctgcatcctgacaatcagaacaaaccatgcatctcacagtcctacagtagaaagctagggtcaattagttaccaaaattgatacttattatggggagaatttataacagaatagatggcaagccatttttacaactctggctatgcccttggattgcacaggcaagattaggaaattaataacatagttgcgctccatctatcttttggaaaacacatctaatttttccccttagcttcatttttatgtttccactttgtgcagatcttttacttgctttttcctccctctcatttaactcttaaaagaagaacgggagcaatgttcccacaagaaagttagtacttttcctgctcagggcatcccatgattcaaaggagaaaatgttcaggtgtttataagaacacctgaccatttggctgcacctcaagaactgggatcaggaggtctgagtccagagaaggaaaataaccagttggatcagtgggcgagagatgggagaataaatagggttgtgacaaagagaaggtcagctgtaaatgggtcaggagaccagagtggacagagtaggccctggaatgcttgctcggaggcctgccatgaaggatttctgcttgcttccccaccctaccccgggggcaggatgactcagcacttcctattgttgtgaaggccaaccccaggaggccctaccaaggctgactgctgttaaaaccagactgcactccttctggctcctggttcattcaaggtctacatagttaaaggttgttccagagggatgtgtgtaa

SEQ ID NO: 318 - DNA, 1028 bp, Homo sapiens
cctggagataagcctgattctgactttctttgaaggatttttttctttcgacttctttcctgtgaaagagaatatccgagaaatgagaattttaactaaagagaaaacctttgcatttgctactgataaatatctggcctatgcgggaaagtcatgggtgccctgggattctggctccactgctaacaagaccttgttagaccttcttaactgcccctccagagaggagaaaggctcttggaggtagagtgagattggggagcttggcagagccctaggatgaactgtgtttttgttttgttttgttgcaggttggagcctttttcctgcagaaagagaagcaattccgggcttttccacagataacctgctagggctcgcagagacctggattctaaccccatctcgcctttcctcacctggggcattgttttctgcgtttgagaactgctgggtgggctggtgttacccaggatttttaaatttttgcaggagacgctttgcaggagatctctagggcttttttctgtgtcaattaaagagcctggccagctggacctgggctgtctttttgacaaaaacaaacgtcatccccctcccagctgagcacttgttagaactggactttaactgagggcctgaaccccctaacaacgggacaaacagtatgaaatcaaaaccgtttaccctcctcccaccagcggtttgcgtagggccttgggtgcactagcaaaacaaacttattttgaacactcagctcctagcgtgcggcgctgccaatcattaacctcctggtgcaagtggcgcggcctgtgccctttataaggtgcgcgctgtgtccagcgagcatcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtcccc

SEQ ID NO: 319 - DNA, 1037 bp, Homo sapiens
tgccagacatttgagggtagaatggaatgtcttaggtaaagatttggagtaaggacatttcgtacagggcagagtgaacaaattctctgatcaccgcaaaaggtaaggcaaactgacaaattgatccctttttaattttgtttttaattaacagaactaaacctaacggaaagaatgtgttgccggagaagaacgaattgatggccttttattaccacaggaaaaagtaaatgtatctgggcagcccctcaagtctcagcaaaaggaacgtacagttcctgccatgtgccggtctcttctgaagaaaagggggcggtgggggtgggggcgcaggtctttaggttgtttattcctttctctctgtccagtggcagagaagcccatacttttgaacgcagcttgttggctactgtaaaagccctgctctgagcaaggaccaatgagcacgcggagtccaaactcttggaaacagtttgtggccaggagtacttgacattgagacagcctccgagttgtaaacaagggcgagcctgggcgggaccccagcccacgcgactcggagccccgtcccaagaggctaatcttaagcccacgttgccccagatacctgtttctgcttcctcttccctgttcttcccaccctttttccgtcacagccgcgggcaccggtgccagggcactccgtggtcaccgtgccaggccattctgtgatgaccgcggctggaggggcggagcccatagttctttctctgatctgattggcgcgacctggagttcaggacgcgtttccaagttccagtgactcctcctgtttgggactcggggggagagtgcggggagacaaataaaacctcgggcggcggcggctggtgggaagacttgaacttgaatctcgaaccactgcatctccgactctgcccagactcttcactccgcggcaccctcaaaccccagcccaggccggggcgcacaagccagccagcgcacctgcagtcctcgcccggacgcgccgcgccccctcggaaccaggctctgct

SEQ ID NO: 320 - DNA, 974 bp, Homo sapiens
cagccttactacgtttcccagaattcagtgaggccacgaagacaggctccctgggcgcggacggaagactggccgcatgggatttgtaggtaggatccgcgccccgcccgacggaggcgtccagtggggaggtgtgcagggattggttgggaagcgctcaagccccgcccacagagtgacgtcaggtggcggtattgctacttaaggcgtcgtggcctcccctgccccgccttagctcccgcgctagagagaaacatgtatcgttttcgatcacagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtaaggggtatccccgccgccggcatcccagttgccggccaggctggcgagtcttccatgcttcggcacggtgggagttgtagttctttctctgatgtacacatttgcatttccagggtgcgtggtttggctactgaactacaattcccagcgtgccctgggcgctgctcctcgcgcgatttagatctggcgtgcgaaccggactcttgggcaccggccgtgggggcagggaggaacgggtccttgggcctgagagtgtgtcgggacaggggctgaccgggagctgggcgggaaaggaaccattgtcagagttcctttctcggcggcgatctcgcccgatctctccccgaccacgggtggggaagaacggggagttgagcccgtgccgtcactggccgcctttgacaccctggctccaacatg

SEQ ID NO: 321 - DNA, 917 bp, Homo sapiens
gtgtcaaaggccagacacaacttccaccccaggtgaatgtcgggaccaggacagtgagcaggcaaaccttgcccttgccctccttccctccacaatcttaaagctccttgaacaacccccatccccaccccctgagaatgtctgtgccctcctgctgaaagggtttggcctttcagtgttcccctccaccatgagctgtttccatgaaaagatctcaagggtgacttgaggctacggtcatcactaccacaagccttttcccatccctgcctctacctattgccctctaaataaggaagccagcgctgccaggcaaagaacttctgcccaatatgggtcctgggtggcctctcgcctctctctttccctgggcccccagccagctcccccctcccccagagatgctccctgctcacttcattcctgcctcatagttggaatgacagtggctcccagaacccctggggagtgtggagggtgatgggggtctggggaggcagccaggcccaagagcaggttaatgttacagccctggataagtgagctgggcgggttgacgtcagggcgatgatgggtggaggggagggccgggctgctgaagcaactataaagataggtcaaatcaaatatcatcaactagggacggagcaagcgggcgagctagagagcgtccccgagccatggtctctaccggccgcggctcagcctgggtccctctgctctcaacccgagtgcccgatggaggctttggtttcatgtcagcagccttcatctgccttccaaaaataagcccctgccgccatgccggagggagaaaaacaagaagggcggtatttttagggccattaattctgaccacgtgcctgagaggcaaggtggatggccctgggacagaaactgttcatcactatgtcccg

SEQ ID NO: 322 - DNA, 1026 bp, Homo sapiens
atgagacaattagagaggcagcgtaagggaatctataatcagctcctttaaggggtgaggcagaggctgctgcaagttgagcatcggtctgtggtcttgtctgtggagggggttaaccaacctgcctgccacaccctggctgactccagtgggccctgttccggagactggggtctgagggggacccccagggctccacccagttttcctcagcatgtcagagttcagcggctagagtcgggtgggctccgagacaacaaacggggctcagcagagagggggtctttggcgtgtgtccctccactaaaatccagcctcgaaggggcacagctgttctcccagccctgcggtcagctgttccctgtgaggtcatcatcgctcacaggcattccccagtcaattctggggtcactaggtggcttggggagaggtggaaacccgtgctgaggtcgtcaagaggccgttgggaacacaatgccaccaaccaggtcagcgctgggccgccagtgcccgggatctaggccgccaaaccccaaacccctaaccgagagcgctccgcccccatttccgctgcattctggaacgcgtagtcccggagcggcccttttcaagagggctgggagcacataaaaggaataacaacagcggggcacactgggaaccacggcgccgcggcggggcgcccggaaaacggacacgcgttgcttcctgggacttgaagtccaaggtttgcctccgcggtagaaacggagccctggagtcgagtgctgcagagagcgtgagcgcagacggctgggggttgtagtcttcttgtcctcggtctcgggcattgcggggagacctagtcgttttaggactacaagccccagaaggccctgcgcgggcagacggggcggggctggaggctcaggtgccgcctcctctgcaacgccggggccagagtcttaaaaccgagggcccgcaggggtccccgcggccgccgcgatgcagaaatacgagaaactggaaaagattggggaaggtaat

SEQ ID NO: 323 - DNA, 845 bp, Homo sapiens
acgcgtggctccgcaggctccattctccacacagtcgtctaggggggcgccaggagccccgcgacgggccaggccggaagctcagcaagtgcaccaggcggcgaaacggccggctgcgcagggcagccccggacacagccacgccgcggccgcccggcgctcccccgacccagccgaccacgaagccgccctccccctcacaccgcagaacctttctgccttttactacttttcaaagtggacctaggctcctggctcgagcctgaggggatacaagggatcacgaggagcgccatcaccgtgcaaggtcgacagcttccgctcaaagccctgtggcccacgcttccggcctcgaccgactacgtcatcaccaaaccccgtgatacctcactccaccttcaggtcctccgtcccaacggttccgtgtcctggaactttccacgttcctgcgcacgcgctctgcggcccttaacgtcccgacttcgccctcctctggccacgcccctgcccgttaagggccctgccacccccgtgacgtacctatcttccctcgggcaacctcgcaacagatctctgattggctgacccaggaagcggactttgcgaggcggcggcgacgataggctggcagccggccgacttccgcagaaggtgattggtcggcgctgctgtccaatcggcggcgggctgtcggattcaaatccggatcgttgggactgcggtcgttagtctccggcgagttgttgcctgggctggacgtggttttgtctgctgcgcccgctcttcgcgctctcgtttcattttctgcagcgcgccagcaggatggcccacaagcagatctacta

SEQ ID NO: 324 - DNA, 1012 bp, Homo sapiens
ttggggaacatccattatcaaaccacctctctctctttcctctcaaccctctatgtccccaagtcgtttgctaggcatgagcaaggagtggaaaatgaggaagggtaggaaaatagcaaagatctcagctgataataatacaaagttgccacgaatgatcacggcaaacacttatattgcgcttactctatttgtgccaggcattcttggagtgctttacatgtactaattcacttaattctcacaacaatcctgtgactgttcccattttacagatgaggaggccgtggcacagaaaggccagaagtgtttaaagagcagagccataattcaaacccaggaggcttgtctcagagccacttgtctgctacttgaaagcacagaatgaagaagacaaagggtttgggctttcgaattcccttctacatacacagatctaggcttccataccacattgtaagtaggaaactctctgagcacctagcctctagcatggtgtctattccagtgtacaagctcaataagtacttgtcataggaaagaatgtttcatgtcaattaatagtggaaccctttgcaacatactgagtccataaaaccataaaatcccaattcagttggcttggaaatagcctaacttttgcttcagtgcggcctaggagggagcttatgccacttagaagaatacattttgacaaatttccttgcaatacgaatttaaagatcacctacctttctaaaaatagcaaagaggccagatgagaacaagctttcttacctgtccctaaactacaaagtgtcctcagcgaatcagaaagtatgacagagaaaaaaaagaagaagcacagagaggaaatgaaccaagacaacatcacctcacagcaaccggaaggaaaaacacacacatacatatgccactcacatccgacgtgtgtggttgctcagtagggaaatgcttacagctgcctctagaagcaagtccgctcgctgcatggagagggaaacatgagcat

SEQ ID NO: 325 - DNA, 979 bp, Homo sapiens
ccacacccctctcttatgatgtttcattattactgcataaatttcctttattactcatgataaataaaaataagatacctgacaaagtgggtttaaataggtaagagtgcaaacaaagatttactgtacaaatatgatgaaactgggatctcagattcttaaagtataatttttttttgtcttatgtgtgccaggttgccactctcaatctcgaactagtttttttctcttttaagggttgtatccataatgcaaaaatggaaagaattaaaaagcacacgcaaaacatgattctcgggatttttctctatttttatggttgactaattcaaacagaaagacacatccaagagaaaattgctaagtttgatacaagttatgaaacttgtgaagcccaagtactgcctggggatgaatttaacttgtatgacaggtgcagagctgtcgctttcagacatcttaagaaacacggagttattttgaatgactttctctcggtcacaagggagccaccaacgtctccacagtgaaaccaactggctggctgaaggaacagaaatcctctgctccgcctactggggattaggagctgagggcagtggtgaacattcccaaaatattagccttggctttactggacatccagcgagcagtgcagccagcattcctggcggctccctggcccagtctctggcgcatgcgtcctagcatctttgggcaggcttccccgccctcgtgacgcgtcggcccgggcctggcctcccggcgatcacagcggacagggggcggagcctaagggggtggggagacgccggccccttggcccagctgaaaacggaattctttgccggctggctccccactctgccagagcgaggcggggcagtgaggactccgcgacgcgtccgcaccctgcggccagagcggctttgagctcggctgcgtccgcgctaggcgctttttcccagaagcaatccag

SEQ ID NO: 326 - DNA, 922 bp, Homo sapiens
cacttcttccccttcaattccttgaattgagtctgcattatcattcctattgatctttgagcccagaacattactttgtggtctggcctaaggtttcttccaattttttaaattacaatatccctaagaggacagcgacgaggtctggggtgttatgaggattggaaacctagccacaagtgaccatgaaagtccaaaatgcctctaaagtctttgtctctaaggcccattttcaaggtcttgttatatagctaatttttccccgacttatgtcaaaaataaacgaagctgggttctaggtaaaatggtaggggcagattttaatcactactactactgcaatggggaaaagaacccagcgtgaactgaattcaatttcgatttgtagaggcaaccgggcgttttaaagagaatgaaggaattaggatgggactgatgacgccgagggggactgagcaactttttcaggtttgaaaagcctcaacatcaacgcgcgacggcgctctttcaacatcagcctccagaactggggctgcagccaggagggaactacaacgcccagcagccccggcgggtgtaaacactcccaacttccgaggcggtgctcaccatcggccatcagcgccagtgccactcgcgccctcaagaagccgcacggagttcgggccggcagcagcggctgcagtcgtatggcagtgagccgctgtctacccagcgagacggagagctcaggacgcaaccctatgagttggaagccgcaggaggcggaaccgggttgcgggatacgcgttgacgtcacatcctctgggcggggccgcaaggaacccgcgcaaattgaaaggtcagcctttcgcgcgctgtgtaggcaagttacccgtgttctgcgttgccggccgtgggtgctctggccacagtgagttag

SEQ ID NO: 327 - DNA, 955 bp, Homo sapiens
ggagaagatgcgtttgaaaaagaacacggaagagggagagagaaaaaaagcaccaaggtccatgttcagagagccctggtaattttaacttgcaactcacccaagaagagcctaatggtcgcaagagtatgtaggaaggccccaacccgacccggcccagcacgcagcacccaagggcggctggaagcgcaatgcgcgtgcccagtacagcgctattcagtctgcaggctttttgaggatttcaacttcaaagaacggtcggcttcggggcgaactttgcttcagttccaggcctcgggaggcagcgaggagacagactgggacaccgagcatgcagaaggggagtggtcttgaaatacgcggaaagggagaatgcacccctcctggccagccttgccgggcgaagtgagaagtactgaggcctgagaaggctccacgcgtgcgcaaagggccgctcgctgtgattactggggtggcgatggttgtgatgacgccgctgccccgcctgcgccgaaagggaaaccccaggggaggcggaggccagcggggatttctgaagccaagtggtccccttcatccacgacggacaggaagggcgaccccctgaggccacttccaggtcttgcgaccggaggagagttaccaaggagacgctcctcccgaggcctcgcgcgtcggaagcttctgtcccctggattccggttgacggacgcgtcccccgagcaggttctcggtagcagccgacacgccccaccccgggcacagcgaggtctgaggaccacgctaaggcgtcacgtccgccctgatccgcggcagctatggaacgggcggagccgcagcggagggcgctccgctttgacgtcacttcctgtgagcccggcggtgacaacggcaacatggccctgaacggagctggtgaggacctgggcggcaggggtttgtggctgtgaggtac

SEQ ID NO: 328 - DNA, 1008 bp, Homo sapiens
aattgcgcccactataaaaactgcccctccgaggcaaagctgtgaacccccgcgccctttcccccacggtcccggaggatgaagtggggtgcaacggagactcagctgagcgtccagtttcgggcaatacaaatctctcggcttctacgagcagccagacgaccccgcggaccgtcgctcctgaacttgaccgagatgcaaacttcggagtgttctcaacgtggggggccgactctcgggagaccgcccctaaacttaagtccccttaggctcgcccccacctgggacttcacagagccaccttaagggcggtattcccgcccccccggaagtgcgggggggtggcagcgtacttggattctcagcctccagccccgcgcggtggcggccgccggtggatgacttcgggccccacaagtggggaaacaacaaccacccctcgcccgcacccctggcccaaaacaactggccaggttccctggcctcccgggtccctgcatcccccgcatccccgtccgcagccgtgaacttgagcccccctccatcagaggttgcgagcgtccgcccgctcgcggcagccaccgtcactagacagtcaaaccccaagacgtcagcccacaatgcaccgggcgggccgggaaaaacggcccggggaggggaccggggaagagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctcagagttgcactgagtgtggctgaagcagcgaggcgggagtggaggtgcgcggagtcaggcagacagacagacaca

SEQ ID NO: 329 - DNA, 948 bp, Homo sapiens
acccgtggagctcacattaactatttacagggtaactgcttaggaccagtattatgaggagaatttacctttcccgcctctctttccaagaaacaaggagggggtgaaggtacggagaacagtatttcttctgttgaaagcaacttagctacaaagataaattacagctatgtacactgaaggtagctatttcattccacaaaataagagttttttaaaaagctatgtatgtatgtgctgcatatagagcagatatacagcctattaagcgtcgtcactaaaacataaaacatgtcagcctttcttaaccttactcgccccagtctgtcccgacgtgacttcctcgaccctctaaagacgtacagaccagacacggcggcggcggcgggagaggggattccctgcgcccccggacctcagggccgctcagattcctggagaggaagccaagtgtccttctgccctcccccggtatcccatccaaggcgatcagtccagaactggctctcggaagcgctcgggcaaagactgcgaagaagaaaagacatctggcggaaacctgtgcgcctggggcggtggaactcggggaggagagggagggatcagacaggagagtggggactaccccctctgctcccaaattggggcagcttcctgggtttccgattttctcatttccgtgggtaaaaaaccctgcccccaccgggcttacgcaatttttttaaggggagaggagggaaaaatttgtggggggtacgaaaaggcggaaagaaacagtcatttcgtcacatgggcttggttttcagtcttataaaaaggaaggttctctcggttagcgaccaattgtcatacgacttgcagtgagcgtcaggagcacgtccaggaactcctcagcagcgcctccttcagctccacagccagacgccctcagacagcaaagcctacccc

SEQ ID NO: 330 - DNA, 803 bp, Homo sapiens
tgtctttcaatctggctgtgctattgttggtgtttaacagtctccccagctacactggaaacttccagaaggcacttttcacttgcttgtgtgttttccccagtgtctattagaggcctttgcacagggtaggctctttggagcagctgaaggtcacacatcccatgagcgggcagcagggtcagaagtggcccccgtgttgcctaagcaagactctcccctgccctctgccctctgcacctccggcctgcatgtccctgtggcctcttgggggtacatctcccggggctgggtcagaaggcctgggtggttggcctcaggctgtcacacacctagggagatgctcccgtttctgggaaccttggccccgactcctgcaaacttcggtaaatgtgtaactcgaccctgcaccggctcactctgttcagcagtgaaactctgcatcgatcactaagacttcctggaagaggtcccagcgtgagtgtcgcttctggcatctgtccttctggccagcctgtggtctggccaagtgatgtaaccctcctctccagcctgtgcacaggcagcctgggaacagctccatccccacccctcagctataaatagggcatcgtgacccggccgggggaagaagctgccgttgttctgggtactacagcagaaggtaagccgggggccccctcagctccttctcggtcttgtctctctcagatgtaactgagctgtgggctaggaggaaaaggccgggaggaggcacggtgatgactgaaaaacctctcccctctcataagaccagtcatccg

SEQ ID NO: 331 - DNA, 1027 bp, Homo sapiens
cccagagagcattcttgacagatgcgcgcttggctccagcaacccgctctgctgggaagtttcttctaaccactaacacccacctccaatcccccaagctgtcacgacgcatgctggctgggtcccgtcttgacgggggaagggttttacacacaccctgctaggctgccccacatcacaaccaagctcgcagggcaaactcctccaagcctggcggacaagctgtcccaggcgctctggcgcttcctgaacaccaaggtcccctccccgctcaagggagctagcgctctgttccgcagagaaccccggaactgcaggtcgaggggatgcggggggagcgggggcgcaggagggagccgagtgctggaggcaaacggggcgcaggagcgggtgcgggaggcaaacggggcgcaggagcgggtgcgggaggcaaacggggcgcaggagtgggtgcgggagcgagtgggggctgagggaggggacggggccccggggggagccaggcgcggaagggggcgcgggggaacagggaccaggaaccagcgggcgcaggaaggggtgcgtccgcaggaacccgcgggcgcacgggaggcactagctacgcgatcagctcgggactctcaggagccgctcaattgccaacgggaggggggtgcggggagttggaggtgggggtgcagaccagacgggggcgtgcctttgcccggattggctgcaggagcctgacgcgaggccccgggggttggcttggggagtgggagcggggtggggtgggtgctgggtgccggagctgcgggcccggcgcgctcagaaacatgctgaagtcccggcggctcttccagcagcggcagcggctccagcagcagcggcggcggcggcggcggcggcagcggcagcgacagcgctcggctcctgcgggaaaggcgcccggcgcccatgcctccggccccgcgccgcggctgccctgacccggccgcgacctccctctgcgcaccacgccgcccgggcttctggggtgttccccaac

SEQ ID NO: 332 - DNA, 1028 bp, Homo sapiens
gctcaaagtagactgggatgtggccgtgcttggtaaactgtaaaatgattagcatacgtgaagcgttagtgtgctccctggcagtcagtcctcacgtttacgatggattaatgaaggcagccaggcacaatctcaggttatgaccttataaggcataataggattacaaggaggcaaaatgaaacagtatatttcctcctaattttggttattcctatgtttccaaatagaaatgaaaattctgaaatttcagataattcccccctccaaatcccaattctcaatttagcttttctgagccttgtccctaccgtgaaatcttactagctcaccccgaaacgccggggtcttggtcctctgggggactagtgagtcctgctcctctcggctttgctccgtccctgccccggcccctccgcgggagtctggggtcgcggcccggtcaggcgccaagccggcaggggggcgcggtccacttgaggccacagctccccaggtccagggctcgggccatccgcgctgtcccttccgcgggctcttgctgttcttcgccaggaggctttgcactccgggccgcatgggtcctggataaggacctcaagaggttgtagtggcgccccttcgctccggcgtactgtctgaaccctgtgcccaaagagggctgtggcagttcctgcaccaaccgcctggagcccatacctaagccctctgggcacgagggacctcctctcccccgctcccccctccccccatcccaactccagccccaaaggaagcaatgcgcgcgtccgagagcaggagcgcgcgtggctgaggaaagaaagggaaggcaaccgggcagcccaggccccgccccgccgctcccccacccgtgcgcttataaagcacaggaaccagagctggccactcagtggtttcttggtgacactggatagaacagctcaagccttgccacttcgggcttctcactgcagctgggcttggacttcggagttttgccattgccagtgggacgtctgagactttct

SEQ ID NO: 333 - DNA, 1023 bp, Homo sapiens
ttgcacagtgtttatctgctggtgtctcagggatttgacagtttccttaatattcccacacatggccgagaaaaataaataaataaatgcgctgtcttctttaaaaaaataaataaataaagtacccagtatcgtaaagtaggttatcgtattctcttattttggatcctccactttctgcttccaaacgcaggaacagtgctagtattgctcgagcccgagggctggaggttaggggatgaaggtctgcttccacgctttgcactgaattagggctagaattggggatgggggtaggggcgcattccttcgggagccgaggcttaagtcctcggggtcctgtactcgatgccgtttctcctatctctgagcctcagaactgtcttcagtttccgtacaagggtaaaaaggcgctctctgccccatcccccccgacctcgggaacaagggtccgcattgaaccaggtgcgaatgttctctctcattctgcgccgttcccgcctcccctcccccagccgcggcccccgcctccccccgcactgcaccctcggtgttggctgcagcccgcgagcagttcccgtcaatccctccccccttacacaggatgtccatattaggacatctgcgtcagcaggtttccacggcctttccctgtagccctggggggagccatccccgaaacccctcatcttggggggcccacgagacctctgagacaggaactgcgaaatgctcacgagattaggacacgcgccaaggcgggggcagggagctgcgagcgctggggacgcagccgggcggccgcagaagcgcccaggcccgcgcgccacccctctggcgccaccgtggttgagcccgtgacgtttacactcattcataaaacgcttgttataaaagcagtggctgcggcgcctcgtactccaaccgcatctgcagcgagcatctgagaagccaagactgagccggcggccgcggcgcagcgaacgagcagtgaccgtgctcctacccagctctgctccacag

SEQ ID NO: 334 - DNA, 945 bp, Homo sapiens
ttccaccaaagcttacctagtgctaaaggatgaggtgttagtaagaccaacatctcagaggcctctctgtgccaatagccttccttcctttcccttccaaaaacctcaagtgactagttcagaggcctgtctggaataatggcatcatctaatatcactggccttctggaacctgggcattttccagtgtgttccatactgtcaatattcccccagcttcctggactcctgtcacaagctggaaaagtgagaggatggacagggattaaccagagagctccctgctgaggaaaaaatctcccagatgctgaaagtgaggccatgtggcttggccaaataaaacctggctccgtggtgcctctatcttagcagccaccctgctgatgaactgccaccttggacttgggaccagaaagaggtgggttgggtgaagaggcaccacacagagtgatgtaacagcaagatcaggtcacccacaggccctggcagtcacagtcataaattagctaactgtacacaagctggggacactccctttggaaaccaaaaaaaaaaaaaaaaaaaagagacctttatgcaaaaacaactctctggatggcatggggtgagtataaatacttcttggctgccagtgtgttcataactttgtagcgagtcgaaaactgaggctccggccgcagagaactcagcctcattcctgctttaaaatctctcggccacctttgatgaggggactgggcagttctagacagtcccgaagttctcaaggcacaggtctcttcctggtttgactgtccttaccccggggaggcagtgcagccagctgcaaggtgagttgccttcatttctggggaagcggctgttttgagagggttttgtttcttcctctttgagaaggctcagaaaattgtgggaattttctgcctacagagagaaggtgttgga

SEQ ID NO: 335 - DNA, 1096 bp, Homo sapiens
tttgaccagcacttggaacactacctcagggtaacttaaatgaaagtccattttccaggatggagtaaactgacagaaatttccatcgtgcatcaaatctgctataagttgtttgccttctgggtatttttgggccctagttgtactcctgaagaaataaccactgttgctccaagtagaaagtggttgaggagacagctaacagatacgtccagttcttattttctatcacagagatgtgaaaaaaaaaaagcctaaattatcttagaaggaaaagcattcctctgtgctggatttccagtgcttcccagctttgcactgttagcttattttttccaatgtccctataataacaatccactcctttctctgcactcctggcccctcgtgatgttttatcatgctcatgctgaaagaaaaggtgtctgtccatactgtatctcttcatttggcctcagggatttccctttgatttggaaagaataatctttcaaattccgctataaactatacaggagaaagagaaaaataagataaagctcctggaatgtgcactggtattgacatttcgttcaaataatgggctgaaggtgaactatctttactattgctcatgtgaatgatcaattattatcaatccaaactatcaacagtgctgcttattattgatttatactgcatggtttaattttgtctccatccttccagacattaaaacatagccaatatttagcagttcccgccattcaccatgagcacctccacagcccccaactcctctctcccagttctgcccaggatatttatggtgagtagcgagttatctcctctttggcagtcatccctgctttcctgtgtggaggaattgcccacattcgcatttgcaaacagaggctcactcaagtgtcactaaaggaaaggaggtggagcctgaagagctttaaaaagcaaagctgagtcattccacttttcaaaaagagaaactgttgggagaggaatcgtatctccatatttcttctttcagccccaatccaagggttgtagctggaactttccatcagttcttcctttctttttcctctctaagcctttgcct

SEQ ID NO: 336 - DNA, 1214 bp, Homo sapiens
agtctagagcccatttgcatgagaccaaggatcctcctgcaagagacaccatcctgagggaagagggcttctgaaccagcttgacccaataagaaattcttgggtgccgacgcggaagcagattcagagcctagagccgtgcctgcgtccgtagtttccttctagcttcttttgatttcaaatcaagacttacagggagagggagcgataaacacaaactctgcaagatgccacaaggtcctcctttgacatccccaacaaagaggtgagtagtattctccccctttctgccctgaaccaagtgggcttcagtaatttcagggctccaggagacctggggcccatgcaggtgccccagtgaaacagtggtgaagagactcagtggcaatggggagagcactggcagcacaaggcaaacctctggcacagagagcaaagtcctcactgggaggattcccaaggggtcacttgggagagggcagggcagcagccaacctcctctaagtgggctgaagcaggtgaagaaagtggcagaagccacgcggtggcaaaaaggagtcacacactccacctggagacgccttgaagtaactgcacgaaatttgaggatggccaggcagttctacaacagccgctcacagggagagccagaacacagaagaactcagatgactggtagtattaccttcttcataatcccaggcttggggggctgcgatggagtcagaggaaactcagttcagaacatctttggtttttacaaatacaaattaactggaacgctaaattctagcctgttaatctggtcactgaaaaaaaattttttttttttcaaaaaacatagctttagcttattttttttctctttgtaaaacttcgtgcatgacttcagctttactctttgtcaagacatgccaaagtgctgagtcactaataaaagaaaaaaagaaagtaaaggaagagtggttctgcttcttagcgctagcctcaatgacgacctaagctgcacttttccccctagttgtgtcttgccatgctaaaggacgtcacattgcacaatcttaataaggtttccaatcagccccacccgctctggccccaccctcaccctccaacaaagatttatcaaatgtgggattttcccatgagtctcaatattagagtctcaacccccaataaatataggactggagatgtctgaggctcattctgcc

SEQ ID NO: 337 - DNA, 1094 bp, Homo sapiens
taaatggcgccactgaagaagaatgaataaggtctagtaatacaacagggtgactacactcaacaataatttattgtacattaaacaaactaaaagtataattggattgcttgtaacagaaaaaaaggataaatgcttgaggtgatggatagaccgtttaccctgatgtgattattatacattgtatgcctgtatcaaaatatctcatgtacctcttaagtatatatatatatttacctacttcgtactcataaaaattttaaaaggtacataaatgttatcattgcatcctcttaattttatttttcagttccagagggataatcctgtctctgccgcaaatgcagcaccttcctcagtcttggggcgtccatcaagcggagagctggaatgtgactgaaagtaacagagtataggtggaactagaacaaggtcacgagctggtgcccaactcgtgtaactcctggttccaggctgtccctctaggatgctgttggcgccagccgtggtagtaggacagagtctgggtaaaggtcgcctgctgacaagatggtagctaggagacctctaggtgcgccaaaattagggcgtcttttcctggaccggcaaaacgccctgctcaaagctcattacatcaccacgcccaagaactgatactttagcagggcaacgcaccaaccaagcgactccgccccaccctccccgctcctccagcacacgcaagcgcacagaggcccgcgagtgacgtcacctctcccgacaccacctcgttgtcgtacgaccaaaggcctgtcgtaacggccgggaaaagcctcgagaagaagggcacgcacgccgtacaccctaacatgctcgccagcatgcgcgcgcaggtccttggcgcaggcattgggactggagccaatgaggtgcggcgacgttactgcgtagccgccagctcggccgcacgtcagggcgcgggagcgcggagcgagtttggttgcacttacaccggtacttaagcgcggaccggcgtgtccttggacttagagagtggggacgtccggcttcggagcgggagtgttcgttgtgccagcgactaaaaagaggtgaga

SEQ ID NO: 338 - DNA, 987 bp, Homo sapiens
gttctgctttgcaacttctctcccagtgcgagagcgcggcggcggcagctgaagacccggccgcccagatgatgcggtggtgggggacctgccggcacgcgactccccccgggcccaaagtacgtatgcgccgacccccgctatcccgtcccttccctgaagcctccccagagggcgtgtcaggccgcccggccccgagcgcggccgagacgctgcggcaccgtttccgtgcaaccccgtagcccctttcgaagtgacacacttcacgcaactcggcccggcggcggcggcgcgggccactcacgcagctcagccgcgggaggcgccccggctcttgtggcccgcccgctgtcacccgcaggggcactggcggcgcttgccgccaaggggcagagcgagctcccgagtgggtctggagccgcggagctgggcgggggcgggaaggaggtagcgagaaaagaaactggagaaactcggtggccctcttaacgccgccccagagagaccaggtcggcccccgccgctgccgccgccaccctttttcctggggagttgggggcggggggcgaagcgcggcgcaccgggcggggcggccacgccaggggacgcgggcgtgcaggcgccgtcggggccggggtggcggggcccgcgcggagggcgtgggggcagggaccgcgggcgcccctgcagttgccaagcgtcaccaacaggttgcatcgttccccgcggccgccgcgcggcccctcgggcggggagcggccgggggtggagtgggagcgcgtgtgtgcgagtgtgtgcgcgccgtggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagac

SEQ ID NO: 339 - DNA, 934 bp, Homo sapiens
ttccacttgtcaaagctttcctctttgacaagtgtcttgggtcttgtcaagtgtcttgtgtctcaaacaaggcttccaaaccccctaggtcctgagtagcttcgctctgcagatgacaaaaccgagactcagaggttaagttgcttgcccaaggtcacacagacgtactgtagacccccatcatcatctacgcagctgttaaaggacatagtcatgtaacccgtgtggcacaagcgccttctccttcctcctgcccttcgctaacgttagcttttcctgcgacctcttctccgctagccagcgcgtatctgcgtctagccgggatgcctgagccccagtgcgaactgttgtgcttgcagcttcgggagacacgtgctactcgggtgaatgaatcgaacgtccccacccccgccgacagccaataactgcgagccacagcccggccacttccgcctattgcgggcgtcggctagggtccggcggcccacgtgaggctccggagacaagggagtaggcggtggtgcgccaggggcgggctctcccagcctcgccacttatccaggcgctcgccggggacgggaggggcggggctgacgtggggcgccaaggcttaaacgtgacggacaggcgggcacagggaggagtccagagcctaggggcgaggagtgacggagaacactgcccaataacgggaggggttgggctgtctgggccaataggaagtccgtaaggcggggccgggactgcagcaagttcggttgcacggagaccgcagctgttctctgtcagtggaggcagcagcggtagaggcggcggcgaggactggcgacggcgaggaggtgagtgtccgccgcgctccgcacggtcctcttcccgcggcgggtcggagcgggtggacgtgcgccggcaccgctgcgagggacgcttatgtaag

SEQ ID NO: 340 - DNA, 1139 bp, Homo sapiens
gctctttatgtttcccaagctgatcttgaactcctggccccaagtgatcctcctgccttggcttcccaaagcattggtgttacaggcatgagccacctcatctgacctcttctaaaatattataaaataaatacagacatcaaaatgaaaacaaaagaaaaagaaaaaacaaaacaaaaatccccaaaacaacaacaacaaaaaatgcagacatcaataacattcaccactaaatactctagtaagcatctgcaaaaacaaacaaacaaacaaaaaccagaatcccacctaagcatacagccattgtcgtaacagtgatatctacttttttggctgaagtgtctttttttttttttttttttttttctgtgagaaggagtcttgttctgttgccaggctggagtgcagtggcacgatctcggctcactgcaacccaacctccgcctcccgggttcaagcgattctcctgcctcagcctcctaagtaacacacacacgccactacgcccggctaatttttgtatttttagtagagacggggtttcaccattaagtgttttaatgtaggtgcaatgcctggaatagctgctggccaaaatggagggctcaacacattcctttaacatttaccaaggacctacttcgtgctgggcactggtccaggagctgggggcacagcgggaagcaaagcaagggttaagtgttttaagtgtttaagagatgcatatttcaggatgcatctctagataaggacattttccaaaataccagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgag

SEQ ID NO: 341 - DNA, 918 bp, Homo sapiens
aagcgacttagggaccagagccaccccaagcgccgacttcgcccgctcgcacgtcccgggtccctcgcgcgcaggccccgcccctctcaccccgccgcacgccacagggtgacgtctgggctcccagccgcatcgccctgactcccgcgcgggccccgccccctgccgctagccaatctgtgcgtttgtgacttttgggcccgcagccccgcctgctcccacagcgataccggtttgcattgccctgactcccgcgcgggccccgccccctacgccgctagccaatccatgcattagtggcgtccgggctcgcagtaccgctcgctcccaccgcgagaccttctgctccgcgcccgcgcgggcccctccccctccatcgctagccaatccccgttttgtgacgtatgggctcgcggccccgctcgctcccaccgcgagaccttttgctccgcgcccgcgcgggccccgccccctccatcactagccaatccccgtgcttgtgacatatgggcttgcggccccgcccgctcccatcgcgagaccggttcccaccgccctgactcccgggcgggccccgccctctccgccgctagccaatcctcgcgttgatgacgtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatct

SEQ ID NO: 342 - DNA, 1082 bp, Homo sapiens
tccaaagtcagctattgtggaattggctgggtgcagtggctcacgcgcctgtaatcccagaactttgggaggccaaggcgggtggatcaccagaggtcaggagttggagaccagcctggccaacatggtgaaaccccatgtctactaaaaatacaaaacttagcctggcgtcgtggcaggcgcctgtaatcccagctactcccgaggcctaggtaggagaatggcttgaacaggggaagtggaggttgcagcgagccaagatggtgccactgcactccagcctgggcgacagggcgactctgtctcaaaaaaaaaagtcatccattgtgaatgaatgtacaaaacgcttattaataagtgtaatattaaaatatatcttttctgaaagttttagtgacaaaacaaattagttacagatttaatgttaccaaaattcatgtacattgaaaatttcgggacattttatactggtggtggtggggtggcatcttagcttgggtttaaatatcattagtaatcggatagctctgtagatgattatcagtatataaagacatcgtgagcagtatttaataagaagagttgctgaagtgacttttgcaggaggatgaatgctttttttaaaaaaaaagtttatacgtgcctcttcgctcttccaaaaaaaaaagagagaagaaaaagaagaataaaacgagagacgaaggtggataacacctttctctagaccccggtgcctctcatttctcgggctgcaggcgacggctgctgggcctgcgcggggtggagccgacgctgacgcgccctgcgccgcaaagcattgtgggagctcgggcccgctagtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaa

SEQ ID NO: 343 - DNA, 990 bp, Homo sapiens
cactctgtgtggcatctatcctgatcttcaacttagaaaatatactcattattccttgtaagtagaactctgcacagctgcatacagaagagcgtctcggcagggaacagtgcaggttcacaaaggggccgataaaacatataattttagctttggtaattgcccttgaagattacaataagaggaggaaaataagggccaaagaaacaaaagatttgcccgtgatttgatagctggtttcgtcacatattatgttgcttatcccacagaatgtgggaatcccagaaagcgccccgtttaaatttagaccgtatttttagcagggtccctttaacagagattgcgggaacctgggaaggaactgaactgggctaaccaaaccggtcgaaatgagcacagggattagattagagcacagaaattctggctagcagtctgagaaagggggccaaagccagcccagagaaaagggaggttgcctgggccaaaggctttctgacaggagacacaatagggtcgtacctctgggtcttaccttcactgaggtttctacccgacaggtttaactggccgctcttcctcgctgccttcaacagcccttggggtaccgaggtaccgcagtctcttccacctgctttgaaaccagcgcggagatcctgccccgctatccgcttcaggcgcgacatgttcaaagtcctaggtccagaagctgcagccccacccgtgacgcttaaaggtggcgccgttgggatgccccgctcctttcgtgagcgcgcgctctgggcgctgggctcgcggcctcgcgctgggccttcactctctgcggcgcagtccagatgtcgtcagcaccagcgcctgggctggaggacagagaagccttttccgttgccggtgccggcctagcgtcctggaattacttcaatcaagtaagtgcgtttaacgggcttaagaggggctttcgggtttattgtttgcactgttactgcgact

SEQ ID NO: 344 - DNA, 1026 bp, Homo sapiens
cttccctaaaaagagaatccccaaactggacaagcaggttacattcacacaatagcgtgaatgaattcgctggtcgcccttcagattctcattttggaatctcgaagaaagagaggtggtgggaggagggcgcttgaaacttctggcgatgccagttcagatcgattccagctatgacggagcgggaagtggataaagaggaccccaagtcacaggaggcactctgagagcaccaagcgcccggggaggccatccgcaggtgggcgcggggcctggattccacagaggggcggagtccctcagtcaggcgctggctgcaatcacacccgagcgccagccccctccagcatccctgagtcccagaggagatcgccgaagcgctggaaaagccgttccgcccacgacttctggtgccgggtcggcggcgactgggggagcccagttccgagaccgtaccgcacccactgcggacctcctgggccctacatagtaggcgggtcatgcagggcagcgggaggaggggcgtgggagggccaaggccgccgagtccccgctgttcagccagcaggagcgccccgcagccctcccgggacacggtggacacgcttgtcccagacctgggcgccctcctgccgggagccaggactggccgcagcaggcgctgtccgggcccgtgggcggggtttcgggagggggcggagccaggcccacggccggtgtcaggttgctccggtaacggtgacgtttcgcggcgtgggcggggccagcacgcaggttgcatattttaggaagtgaggaggaggcgcgggctggagctgcggcggggtctggggcgcagagcagcggcgggaggaggcggacacgtggcaacagcggtagcagcccgggcggcggcagcaacagcggcggcggcatcggcccgagccgccggccgccctcccaccctcccgccccgcggcagccctagctccctccacttggctcccctggtcccgctcgctcggccgggagctgctctgtgctttt

SEQ ID NO: 345 - DNA, 1071 bp, Homo sapiens
cccttcctgtgtggtctttagaaggataaataagaaaacatgagttctatatttctgaaatcttggtttctctattaaaaatctgttttttattcagtcaaaaaattaattgaatgtccctaattattgtgtagagccacgggccctaacttgtcttttcccttccagctgtacctgggtgtggtgctatcagccgttgtaatcataactggttgcttctcctactatcaagaagctaaaagttcaaagatcatggaatccttcaaaaacatggtccctcaggtaccagacgctttgtccttccccagtggatgacttgacagccccaagcatgtcagcctgtgaattagtgtgaagttaaggttttccaagtattacatgactcatcagagagatggatgtcttctaccccacccaaaaccaacctattttccttctatccaaaaagtggtagcctttcttttgaatgtaaactctgaatacaggcacaccatgtaacagcaatatctcttaaactggcgagcaagcttttgtaacttgtgtaaataaaaaagtgaataatatctttgttttgtattcaggtaattaggattatgactatttttattttcttgttttggacactaccttctctttgttggtatactaacggtgtaaattgtttcttttccaaagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtagctcttttattttaacaaacctcatagctagctctgctgttcgggcagcttgatttgaggggtacagtagcccatgataaggctggtgtattcacatgacatttttcttcttttcctcacatataggtggataactcctcgctcactggtgaatcagaaccccagactaggtctccagatttcacaaatgaaaaccccctggagacgaggaacattgccttcttttcaaccaattgtgttgaaggtaggccatttttg

SEQ ID NO: 346 - DNA, 958 bp, Homo sapiens
accttgagcagtttttcctctgatactgtgaccttggtatcagtatgtttacaaattatgtcatatttgtatacaattaaacatttatttatttatgattggttttaattaaactttattttttcctaatatgcaaaatatgcaaaaatcaaagtttgatatactagttatattcttaataaatatgaaaataatattaaaaaccatgcaccccttaaaatcatcctatgtattgccagtcgatgtctagcacacaccttggaaaatattaacatggaaatttcctgccatggaaataagggatgagaattggagtgggaaaatgtgaagatagcctcttataactttccctcctatcagatatgtgcaaaataattaaacaaaaattatttgtttactttgccctgcttcctgcagaaaagaagagaactcttaaaatattttgatcagatgaattttatagtcaaggactatccaaagcatggagtaagatacaactctatgtgatgaatttctatgtgagtttctatatgataaattaatacgccaaatgaaacagtttattgaaacatgcaacttttttaaaataaacaaacatcctccagaaccaaagactgatgctgttaatgctttagacatgtgacatatgtgtgtgtacctctgtatgtttaattttctttctttctaatcaagtgacctgttctcgtttggttaagtttcaaccacaagacaccactgtatgctttttttttttcaagatacacgtcacagcacaccaagaaaaggggaacttccagtgtctgtggtaacatcacttgataaacagactcctttaaacagcaagtgcctgtctgcattctactatataaagcagcagagacgttgactagcgcatatttgctaagagcaccatgcgcgcagcagccatctccactccaaagttagacaaaatgccagg

SEQ ID NO: 347 - DNA, 1019 bp, Homo sapiens
gatcttttcacgctcttgttggtttcactgacatgttcttgtcaatttcaaacgctttgtgattgtaaaaaaaaaaaaatcgaaccgatacggtcctaccactcgccctagtttcggagcccggagctgtcctgcgtgtgcgtccatgtggagtgtccggggctgcgggctcgggcgcacggtgccagccgagggctgccctccgcttttgtgttaaccggcgggcttctcgcggtccccgccgcagaggtcacacccggcgggtaacggcgtggatacaccgaagggtgactttggacaccttccccacaccacagactaacgcttctgcccctactccgcccctgctagagaagtaggaggccagtgggggagggggtattttcctgaagctccagaaaatgaccacgcattttagagaaaggtcgtgcccgcttcccagcctcacctagtctgggctggggccgggacccgcctccccaccttccccgccccccccgctcttcaacctagcggagggacagatgccagcgcggtggagtcatgccgctggcttgggcaccattggtcatgcctggaacacgcagcagcgagtacgcacatctggcggctatcccgggcggctccggtcctgatatggagagagagggcgggctggtgtgtgtctcagtgagcgaggctgggggaacgcgcctgggctggctcctccccgaacttgcatcaccagtgccccctctctccacccgccttcggccccgccttggcccctcctccaccccccttcctccgctccgttcggccggttctcccgggaagctattaatagcattacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctc

SEQ ID NO: 348 - DNA, 935 bp, Homo sapiens
actttcctccactgacctttcctggcgctccaggtcaactccaggagccttcccagtacagtctaggtgccttctccttccgcagcgcctgaaccacacaggaataagtaaggcgagagcgcgcccagagaagagcagagagtgcagaaaggggctgagttagtagaggcatttccgcggggatccttctcctgccaggcctgcaccggggccgtggcgactgagaagtgcacaggtggctcccgggtgctccagaagggccccagagctcctggcccggctaaaggcaggaggcgggtgcgcgtctcccccgcgaagctggatcagtactgggggcgcagggggcgcacgccgcgcagcgagggctggcgggggcggcctgcctggggcgctgcccaggctcacgcgggagccaggtgggggcgcggggaggagcagctgagcaggtgccgggaaggaggcgcctgcagcatgccatggcgacccgcgcacgcgacggcggggcggccgggtggcaccactggcgggaccggaagggcgccgcggccctaggatctctgcgccgaggcccgcggcggaagccacgacggccatgaccacgctgacgcccaggctgcgagcccctcgcccgggccgcctgcccacccgccacgcccaggtagcacctcggggtctccccacccgcgacaccggccgcagccccgggccccctcgcaggcgtggcccccgctcccaggccccgcccccgcccccccattggtcagtcccggggtgggggcgggcgacgcggaccgctgggcagggcagggcagggactcgcgggaaccgcaccaagcgggtggctgcaggagctcgcccatcgcccctgcgctgctcggaccgcggccacagccggactggcgggtacggcggcgacagacggattggccgagagt

SEQ ID NO: 349 - DNA, 1045 bp, Homo sapiens
aattatgatcttgattgccctgggcctactcaactgtaaattttttccagagccagaaaggcttcacagaggacaactttaccctgaaaagaaaggacctctttggtcagtggtcctcaactctgactcacctgaaagctttacaaaaagtaccaatgcccaggtccagcgctggagattttaactggcttggggtagagccctggcatcagtatttttagaggcttcccaagtgattgcaatgtgcagccaggcagagaattactgctcggtaagtgggatgactggggagtgggagatcaaatactctaacgtctcccagcacctattctagagatcagtggggcagaaaggtagaaataaaaggtggaaagggatgaaatgggtaagtgtgggtgaattagttccaggaaaacggcaatctccactgtggattcagggaaggcgtcactgaggagggctttcttaacagttcaggtcagtggaagccaacttgaggcacacatcgtgcgcggcatcctccggggaggtcgggtcatttcaccccattttactgccgagatgacctaggtccagagacggtaaagagcggtgtacgactcacacaagtcgggggtcctgtgaaccgaggttgagcctggcgggccttcggcccgaggtctttaagcgaagtcaccagacccggggttcaaagcccagaggtaggcaggcggctggctctccgcctcaggcctggagagaacccaggggtatgaacctcaacctcgctcccgcgtccagctggaggggcggagctggctggccccgcctccgggttaaacaaagttctttacagactaggcgtgaggggatgttgcagtcttgttgccacttccgggcgaagaggttagcgagaaggaacccctccacgcagcgacgacgggacctgacgtcacttccgcgcgccgccgcaaacgtcagtgtcgggcgcagacggcggcagtgcggcttgctcttggaagttcaggctcggttgtcttttgggagccatggagagtgactttta

SEQ ID NO: 350 - DNA, 1067 bp, Homo sapiens
agataagaaggatggttggaggctttgtaaggaatacctttctcttctgctcccctctcactcccataggctgggagcagttgatttcactacctcagatatgcaaattgatgccaccttcctgtagccacttttgccatagctgacctttttgttgggtggtggggaggggagcgggcaggattaggcgaggggtagtagttgggatttcttggtcttggaattcaaccatccgatgtatttgtttccctgtgtctattcccttaagtctacaggcactgtctagtaattttatagttttcagcggcaccccaggggacaggacaccttggcctttttataatcactctagagtcacaaagcagaaaggaaaaaagttaacgatcagctatgcaaaggcttgtgtggattgcttaaggacaggcgattttcactttaccagagttactaaaggacttcaggagaaggatcccgtccctgtaggagcgtttgtggttgaagaagcaggaggacgagcgctcaggtgcgcctcggcagtttgcctggggtccgcaagtccagtgctacttattagctgcttgccgtccaccgacactttagcggagaactggaggagaccccagtgggctcccggtccggccaggagcagggcgtttcagaggagaccgtctggggcttcccaacccaggcgatcaggataggcaacagccaagagaggcgctcagttgctttgcaccctcctcccacctcggttctgtccacacccacgggcgccccgccccctcggccttataaaggggactcggcacctccgcgcgcctcgccaccagaggtttcccagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagac

SEQ ID NO: 351 - DNA, 1017 bp, Homo sapiens
tatcctgcctctcaaacttctggctgggagccagacttcggatgaaaccaggcaatctcatctagggattcaacgctcccttactattgatgtcacccacgccgtttgcttccgaaaacctttgggccggaggctgcggctagaaaagcaatcaaaggtttctcgccgggcttaaagggccacatcttagtgacgtctcgggttataaaatctgcttgacaatgaaatatcgtgtgcgcgattctgctcctcccccgacatgacgtggccagacacgccgctcgcgtcagggctgccttacgcccccaggaagacccattcccactctggggcgcgcgcagatttgctgtggcacatgtactataacgcacaggcaaaagggcagtttccaaaacgtctccaacgtgatctcactccagagattttttttcctaaagttttagggctgcgcggaagggaacatggggttcacctcaggaaatttcagacgtcacccccctcggaggaaggtagtcgcgtccggttcctccccgggtgtcagttaagcaggccaggctgtgagcgaaggttctgggcggggctggactgttctaagtgagttcgggtgggggagcttcacgaggggaggctgctctgtgaaggaaccgcctttctctccgcgtgtctcacccttttctccccatatctgtttggacatgagctgagggcacggtcgcgggcggtcagccctgttcgcagctacggcgaggaggggcgcgattgttccttgttgccgctccgcttagtggccgcgtccattccgcgcggtgtcccgattttaggggtagggagaagtgtcagcttcaggcatcgcgaggcgtggcggccccatggccccgctgggaggcgccccgcggctggtactgctgttcagcggcaagaggaaatccgggaaggacttcgtgaccgaggcgctgcagagcaggtgtccgtgaggcgggaaaggtggaagggggagctctccgcatcacgtgacac

SEQ ID NO: 352 - DNA, 1016 bp, Homo sapiens
gcctgtggataccttagctctgagtcctgccacctaggatcccacggttctacgcgaggaagagggcggggagcgcggaccgggtgtgggaggccgaggtgacagcaggtgagggccgggtgcggatggggaagtgagacaagcaccgtgtgggtattactcattccgctctactaaggaggctgctggcaagcggaacttctagcctctctttcaatccagctgaagttcaatctcattgaagtcacttcccatcccggttcgcttggggggaaaccaggcgtccctggaagggaagggaagggagtccgggctgcgcgggtcaggtagcctctctccggtcgccgcgtgtcctcgccgtccccaaacctgcccttcccctcatcaagggaactccccggggagtccagaccgcgatccctttccttggccccggggtgcggggggcggacacgcgaggcgtgggactgatggtagccctgcctccaggaagcaggcaggcggggacctctgggcgctcggaggggcagctccgagggcacagggtacagggagaatcagccagatccctccctgccccgggcagccgcggcgggtgtggccagcgcggaggcaggacgccgccgagcctccaactttacctttccaactccgacagcccgtcgcctttctgaccgcgtccctacggtttcccggcatccgcctccctctccccaccacacctgaggaaaacttttccctcgcccctcaattcaaattcagcagtgcccacggttgccgcaaaccgcccggtccctagcaacaaggttccggccgtagagcgagagcctctaggtgtaaggaaggtgatgtcgtaaagccgggagtgtcgtaaaccaggtgcggtggggaggggggaggggtggaggcggaggggtgggggggaagggggagggagggggaggaggtgactcgagcatttagacacaagcgagaggatcatggcggatggccccaggtgtaagcgcagaaagcag

SEQ ID NO: 353 - DNA, 905 bp, Homo sapiens
agaccctgaagacctgacaacagccgttactctggctgacaagtcattggatttctggcgcacgcgcggcgcggcacgggcagcttccggtttccagccttgcccccgcccctaccttccgccccacctccaggctagttcctcctcttggccccgccccctgaccttccttctccctatccctaggccccgccccctgacccgcaccttcccgccgcccctccccggttccatttcattgttggattgtggcgcttcactcctgctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcgggtaagtggtgcgtcggctccggccccgagacccagcagcgggcgacgcggcgcaggaggtggaggtggaggcaggaggcggagcggagccgggtgcggtggagcagcagaggccgagcggagccgtgggcggcgggccgggaccccggggccgggccaaggactggcggggcagccgcgagttcacctgacgcggcccctcgctcggcgcccccgaggccgccggctcgccgccccacgcccgcttcgtgcgctcagctgccccgggacccgcctgcctcctcgcgaacttgggacgagttggaaaatcctccctgagag

SEQ ID NO: 354 - DNA, 984 bp, Homo sapiens
tgatggcagtgataggctagtgatgtcattgtgatgtcagtcctcctgcttatcctgcacatgcttgctaatttggaacactttatgttgaactgtggtagaggaaacaagacagttctgtctgcagaagcccattatggctgtaactggagatgacacaggtaagaatgttaaagaggggttttcagttaattgtgcagattgttttgaagtttaggaagtattcaggaacatctgagtgtttcagaaagtgttactctcctagtcacttaggtgtaagactttttttgaaatatacatctatatattcagctcactttgttagggcatcttagtgtgattgtttctttgctcaatattctattgcttgcttgactgaggcactaatcctctcttcctccctctatcctccctcccctcctccccactcttcccctcctcttctcttcccctctcctccatctctgtgtctctctttcatatgcataccattctgccctactaaaataagctgttacttcataggcaacctgttgcaaattcaatctagccgcagattaaacatacagtatataccgttcatgttctgatttcattactgtggacaaatgcagctccaaacagaataggaaaaacccgcgtgttatggatgtttgtgtgcctacttgtttctttcctcctgtatttaaaatggtctgttcagctaattgagttcaaaaggctgatgtcattacatttcctggaatcgtatttcagcaggggaagtggaaaagttaaaactccaagcgagctgcacattgacgtcagctccgagtcatgttgtgatttagtcagttcctttccgctttgtaaaatgctgctgacagatttagagttaactagctcaccactgcctctgcctccaagctgccttttagactgaatagcttttcttgttagccctactttaacatttcttttgaagtggttgtctgcttgaagagg

SEQ ID NO: 355 - DNA, 903 bp, Homo sapiens
cgcgtattccacaactagctcttcacctatcaaattacgcgcaatggaaacatcttagtcctcagagcaatcctgggtgcaaggcagaggcggctgttatcaggcctattacacaggtttagggtgaaacttgaaaatgtgggcgggaaagtcacaaagcaatgaaaaaaccatctagaaaaaatcttttctggatgtcaccatctaacatttggcatgagaccccagaaaccggatgactcggctcagaagcagacacatttgaaaagatatttatctcacgataaattaagggacaaaaaggccttcaaaaaggaacggaataaacggaataatttttaactctaacattactttctttcaatttttacataattcttatagctgcggcgagtgaaacgactaaaacaaaagcaaaacagagctccactgcccaaaacaaagatggccgagacgactcccatgcccacacgcaaaatggacgctgactatgacgttccctgcaacaatcctcaactggccccgccccaccaatttggaaccccgcctcctcaacccggaaccccgcctcccccagtgtggccgcttttccgacagaggcctgcccgtgattggctgctcgtactatttacgtcctttcgatgttgcgtcatgcagtgcgccggaggaactgtgctctttgaggccgacgctaggggcccggaagggaaactgcgaggcgaaggtgaccggggaccgaggtactgctccggctggccggcgggcgcccgggatccccggtggtcctgacagccgccctcacgggaccgctgggtgcggggggaagggctggaagcagcggtgctgctggctgcgtcagggccggcctgcgcgttggggtcgcagtcctgtgggtgacctggt

SEQ ID NO: 356 - DNA, 1010 bp, Homo sapiens
gggaaggaaaaggaagtcttcaaaaggggaacaatatcatggcgctgtgttaatcacttcagcatccgtcactccacactcaccacccttcttgaagccgaccatccccactctttggagagaagaaaggccattctcctctctgaagggcctcccaagtgcttccctggagacgcacttccccgggatgcccaggccgaagcaaagggggcggggagagaccccgggccgaacccttctgcccccaacccctccagcgccccgactcttcctggactccgacatcttctgcaccgccccgggcccccatccctcccgcaccctggtccctctggcaccgccacggactactcctgcgccccgacttctcttgcaccctgaacccttctgcaccacggcccttcctgcaccgccacgggtcctccagggacccgacccctcctgcaccaccacggaccctctgcattccaagcccacctgcaccccatccgccactatgccccgactgcccctgcacccccttgagccctgcagtgtcccgactcctcttcggggcatccggggaacgactcggcgcctgacaggtaggaagatggcggcactcacctgtcacagcagctgcgcccgccacccccggagccagcccaggtcgcgcaccgccagtgagtccctacgacgcggccccccgtactgacccgaagacgcgcaggacaccgctgtctccgcactgacgcgaccccacaaccccaacctggcgctaatgcacttccggtgtcgccggaagtcccgccccagtcccgcgccgctgggttctccggaagccgccccacacctccgccccacacccggcggcgccggaagtcacgccccggcttccgccccgcagccccgaggggtctgggcgcgctgaagaccccttcggctgctgggccaacgcccccacccttggtcacgtactcctgccgccgagcggttcgcgggaggtggcctcgggggtcgtagctactcac

SEQ ID NO: 357 - DNA, 997 bp, Homo sapiens
caggctcacttacgactttccatgatttttgaaattacttcacagggagcctgggcagcttctggagggcagtgagaaaccaacgaaaaggctttagggaaaagatgccacagatgaaatttcataaagatcgctttgggtagcccaaatcagaagcttctacaccagccttacatattacggttctcatctattcttattctccactctaagtcaccaagtccatcctacctccacaaggcaaataccctgtctctgccaccatccactgaagaaccctaaaagcaaatgggtactgaccctgccctgcttaaaattctctcagggctctgatttgcgtcaggataaaatccaaacgccatcggccttgcgcggttttcttccagttccagagtgtcagtcctctggccgatctaaaagccctggggctccaagctgcccacggctgtggagcctgggctggagcccacagcggacggcagtgttagtattattataataaatgtcagagcaagaaaaacgttcccgccggttaggttttgttatttcaaaaataaattaaccgcctttcctccggcggagacgcgcaggtgagagggcggcgcctgacccagcgggctctaggtgctacgccagggccccgagggtcccgaactcggcttgcccacacaaaacatggtagcaggagagcagcatttccgccgggcatgtccatatccaatggggcccatgggagaggcgtagtcttctgggtcttgcccagactcaacatggcggctacacgtcgcctgtcagtctgtgaagcctaccccgggcgtgggccgcagcgtcgagtaacgtcattcgaaccccgtcgcgcccctttgtgcgtcacgggtggcgggcgcgggaaggggatttggattgttgcgcctctgctctgaagaaagtgctgtctggctccaactccagttctttcccctgagcagcgcctggaacctaacccttcccactctgt

SEQ ID NO: 358 - DNA, 1014 bp, Homo sapiens
aagctccctcttacaactggaccaggcagccaggggaggcactgagaggccgagcttctgagctggtgcctgtggatgctcgacggtcccgcagctcccacaatgggatggccaagcagaccctgagatccacagcccccctttagtgaaacaggagggaggtcgctgggcacagggagccgggaacgcctgccctccccgccatcgacggctcccgaggcctgaaccttcgctccagccccagcacaagccggccagggcgcagggccaagtgttgcccgccattccccgggtaccccatgacctcccagctggggctggctcggactgaggagtcgtccctgcccgtcaccctctggggtctccagtgctgcggagctcagctggcttttgcagcggtaggggctgggaggagaagctgcagggagaccgcaggcgtgggacgttgtggggggtcaggcttgctctggggctgggaccccggggggagcagtggggttgacgccacagcgatgacttgggccacgggtctgggggctctcccgcggggcgattgggctctgtctttcgggattagggtctctcccacagggtttggggttctctctgcagatttgggggagtctctcccgcgggatgagggggggctctccgccgcacccgcctatgatggcccagaggacccgagctcgggtcactcccgtcgccctcggggctcggcgagggtgcaggaggcgggcgctgagccggtgacgcgactccgggcggctcccgggtgcgccgcatatatagcagcggcggcggtggcggcggccacaccgggcggcggacacgtggagggacccggcccgcgccttctgcccctgctgccggccgcgccatgcggtgagcgccccaggccgccagagcccacccgacccggcccgacgcccggacctgccgcccagacccgccaccgcacccggaccccgacgctccgaacccgggcgcagccgcagctcaaggtactactgg

SEQ ID NO: 359 - DNA, 1025 bp, Homo sapiens
tggccttgctaacctaatcacatctgtgacgggatatagtgatgtttaatcttatgattgccttaagaattaaggcaatcagacgggttcggcggctcatgcctgtaatcccagcactttgggaggccgaggcgggcggatcacgaggtcagaagatccagtccatcctggctaacaaggtgaaaccccgtctctactaaaaatacaaaaaattagccgggcatggtggcgggagcctgtagtcccagctactcgggaggctgaggcaggaggatggcgtgaatctgggaggcggagcttgcagtgggccgagatcgcgccactgccctccagcctgggcgacagagcgagactccgtctcaaaaaaaaaaaaaaaaagaattaaggcaatcataattccccacgcacactcatatgctaggaccccgccccttacctgaaacgttgtggcttatatagacactgccaggcactgtgttaagtgctcccaaagagcaccccagtctaccattttccctctcgattctatatgtacactcgggacaagttctcctgatcgaaaacggcaaaactaaggccccaagtaggaatgccttagttttcggggttaacaatgattaacactgagcctcacacccacgcgatgccctcagctcctcgctcagcgctctcaccaacagccgtagcccgcagccccgctggacaccggttctccatccccgcagcgtagcccggaacatggtagctgccatctttacctgctacgccagccttctgtgcgcgcaactgtctggtcccgccccgtcctgcgcgagctgcctgcccaggcaggttcgccggtgcgagcgtaaaggggcggagctaggactgccttgggcggtacaaatagcagggaaccgcgcggtcgctcagcagtgacgtgacacgcagcccacggtctgtactgacgcgccctcgcttcttcctctttctcgactccatcttcgcggtagctgggaccgccgttcaggtaagaatggggcctt

SEQ ID NO: 360 - DNA, 917 bp, Homo sapiens
acgcgtcagttacccccacaggacgggtcagccaattaaaggcgaaccaggcccggtccatctcctgacgccttttctcatcccagggctggacaggcagctggcctgggcccggctctgccttgtcacgtgcgggggccggcccgtttgcttgtctgtgtgtaggagcgtgaggtcacgctgggtgctcccgccccgccggggcctttagtgtcctggtccctaaacgccaggccgctccaccgggggagaaggcgcgaaccccagccgagcccaacggctgttgtcggttgccgggccacctgttgctgcagttctgattggttccttcccccgacaacgcggcggctgtaaccaatcgacagcgaggccggtcgcgaggccccagtcccgccctgcaggagccagccgcgcgctcgctcgcaggagggtgggtagtttgcccagcgtaggggggctgggcccataaaagaggaagtgcacttaagacacggccccgctggacgctgttagaaaccgtcctggctgggaaggcaagaggtgtgtgactggacaagacttgtttctggcggtcagtcttgccatcctcacagaggttggcggcccgagagagtgtgaggcagaggcggggagtggcaagggagtgaccatctcggggaacgaaggagtaaacgcggtgatgggacgcacggaaacgggagtggagaaagtcatggagagaaccctaggcggggcggtccccgcggaaaggcggctgctccagggtctccgcacccaagtaggagctggcaggcccggccccgccccgcaggccccaccccgggccccgcccccgaggcttaagccgcgccgccgcctgcgcggagccccactgcgaagcccagctgcgcgcgccttgggattgactgtccacgctc

SEQ ID NO: 361 - DNA, 925 bp, Homo sapiens
ccagtcttgaactggcctactgtctattgaaattttccctctctaggtacactctagccattttccagaacattcactgaatcccgtcttctcttcactcctttaccgcaacagcactaagtacagcatcctgaacacgggcaggacttaatgcacatctgtgccaccgattatcaatcagtctgactgtaagcttaaatggagaatgatgtgagacctgccacctgaaaagggccgccttgggagccatacacctgcacagcccctacaagctctggtaggtaagctaacccccttccccaagccgacccactgtcctgccagtgtgggccatggtttcgggtcctgaaggacacacagtcggaggttggggacaacccagaaccacaataccctctgtcgtcctcaactttacccagagaaaagcctcctctgcgcgtgcctggcctccgggtcaagaggccccggcccatgccgtgcggcagaaccctccgaatcataacccctctgagcccggaccctctgaaagctgcactgctgcctcgctattatcgcagccgtcactgctccgcgccaaacgccattcagacgagcgcgccaattggccagcggccctcagggctctgccccgcccaatgctctaggtggccgtctccccgtgacctctcctggagccccacccaggcccgctcccacccgccattggctggccttgcgatacgtcagtcctgcgcgcccccgggcggagatggggagggcacccggcgttctgagcggaagtacggttgagccgatttccggggccactggtgtgacgtgtcccgcgcttggcgcagcaggaagcggcggcgaacgcggcctgaattcccggcgccggccccagctcctctgccgctgccgccatgctcgacttcttcaccatttt

SEQ ID NO: 362 - DNA, 1002 bp, Homo sapiens
gagctcctcagggtttctaggacctgtcacagcttctgggaccccaacaaatgagtgtgcaaagacctgttctcctcaaagtgcaaataatactgtaagtaagggctgatattcattgaccacctactgtggacgaggcgctgctctgagcacttgacatacattgtttcattcaatccaaaccccaatccactaggtcagttttattctccccattttacagagaaagacaagaaaggttaagtcacatagatggaacaggctgatgccagaatggacaccctcagcttcctcagccgccccaggttgactccatcaccaagggccagggtcccagtgcccccaggctctaggagctgctgtttggctggggctcccaggagaaggtgaagcttaatgatttatgggtgattagctgcaagaatgcaagcacagaagacacaaacctttatgccttggaaatttgtcacaagccaaccagttgttttccatccctgtgaagcaggaataattggaggtctgacagaagaacttcccagttaccagaaggagcagcactcatgttctctcttagttttgtgtgaggtgttgcccctgccttggtcaacagtttgagtcagagagatgggggccgggcacaatccccaccagacgttcccattcacaagaccctgtgggggctgggagacgccctggggcagcagccctggggtaaccaagggaacaaacacggaaaaccagggacgtcagtccttatctggagctcattaaatggggaacattagtcagctgtgaaggccaagatagggtgataggcctgtgggtgggctgggatggggcatgggggcagaggccgccatggaggagaagaggtattggcctcaacgactccacctccccgccacgtgcccagatccgggatggaaggaccctataaatgcccacaacccagcctccccagaggccttgagaaagagagcgatagagtgcgagagcgagtgc

SEQ ID NO: 363 - DNA, 933 bp, Homo sapiens
cattgagggtaaatgaccaggacagggccacacagccaagagatcaaaacccagatttttctgggatgctagtttgagattttccattctacaaacgtccagccactcacgagttctaacagatgactgatcttagctgagaagcatgacatagatacaagggagtcacactgcccgggttcatatcccagctgcaccgcttactagcagtgtgacctttggaaggatcgctgttttcccaggtgtaaaacggaaataagacctcccacaaaggggtaagtaatcacgtgatacggcactcaaaacagcgccttcaacataagtaagccctttgtgtttgccaagactaaatcactactgcatagttagtatataattggtgctaaatgtttttttctcacttttttttttggtgctaaatgttttaaggtgagaaagtaacatttagggatgtaatgagatgtaatggtgggatctccgtgaaacgacaaattcattttggagaaagctttttaaaaaacgcaaaccacaaacctctgccatttgtcagcttgaagtctacggaactgcaagcaaaataaagattggtgaaactttgcttctgactgacccctacagtcccaaatattttcttggcctttacaaagcccgcaggcatcgtcacatgcagtcctgaaaagccttttctctatacttcacacagcccagaccagcccacgtggattcctcgcccggctgcttccgcttccattttgtcccctcctatttctcattcggcgcctcagaatgacgtctgaaatgagcgccgacgctgcccaaacaggagcctgcgcatgcgctctgccctggcagcggccctgtgcagatccctgagcgtgtggcagcagtgcggtcgtggtccctccctatgcagcctggtttctagcgtgacac

SEQ ID NO: 364 - DNA, 921 bp, Homo sapiens
ttgcaaagccctttgataggttatcggtggagagtagggagcacaaacctggggtcccattctagcttgaccacttctcggctgtgcacaaactagtctagctctcctgagcctcagttacctattttgcaaattagggatgggaacatccatacctcacgacgccaaacggctaccttgtaaagacgaaaggaggaaatgcaggaaataactccacgtaaggttaatgctccgtaaacagagctgctactgctattatatattctatacaatcctgcgcccttaacggcaggaccctttcagtgcttcagtcctgtcttctctctcctgggttgacctccacagatcctctcagaagagcgttttccaggcgtgaatctccgcagagtggagataaaggctgaggccccaacgcacgcgcactcacgcgagtccgggcctatgacgtcattagcgcagcgccatcgccgcggaaggcccaggggcctgtcctgtatgcggcgtgtcttagggaggcccaggcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggagcctgcct

SEQ ID NO: 365 - DNA, 1024 bp, Homo sapiens
gaaatgcaggaaataactccacgtaaggttaatgctccgtaaacagagctgctactgctattatatattctatacaatcctgcgcccttaacggcaggaccctttcagtgcttcagtcctgtcttctctctcctgggttgacctccacagatcctctcagaagagcgttttccaggcgtgaatctccgcagagtggagataaaggctgaggccccaacgcacgcgcactcacgcgagtccgggcctatgacgtcattagcgcagcgccatcgccgcggaaggcccaggggcctgtcctgtatgcggcgtgtcttagggaggcccaggcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggagcctgcctccccagctggggatgaggctaggaggcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagag

SEQ ID NO: 366 - DNA, 1039 bp, Homo sapiens
ctggccattttgcacatttttaaatctcaaaaggccaatctacaatagtggtgttatctgtaggagtaactggggaagttgcgtgtcttgtgaccaatccacatcttagcagaattcaggctcctctcctcccgctagcttggtggtctctcataggttttacaaaggcagttgggttttggaaaagggctatcatttgaactataacctaaatgtcttccaaagttagcttggcctaagcccaggaataatgaaggcatcttgacagccaaaggcgcgcagagttgggggtttggttagattagacctcccccactgctataattttctcactgatataatttttgcaaaggcagtttcattactggtgtggttctatttatttgtttttcacatctactatagtttctcctttatgaagttggttactgtattatttggtgcactgatattcaaaactgttatttaaccctatgaactgcagcttttagctttacaaagcgtccttttttgctgtgccttctggtctgaaccctatcttgtttgatatcaaaacctcagcacgcctgcgtctctgctggggtcggactctgagtcagttctacaggccctgggaaactgggcgtccaggctccgaggatggtactgaacctggcgcagccgtgggagggtgaaccaggtgccgctggcggagccccctcccagccttcctttcccgtcaggctgtgcccctctctagatccgcggcagctggaagccaggcctgtaacgagggagccttctccgaggattgtgggagatgtagtttttccggcgccttcgcgtcctggcgcatcgacgcaggacgcacttccgcatgcgccgcactcccggccttagtcgggtgcgcgcgtgcagggctgtttccggcttagactcagtggaccggaatctggccagcgggtgtacctggctgagtctctgtggccgcggaggcgcggagctaagcggctcggattatcctgggcagaccagagacttgaccagctaaacacttccg

SEQ ID NO: 367 - DNA, 1077 bp, Homo sapiens
ctttgaaggtaaaggtccggaatccaaagttatggatatgaaagggtataattaggccgggcgcggtggctcacttctgtaatcctagcactttgggaggcagaggtgggtggaacacgaggtcaggagttaaagaccagcctgaccaagatggtgaaaccccgtctctactaaaaatacaaaaattagctgggagtggtggatggcgactgtaaccctagctgaggcagaaaattgcttcaacccgggaggcggaggttgcagtgagccgagatcacgccactgtatgccagcctgggcgatagggcgagactccgtctcaaaaaaaggggaaaaaggtataatttatgccttttctgggcaatgctgggtctttgctatagctgcccagtaccctaagtcagactgaagatgtacagtatggtttccgttaattgtgtaagccgacaaactacaggtcccaggatagcttgagacttgtagttgctcacaaagatgggtccggtgctgcggtgcttcctgggagatgtagtttcctgtgtattgaaacctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtgggacggat

SEQ ID NO: 368 - DNA, 704 bp, Homo sapiens
acccggctgatttttgtatttttagtagagacgggatttcaccatgttggccaggctggtttcgaattcctgacctcaggtgatccacccgcctcggcctcccaaaatgcggagccaatatttaacctttcatctgaagctatctgcttaggaactaaaggaaaggcagtttcttacatgactcagcttttagcttaattctttttcttttggcatagtgagttgggggtcccaattttttattttcctttcacgaaactgaggacagaaaggggaagtggaaagagggaggaggagtgggttgtgggaaaggcaggaggaagctgccaaagaagaaagcttggccagattccacctcccttctgacagcctcagtggcctcaagccaggggggtgggtcctggcaggagggaggggggggtgtagccagccccagggccccattggctgcccagaggtgccagaggaataaagcccaggaccaagtagcccctgggaccattcagaagactgtccacccgtcctcagccccctctcttcgtgggctatctactcagttgatccctccctcgctggcttggctctgactcctgctcagacccatcacctttgccgggtaagtggccccatcctcagtcccacctcaggactggagtgtcccgggctagcctgtggtttcccaggggaagagggagacatagaaa

SEQ ID NO: 369 - DNA, 1058 bp, Homo sapiens
tgtttttcatgctaacactgcgtggcccagattagtcttaaatgttcattcccctttcctggtggcaaggagaaagttccctaagtcagctcgagcctctggctcgtcctcattgcctctgggcaaaccttaaggtcagtgtttccttgaaactagataaactgaccctgcagtgcccagcccggccccgcgggcgccccgcgtgacggcgctcgggcggcaggaccggcctggggacgcgcggggcggcgcggttgcccttttgaatgcctcctgcggctcggagcgctggcgggcgctggagtgtgagtgaatgtagccccgcggagccaatgagctgggaccggatgcgatatatcctctgggacaacaactgctctgttccgcctcggatccacatgacgccatttactgctgccgcggccgccgcagagctccctgcctcctccggaaaggcgagggcgcaggccaacggcgagccccccccgggcgggccccagaccctcctcctcctcctcctcctcctcttcctcctcctccgcacccaccgcccccgcctcggcctcgctgcctcgcctccacaacgcccagtctgcaccgccgagagctgcgcgccgcagcgctagcggaggagaggggccggcggagcgcgcagcgcccaggcccccgcgcccgcccggcccggcccggcccgcgcccccgcgccgcctccgctacgacgcggccccggccgcaccacttggcgatctggctttaggttctccgtaaggccgttttcttttcccattcgctcatctgccaggaaaagggacttgccgttggcgcttcggcctcttgttcattgagaaaaaagaggaaatactccgcgtgcgcttgtagaaggggagtcgtctccagctccgaaccccggagtgttcatcagcggggaatctggctccgaattctctttttttctcccgccgattgctcggaagttggtctaaagcagaggttggaaagaaaggaaaaaagtttgcatcgagactggatttatttgcacatcgcagaaagaagagaat

SEQ ID NO: 370 - DNA, 805 bp, Homo sapiens
atcagaggaccaaggaagagacccaggggtagagagactccaccatttcatggcaaggcagaaaggagccttgatcaggaggagaaacggggatttaggagttggggactaagtggaccttagcattgggcacttggactacagaaaggcccaggactcagggtgtcgcgtccccaggaggaggaactggaaaggcaatgcccaaccccctaacttctagacgtctggcccctgtagtctcccgcccctggcctcgcccctcgttcctagcttgtttgccacctagtgtctctcccgggagcaagagtcctcaaagttacatcatgtgcggctgggagggcggtggcggatggggggcggggcctcgaagtcgggggccgaagagtggacccagtcctccaatgggagagatgggtttggcggtttggaggcaggggttggggcggcggctgggctgacctggagcctggagccccggggccgagggagctggcctgccagcggggcggaggaaagctagtgccagccctaccaggttccgcccccgcgcctgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggtgagtgacccccggcccggggcccacccgcaccttccgctgcgctcgccccctcggggctgccagtggcgctctcctgctctcagcctc

SEQ ID NO: 371 - DNA, 911 bp, Homo sapiens
cacccatggcttgaacctttaatggatacattcatcagttacctgtcaagtgcgtttcctctgtgccagattgtgtggcgctcagcactgtgaaagtaatgatgactaaacattattcaaataaatacacattcaacaacaaagtgtgaaggcacaaaactagcttgccagagagagagaagcctcactcagacaggggatcaaaggcccctctagagcctcctagatattggagagagccatgagtgatgggcatgcctccagcctgtgagaccgggggagcataccccaggcagagggcacttaggaaaaatagcacggggtgctagcgctgccagggacctcagtacacatggaagaaggcaaggtccagagatccgagtgacttgcccagggacacaaggcaaatcggtggaatcgtcgaggggtggaggatcagccacagccccccgcctcccacgccacctcttggaaaccagatacccgcctcgcggccaagacccaccagctccaagcggcggaggccagaggtagcgaggggtgaggttagaggtgggggcgagcggggactggacacctggggagtggggaaaggggaagggggcggcaccgctgacgtcatttccggggtcggggtatataagcggggcgcgagggcgctgctgctgccaccgctcctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctct

SEQ ID NO: 372 - DNA, 1034 bp, Homo sapiens
ctaaaagctttccccagttcctcgtctgggaataattattgccatccgtgcgagattctctaacgctttgtacgactgctttatttcaaattctgctttatagttcttttgtgtacacacacagattgtttctcacgttctattgaaagctgcttaggggaggaattgtattctattttgttaatctctgcatcctttcggcgcctagtaagagtcttgtacgaaacagaaatgtctctccttcgtaaaattcctcatcgggagctgggactgtgaatttttgtaacgtttaagaactatctgttatttaagaacaaacactctgcttaacttgtttagggttcactagagcgagtaagacctttttagggcacgccgtctcgctggttgtcacacacgcatggatcgctgccgggacccttaggtttgtctgcaaacacgtgggtgataagcgctaccctccaggcccctcctctgtccacggtgattggcggaccaaacgttccaatcatccctccccgcctctttcggcagtagccaatcagagaccccgagcgcctcctgactactagacactgtttactaacagatcgaagctggggaataaggggtgtgaccgttctggggaggtcagggaagggaaggtcttgactgcgagtgcgcaccagaggaaatgggcggggcagagctttgggtctcaccaatcggagtggcggcgctcctccctctcctgcctccccgccaagcaacaacaattcgaggagcgaggcggggaggctcgtgaaacgtcacagcgtactgcccaatgggaaccggcgttggcagacgcgcgcgccctgtgtccaatcagcgaaggcggctcgaatggctcccttaccttgctggctgtgggcggagcggcctgaggaggcggcggtggagcagggggcggtttggttgcgcggtactagcggtgcccgccgaagggggaggaggcgaggagcgagccgtgcggccagagcgggaaagagactcgtctttgcgtccgagttctg

SEQ ID NO: 373 - DNA, 925 bp, Homo sapiens
ctaacgccctttctggtgagtttggggtcctggccggggggtggggggccatcaccccgggctcgggcccagttggctttggggcacctgagcctcagcagacagcagggcttgaggagggagtggctcgaggccagagggaaggcagtcacctgggcccaaggaggctgatgtggcgacagcattaaagccttctcccgtcccctcccacagagcaggacctgatcggccaggacctgaactctcgctacctgaatgcccagggtggccctgaggtggtgggggcagggggctcggcccggcccctggccttccagttccaccagcacaaccaccagcaccagcacacccaccagcacacccaccagcacttcaccccttatcccccgggcctgctgccaccccacggcccccacatggtgagctcctcattgggctggcgatgaggctcggaggcctctggggagggcatggcttctgggggaaggcccgggtccctggctggcagcttactcttcccttctcttccctagtttgagaaatatccaggaaagatggaaggccttttccgacataatgtgagtgtgtgtgtgcgtgtgcgtatggggtgtgtggtgtgggcgtggatgcatccatgcttgtgaccctgactgctggggtccagtcttcagcacaaaagcaagagccttgagcctgggacagctccctggggggctttagggtggaggcccgtggactgacgggcaggctggacttgggctgcgcctccacccccacctgtactagtcccccttctctccacagccgtacacggccttccctcccgcagtgcccgggctgcctccgggcctcccgccggccgtctcctttggctccctgcagggggccttccagcccaaggtgagctcccaatccagacaccacc

SEQ ID NO: 374 - DNA, 1064 bp, Homo sapiens
gcctacagctagagggaagaagggagaccttgacgactcgaagtggctggctcctgctggcattcaacacccattggcctggatttccccaactctgggcaacttccagtccaggagcagaataaccagagccacggccagggccagggctggggcagattatttatttttagcagagttgctggcagctgcctggtgggtgctgggaggtgggatggggactgagtttaatcccttccctcttctgggctggggtatcctccccagggttcaagcaggcatctccacctgcaactctgtcagagctgcccccacccccaacagccctctcagggcccccaggggctcatggggtgacaccaaccctcacactgaaggttaggctcattagggagaatcttcaactccaggatggggagtggaaaggattttgtgtgaatttaggacaccccctaaattctagctcagacctgagcctatggggagtgggtgtcatgggcagagaagggggatctctgtccagcctgtaactagcttacttgctaaaaggacgagccgggacttggggagaggaaagggagaattcagtctcacggggccagaccgaattcttctccagagggcagttgctgcttttggctgattgggtttaccccgctgcctgcctccccatcacgtactccccccgcaacctcgctctctctctccttctcacacacaccctcagctccggacctcgcctaccggtcagcccctctattcccagacagctaccgctactcccctggcgggtagggcggggtgtcggggatgtaaggtccgaggaagagggtgggggattcccctggtgggggtggacagacacgtcagcccccgcagcagcgtggaccgggggcgggagcgggggcgggtggaggcttaaataggcggctctggagccagagcccagtgcgggctgagaaggcggtggctgcagcagcagcggcggcggaaaccctaaagtccgagtccggactacgagtgcgtggcctcctaatccggatcctagtcctgagcgtgtctgt

SEQ ID NO: 375 - DNA, 973 bp, Homo sapiens
aacccttcagtgggtggtattttccatctgctcacaggaatgttgagattttggctgtggaccttgtgttttgcttagcaaagttgttttgtgtggatcgcacctgacattttaaattcttccaacaaccataggaggtaaatgaagaattcatgcacagtgcaaggataaaactgcacaggtttcagctgccttggacaccctgtgcttttcagctatttgttgaatggaacttaagtgcccaatttgttctgattggagcaaaactttgtggactgacaaggatgggcgtccaagatgtaggaagttaaaaaaaaaatgttgccaaacaaggtgtagagcacgatcctatctgtgttttgaaatctatgaaattatgtatctatgcacctatatgtaatgtatctatctctgaatggagggaaagagcctgaccattaccaccctctacccctgggagtgagaatgaagtgtacagggagcaggtgcaaggaagaatgctcacttcttactttatatatttctgtactgttaaaattttaacaggctgttttgtaaaaaaaatttaataaaagctatcaactgtaaccagaagtactttctgacagtagatgttctcaaaccatctcaccaagtgcccagaaagagttaacacaggagaattccagatgtttgaagtgaggacaaattcctgctttgagggtgggaggtgggcttagggatgagaggcaatgacgggggagaggaggaaagaagctgaggggagagctggctgctgagttgtcattccaaccaatggcatgaaagtttcaagcccaacgcccatttgtggagactatttcaggagttaggatttgcatctgagttcattgcccctgtaacctgtcaaagaagagctaagggagctttcggggttggcttcttggaggctgctttctcctttacttggaaggtaaaaatctcaagcccaagc

SEQ ID NO: 376 - DNA, 1067 bp, Homo sapiens
aaagctagttggggtttgctttctgttttcacatcctctaaaactgtactgaggatggtgtgtgtgtgtgtgtgtgtgtgtgtgtgtgtgtatacctatgtacttggaggagggtgaggaaggggaggctgcaggattgattatgacttattaaactattggaaaagaggctgaatcatcacagtcaaaaataaacagctgcaactccatgcgactcccacttcttgcctgctcccctttgctccctcacagcatgtaggagagactgtgctgggtcagaccagcaggtgctgactgacgtggctacagcaaggggaccacctgtatggccgctgcacctccaagctgtgggacgcagggacagctgggaccagtcgacgtccactggccctctgatggctcctaggactgaatcttggactccaggtgcgggtttacactccctgcgctcattgggaactgcatggagaagcgctatcccctgagccctttttctccctactcttagcctggccctgcgccctgcgcccggggctggcccacggtaaacacagctttgctaacttgtttggctaaggaaatcacagaggtcccggtataagtctgggtcaccccggccgccactccagctgcctagaatatatgggtggaagggaatcgactctgtgaaatcagagggaaaatagcgcttgtccttgccatgagtcttgaggagaccgaaaacgcttaaccttttacgcccccgcaggcgggtcccctctctccccgctccccggctgtctgtaagctctgcctgcggccacccgcaggcgtttcagccggtctcacccctgtccttctgcaggacccgggaggaggggttgggggggcggagcgaagccgctgtgacgtagcgggaggggggcgtggggaaatgtgccgaggggcccgggctggctgggccagtcccagcggcgcagccacccatgcgcgcgcgctcgcaagaccaccagcgcccagagccccagtctgaggcttggcgccgggggtctgcgggcgaggggagctctctacgtgcgaggggctag

SEQ ID NO: 377 - DNA, 869 bp, Homo sapiens
acgcgtatccagggcccggcacatagcaagtgctgtaagcagtggcactcacaggctgccaggacaggaaggaccctcagaggtccgtcccaagctgtgtgggtaggagcagaagcttcctctgcagggggtcaaaagagtgcacctgtgaaatccaacctccaggacccccaggagcccgagatggacacaggatctgcactgctgggtggggcggagaggcaggtgctggcgagagaagagctaaggggtgcaggatggggtgtgagctggagggcagggggtagtcagagccaacagggagaggggcctgcatcccgagggaatgccagcaccaagtgccaaggcctgggcagccctgggaatgggtggagccaaggtcaatagcagagagctttgtagttgagatgtttggtagggcaacctcctgaatatttaaatatttaattaaattaaatatttaaataaacttgaagtagaacgtacttaaagtgcacaaattggtagcttgaattcccaccccctccccccacataagaggtgggcttgtccaagactccgagggacagagggagaatcgctggtgcccagccagtcggtgacagagcagggattagagatggacccctgaggcttagccccacgctctcttccccaaaccctggggcctcagtcagcctctggtaatcccttctgtgcccagggcaccagagctgacgtttcccttcagcaaggcaggggccgaggctgccagagccctgctggcgtcatcctgcctgggatagctcgagaggtggggtggggggattacaaacctctaacagcaccacaggctgcccggggaacatctgctactacagccttgcagc

SEQ ID NO: 378 - DNA, 990 bp, Homo sapiens
aagcagtggaaatatgaagcccttgccaccccacatttctctgtctagggccccagctggcctcttctctgggccatccccttggtccctctgtagtcctggcttcctggcccccacttttggggcagctttaactgtgggtggctgcgtcctctggaggaaagtactagacaccacgtaggctgcccggagaccttgtctctgagtggccatagaagcacctgccattgtttcccttcacagccactattggctctggttgccccttccattgtccgcatccttcctccacccactcacccaccggtcacacgtggacccttaactgtcctctcccaggatttgaagtgtcagaggaagtgcttcggttaaagggcttcattatgtagaacgaaggttgggagggaacaaggttgggaaaggaacccaggagaggcccaggcaggtttctgtctctcccctcctctcaaggaccacccatctcatccagcgtggcctaacttgcagcgccattccttttcctcacccttggaaaggcgaagatgccaagatgttgtgttctgcaaggctagtgcgttcaggaagtagacaagtcttgagcacctaccccgggccgggctttttccctaaagaggcgcagcgtatctccctctctcctcccttccattattcaatgtgcaagcgtcctgcgcccattggctgggcggtgtctggggctcttcagcccagcaccagcacccaggtccacgtgcgcccgtgtgtgtgacacagccctgaccttagtggagaccactagccaatcaggcgccgggaagagatccccagccaatcgggggcggggcctgcggctccgtcggcaagaggccaatgagggggcagtgcccggcattatgcaacccgcctccccgcccgcccggtggagcttccactcggctgcgggctggagcggcggcgggcaggcgtgcggaggacactcctgcgaccaggtag

SEQ ID NO: 379 - DNA, 963 bp, Homo sapiens
cacagatacatacgcagtttggcctcgtgtcgccacactctgggcacggcgtgggctgggacatttggaataaacggatccgagtcgcagccggggtcgcaccgggaggcctgaggctgcggaagcagttaaactgccggcggggcgggagctgtggcggcctcccttccccacccccagcccggctccacgtctttgggttctgcagctgccactctctgggtggcggttggcctaggccttggggtgattaatattcaattaatcgggtgcacaagtcccggtcacagtttgccctttctctaccccgcccctggggtgggctggaggccgatttggtagctattccacgagcaggatcctccttggccgcagacccccgcggagagggcactttctgggtactcttgccgctcctccagccccggttctcctgagccgcttcgccaccagcttcgtccccctccccctctgcccggcgctctccgcctaaaccgggcgtcagccgccctaccccacccctttctctctcattggcacgtctgcccccacagtccctttccagacgttctcttcattccgtccccagtgctccgatcgtcggttcattggccctcctggagcccggagggtgcggcttccccacccctgcgtccgccgcgcgtccggacaggggcaggcgggacttggccaatggcgtcggggggcagggcaggggcggagccggccggcgggggaccggggtgccgggcggggagcgcggggaatggctgcgccgccggagctgtgtgacgcggagcgggcgcgcgcaccccgacggaggggatgggggcggggaggaggccataaaacgagaggcggggcgcgcgccgcggcagaaggagcgaagctctggcccggcgtgtagcgggcgcactacggggacgctgggccgggcaccgggctgtgtggagaagtgagcgc

SEQ ID NO: 380 - DNA, 913 bp, Homo sapiens
agtagaattactcatggcctcgccaaacattatgcaaataatttcacgttcccaggtagctcagccctcccacaaaagatttgaacgttttccatatgataacgatccactcgtttttgctaaacatccacaatgggcgatatcgacctatctggaaggacacacacaaatcccttcccaactcaaacacgatgttctttctggctggcaccagggcttctgtttgcagtgacttcctgggacccggagctttctcacagggcctctggcatctcctctgcggtgattaaggttcttctcatttcccttccctgttactgcccatactcttcaagttcgaaaagtttccttttccaatctcttttctgggcttgtttacccaagtctctaattgccaaggcctctggtctctccccacccacaacgttcctcctggttaaacccttcccctcccgccactcccagctcccgccactcccagctcccgccaccactgccgctgacgacgtccagcgtttgcagatggtcaaagccgacccccttctcctcccacctcgttttgtaaggaagtaatttcggggccgagcgctctgcgccccccgccgcgggtcggcgccgccgcgggtcgggagcgtgtccgggcaggtcgcgctcagcggggtacttccccgcccgcgtcccgcgtccgctcccataacgccgtctgcggggcggggacaggggcggggacaggggcgggccgggcgtctagtttccctacgtcaccagggaagttctcactggacaaaagcgtggtctctggcgcggggatctcagagtttcccgggcactcaccgtgtgtagttggcatctccgcgcgtccggacacccgatcccagcatccctgcctgcaggactgttcgtgttcagctcg

SEQ ID NO: 381 - DNA, 921 bp, Homo sapiens
actttggttctgcctctaatccctgacgcattcaacctcctcaagccatttgcttgtaaacataactggcataaataatatctgatatgcccattttacaggacaagtgcttccctctcagaccacatactcgaggacagcggccgtccacgccttatttacattcatcttcccaacacaacagtcatttggaagatgccgagtggcgtgggaagaacaagcgggaacgagcgccgacccgcccgcggcctgactgctagcgcaccgctgtgcggccgcctcaccgcgcactccctcctgaattattcaccaccgagacgaggacggtgatcgcccccattccacagaggacacggagtgaaggcgcagtcacaggcccaaagcccccagtcggcgggtcttggaaatggacgactttttcactcaaaagctacgaggcaacaaagcatgtggatgaggagggaagggagccggggccaataattcatctcaaagtaaaagacgtccccgggggtggggaacaaacaaacaacaaaacccggctctgtgcttccgcgcttgcgctctcctaggtctgccaggctgccgcccgcgcctaggccagagtctcagtgcgcctgcgccgagcccgacttccgccagggctcgattggcttccaggctacttctcccggcccagggagggcctgcgctgtggctagagaagggagtctggtgactgggtgcgcgtgctgatgacgaaatcggaagtgcccggagcagaggcgggaccagaacctagagggcctcgggattgcggaagtttggtggggagggtcggagctctggtggagagagtgttgtctaaaacaagttccggaagggaggctgcccttcgcggtccgagaaccaccggcctccccagtttgagggctgttaccc

SEQ ID NO: 382 - DNA, 1085 bp, Homo sapiens
tgcaaatagacaggtttgcttcagtccgggatgcaaggacctagagggtgtgtgtgtggggggtgggggtgggagggtggaggaggaatcgagttaagggggatatttaccctggcgaggtgattttccctattctgaaatatcaattcttgggcggacagtctgcccctcctctcattctcagagatagttacaaagatggaactatcttctcctttctagtcgtgagggagagatgtgtgtatccctgcgtatttagtagtattcaatcggacaagaaatcatgcatcaacgcaggagtgacatttaccagctggtatcgtgaggaggtgggcactcggttgcacagtacacggtagtccctctccaaaagaaagacctgggtgaagttcttaccttgcaggaaggaagcagagccatctggccgcgacagcaggttctgttcgcaggcaaagtgccggaggctgcagccaggaccccgagggctggaccctgttccattttcagcacggattttggcgtcagtatgcgtctcctcctccatcgcgccgagcccacgtgcggctgcagttgtcacttccgcctggcagcgcgcgccgcaaacaggctgcgtaaccagtgcgcacgcgccgggctgggccatcctcctgggcgtccgcacgtggcttagcgtttaccaacaatctggctccgcccagtcccacctcctaactctggcaacgccattggacatttgggaacagaaggcaggccttggcattgatccgctttactctgggcccccgggccctaaatccctgaggccctggtcaggttgccctcttctttgcctgttacaggagtaactacaatgaggcgattggagaaaattttgggtagatagatttttttttctccaaatctctgtgcattctatctaccacagaacgggaagaagatggttttcttgtcagatggtgctggagtttgcgtcaggcacataaagaggcagccccgaatctagcctacgtgagtgccggaccgctgagtggttgttagccaagatggcggtagcgatcgctgcagcgagggtctggcggctaaac

SEQ ID NO: 383 - DNA, 845 bp, Homo sapiens
gtctgcgagtaaccacacaactgcatactgcgtatatttatttcatgacaatccttccttgaacccctgctcttaacgattttggggacccagtggtgacccagatgtcctggctctaccctcctgggccacacaggctagcagggcaacagtgtttgtgatgaaacccggtgattgcgtgaatgtgtgggtgattgacagtgttgttggaactgtgagacactgtgagcgttactgtgtgtgtgcaggagtccatagccctgggtacatgactgtgtgtcacagtggatgactgtccacctgtgagtgagagactgtggctgtctgggtgtgaccatgggactgtatgggtgtgactgaatgtgtgactgtgtgagtaacagcttgtgaggttctgtgactgtgcctttccatggctcagcctatgggattgtgtgtgacactgcatgtttgattgagtgactgaggctctgggaatgagtggcggtgggggcgggtacctgtgggtgggacagcatgagagattgtacacacttggtgcaggggtcctcaggacgataaggacaattcagtaactgccctccctcatgaccttgatgactgccccctgctcggctctctgccccagagctccccgcttccgttccctgtcccgccttggccccgccccctcccatcaccccgggctgccagcgcctgtcacctctcccagagccgagacaaggcagttggaggcagcggtggcaggggctgcaggagcaagtgaccaggagcaggactggggacaggtgagggctccccaatcccagcccattctccctgcccccccttgacctctcaagtct

SEQ ID NO: 384 - DNA, 963 bp, Homo sapiens
cgtgatttctggtcgtttcagactacatttccttcccagaaggacgcggggacacgccttccctatggacggatcccaaatgcaagttgtaagcaattataactgtaggcccctagagcctgaaccacttttcccaggaattttttgtggtgcgccttaggagcaagcaaagtttcagggcaggagaaggccgacagggcttccagcatttgaagattctgccagtctgaaatacgctttcccagaagtctatggggggtgcagctgctctaacagtgggaggagacaccgacgaaaagcattctgacggccgcgcttccagcgctaaggattcccgcgtagtgagcatttcccagaggtctctggggcatggctccattagggccgtgtgcagttgcctgcagggaaacactgatgggcgcccttccagatacgtcgattcccgggttatgagctacatttcccagaagccctcaaggcaggacgcccttagggtcgcgtagagttgcatgctgggaaatcctgacagccgcttccaactctgtggatttccgggttatggactacatttcccagaggcctctgggtcacggctccatttgcgccgtgtagagttgcatgctgggaaacactgacgggcgcccttccagctgcgtcgaagcttctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcct

SEQ ID NO: 385 - DNA, 1055 bp, Homo sapiens
atttctctcaaccccttcctgacattgtttatatgattttactccctgctgggtaagaaaggacagtctgggacatgtccttaaatttatttctgaactagctccctggggaacctacctcctaatgaaggaagttgggttgcttgagaacgggtatggttttattggccaagatgccaggctatcaacctctgcaggaaccttgtgccaccccctgccctgctctgggcctcagtttccttgtcagttacttgggaaagggttggattcgctgcttctgggggtgaaatgcaccctcaggctggatttagcattaataatgcaatcatgacctgtatagtaagaagggctatttactgagcgcttaactatatgaatggcaccattctaaccacttcccatggtccactgttttacactcaagattagcatagaagcctcacaacaacccaaagaggcaactgctattaggattcccatttggtagacggtaatactgaagtccagagaggttatgccactcatctaatattacacagcgaggaaatggcagagctgggatcccagccaaagtctgtatgaccgcgcggcttcctcttaatcccaatgagagccctagcttgcagaggaaggtgtatttggggctcataggactaattaggactaattaagagcctcctttgggtggggacgccaactcggaacgtgacatcacgaaggagtacagtgacgttggccaaggcgggcgtgggaatccacacgccttccagcatccgtttaacggcaccgccccctgacccgcctcacttccgtgtatatttgcatattcagcgaacggacgtcgctacgccagcgtcgacggggtgacgtcaggatgcgcctctgaagtttccctcgagcgtacgtacatacgtactgacgcacgcatggccacgagagggcgggggaggagtgaagaggttgaggcgccccgcccagtcagcaaggttgcgcgtgccctgtgagaccgccaagatggtggtgggcgcgttccctatggcgaagctgctatactt

SEQ ID NO: 386 - DNA, 1003 bp, Homo sapiens
ttccgaggagttaggcagtaagacggtgtggaggttgggggggcggggcgagtctttcaatctttcaaaggtatttttaggaatccaggatcaaagccattcggcgagaaaccgaaataatccaaaggagtaaataaatctcgccatgtgctaagacagtgaccttctccccatccacccttccctcgcgccagccccaccctgaacgcctcggttgcaaaaacaaaataaagcaaaaccttttgctttggcaacctctaagccacattatgcctccttttgcaaaaggaagatttctttcttctccctctcccggcttttttccttcgtcctctcctccgcccctcacccgcccacccccccccccccccgagcccttttcttttcttctcggtcctctttccttccccaaatcactcgaaacttaagacgtgcagcgtctgcaggtgcgcgcgggccggcggccgggcctgggcgagcctgggactgccgggcctcgcaggcattgatcagctgggcgcgcgcgctgagtgacggcgcggttgccatggcagccgcctgagcggcgccgcgaggacaaggctgcagggcggcgtgaatgggcggcgtcacgcgcctggcgccagagagtctgctccggggctccggctccggccccgccgcggcctggcccgcgcgccgccgccgccgccaccgccgccgccaattcatcacctgtcagggatcactcgcggggtcacgggcggaatggacacagctgtgagaacaaaacccgggaaagaaaggcgaacgctccccattgcgccagatgtgcagggaggaccttgagacgcgccccccgcccccgcaggctcctcccgccccccggcgcatcacgcgggggtggcaaaggcggcctggccagcgcggagctcccggcccggagctgcttctgattaccgcgaggggcccggacgcgagagccgccgcggggcctgccctagaggcggagtgagtgagtcct

SEQ ID NO: 387 - DNA, 1020 bp, Homo sapiens
cccatgaatgatgaaagagaagcagaaaatatttcttagtaagtgaattactgggaattaagactatgattgatacctacagcaatttaaaaagttacttcattgtacctattaatacatgcagaaaaaaatgtacttggattttatgcttgctacttcctcgctcttgagtaaattatcctttctatgcatcagtttcctcatctgaaaaataggcattctagtaatatatacctcattaggctgttctgaggaatgtgataatacacgtaaaatgcagtccctggcacactgtaaatgtctaacaaacgtttggcggctattactggcgtttcccagcccgttattattttttacatgtgagcaagttaattcagaggattacttcaagaaacaaatacttgaatacctatctgtccaagcagccggggttacagggaattcactacataaagcctctggtcttacattatatagaaaggcgatgaagagacaagaaacaggttaaacagaaaaacacgataatttcacacataaccactgccatatttaaagcactgtacaccggccctcggagccagaattctttccctcgaggttgccccaggaatccctttgacctctgccattggacgtcacagaaggcgcgactaatcgtggctggctcccggagcttcactcttccctctcttcctgcgaaacttgacacgccatttgtttctacgtctgacatcctcctcttttctctggtccgtgggagcttttgcaagcgggaccaggccccaacacccgaaccagcagcgagagaaggagcccggcatgcggcgactcagagtgacgacacacgcgagtctccgcccgagtacgtcacttccgcaacgcttccttcgcggggctttgtgggtagccgactggggtctcctggcgacgaccatggcgggggatgtgggcggtcgcagctgcacggactcggaactgctgctgcacccggagctgctgtcccaggagttccttctcctc

SEQ ID NO: 388 - DNA, 1026 bp, Homo sapiens
gctgtagaaaacaggctgaggaaagaaagcgacacaggatgttgtctggagaaaggcggggaggtaggatggggcatatttccaggggtccgggcaggttgtgtggcttggaggcctccgagggccgtcgacgtcagccatggtccgggcagagccccgcaaggtgccacagtatcggggccagcgccccccggaaaagcatgctccgctggcggccgccaggtttctccgcggagtctcggaaaggaaaacccgtccccacgggggtcccacgacgcccccgggtcccaggccccgggacgttggcagaggcgcagcagaccttcttccccagcccgcacggctccagcggtccggccgcgtcccagcccgggctgcccgtcccccgtctcccggcggcgtcggaaagttcccggggctggcggcggtcaagagcagagccagggcagccgcagccgccttctagcccgccgctcaccgccgcaggggcaggcctgagcgggggtttccaccaagtcgccgacacccctcgggaattcccccactgggccacacacaaaccccgcttcctccttcaaatttccgctgccggctttaccgatgcgaaagccgcggtggagtttagaccactcctcccggcgccgggctcagcccgccttcgccttccctctccccgcggaaccccttctcgtcgcccgaagaaacccgaaggtcttcggcaagttccgtccccagcgcgggggcggggccgctcgagctgctccgggcctagctcggctgtttccgtgcgcggccgctgcgcactcggcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaag

SEQ ID NO: 389 - DNA, 1088 bp, Homo sapiens
tgatgcctgttggtcagtaaaaatcattctaagacttagtggaagtaggaaatgtttgtatggctgtgtataaaggctataatgtaatcccagcactttggaagaccgaggcgggtggatcacctggggtcaggagtttgagacccacctggacaacgtggtgaaatcctgtctctactaaaaacacaaaaattagccgggcatggtggcaggcgcctgtaatcccagctgctggggaggctgaggcaggagaatcgcttgaacccgggaggcagaggttgcagtgagccaagattgcaccgctgcactccagcctgggtgacagcgtgagactctgtctcaaaaaaaataaaaaagtctataatgctattttaagtttctaaggaactgaaactgctctgaaataaatcagaccattataagacttttttccatatcagtgagctaagtgcagataagcttctgaaacttgcatgctagatttttttggtacaaatatttgaaatgcttagtgtgctgccttggaaaaacctggtattttttgttgtgtccttatactgccaaggtttatggaatcatgtaccttatgcctagtaataattaggatgaccaggccagtgagtggttcatatccggggcatgattagctctgcgtgtgctcagccagtgccccatcttcaactcgatgtgttcctaaggtagacagcaaattccctattttatttctcagattgtcactgctgttccaagggcacacgcagagggatttggaattcctggagagttgcctttgtgagaagctggaaatatttctttcaattccatctcttagttttccatgtaagtattcagtttacatttatgttgcaggttaatcttaagaattgtattgctaaggcttctaagtgaatttctccactctatttgcattttgttgcatttcagaggaacatcaagaaatcatgaacaactttggtaatgaagagtttgactgccacttcctcgatgaaggttttactgccaaggacattctggaccagaaaattaatgaagtttcttcttctgtaagtatatgaggcccatgctgg

SEQ ID NO: 390 - DNA, 1068 bp, Homo sapiens
agtacaaaaccgaaggtgggagcttaaagctccacaggtccgcctcggagaacagggcagggaaagacacgtccagggctgcagaatcccggccacgctaaacgtaccggggctctccgaccgcgcagccccggaggagaacagccgtgccttcccgccgccacccggcggcatccactggggccgagagctacacgccacaccggccgcccgggccgccggccccgcccggaggcctccagcaccctcccccggaggaaaaaaattggcggcggccaatgggaggccgggaaggcgcctgacgtccgcgagcgggcgggcggcgttgcctggagaccccggcgggggccgagttctgtcccctcccccggcgcgcccgccccgccgcagccgcactcccgggctctatatagggcgcgcgctcggaggccgccgagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaaggtaggccagggagcgggcccggccggcagcagccgttgtagttcttggactttgcctctgtccccaggttctgggggacgcccctcccgccctgcctttcaggtcgggaaagtcccggggtttgcaaaagagtgtccgagcgccctggaggcggggagggcggcaaggagggcgccggtgtcgcggttgagtttctccactgccgaccgcggccacgctgcccggggcttcccggacaggcttcgcgccgcccacctcggcagccggggcggaggatcacgtgtcgaaaccc

SEQ ID NO: 391 - DNA, 1004 bp, Homo sapiens
cttcattccctggaagttgattgtcctccactccagctgtttcccaaatccttccttcctcccagcacccctcgtgcaacgacgattccagctgcggaccgcatctgtgtcagttacttccaagccacctactgccccctcgcggagtgcgtggggctcccggctcgcagactcccacggcaagtagcaagcagcaaaaggcgtggtagctgcggcggtggaatgagacagttgtcaacagctggcgcagctgccgcgctgcgcaccgggactggcgagtacgcagcccaggtactgccccttcccagtgacgtctctgcagggggttataaaagcctcgtgcgcagctaactcgcgagctgagcaacccgaaccgagaggtgcccgcgaaactgcaggcggcggcagcggcagcaaaagagaaggaaaaatctccagctggatacgaagctccagaatcctggccataggctcagaacttttacaggtcgcgctgcaatgggcccccacttcgctcctaagtcctcacgcagcacagggctttgcctttccctgcggaggaaggagaaataggagttgcaggcagcagcaggtgcataaatgcgggggatctcttgcttcctagaactgtgaccggtggaatttctttccctttttcagtttaccgcaagagagatgctgtctccagacttctgaactcaaacgtctcctgaagcttgaaagtggaggaattcagagccaccgcgggcaggcgggcagtgcatccagaagcgtttatattctgagcgccagttcagctttcaaaaagagtgctgcccagaaaaagccttccaccctcctgtctggctttagaaggaccctgagccccaggcgccagccacaggactctgctgcagaggggggttgtgtacagatagtagggctttaccgcctagcttcgaaatggataacgtcctcccggtggactcagacctctccccaaacatctccactaacacctcgga

SEQ ID NO: 392 - DNA, 928 bp, Homo sapiens
ggggtgtcaaaatgactttcatcattagaaatgtgtttgtttgtttcctatcccaacaattttgaccccacgttagttctggtacagcatgacccccagacctgggttgtccaatatggtagccactggtcccatatatggctagtgtgactgaagaactgagtttataatttttaaaaaattttaatgaatttaaatttaaattggtactccattcggttattggaaaaatgtttgtgtttttagaacagcttgggtatataaatctactttttcaactgtacattttatgaaatctagacactgataggtatctccattgaaaattcagtgttcaaattgagatgtgcctttcgctgtaaaatacagaccagttttcaaagacttggtatgaaaaaaataaagcatctccttaataatttaaaaacgagttacatgttgaaatgataacatcccctatatgttgggataagtaaatatattattaaaaacaattccatgtttttgtttttattttttaaaaaacaggttaccagaaaatttaaagttacgccagtcactcccattctattgctgagagaaaatacagagcggtgaagagcttacagtcgggtgagcaagatacgcccccaatgttagctaatgatgtaaggcatcaacaagaaatgtgggggttcaggaaagtggaaggtggggtcgtccaaagcctgggaaagtcttcagttgaaggcgagacagatgggactattagtgagtttcgagagatccaacgcctcgccgccttcgcttcatttttgtctcacgccccacccttgaacgcgcggcgccttttgaccccgccgccgcgccgtagaccgcgctgcacgccggcggcagccatggcggatgtgtcagagaggacactgcagttgtccgtgctagtagcctt

SEQ ID NO: 393 - DNA, 901 bp, Homo sapiens
tgtccagtcacaaaactcaggaaacgtgaaaatatgcatctcatctcaacagttttcctcatatctcattcttttgtaacttagtaccccactctcttatcagtaaaattagattttaaatatatattagaaggaaaaaaataccagataatttcctgttagcatcagctatcttggatgtttaatcttcattttgctccatcctttctgcctgaattccatttattaaaacagaacacataggggtttaatcaatatccttaaattttccacaaacataacataaataaactccacgttgtgaggaagagaggatttttaatacatatgtgttgaatgaatgatcattatttagataaatgaatgactgaagtgattgttatattcaggtaaattcatcatggctaggtagcaaaccaaagacttgtaagaacctcaaatgaggacatgcacaaaacagggatggccatgggctacgtaatttcaaggtcttttgtcttcaacgtcaaaattcactttagagaacttaagtgattttcatgcgtgattgaaagtagaaggtggatttccaagctgctctctccattcccaaccaaaaaaaaaaaaaaaagatacaagagtgcataaaaagtttccaggtctctaaggtctctcacccaatataagcatagaatgcagatgagcaaagtgagtgggagagggaagtcatttgtaacaaaaactcattatttacagatgagaaatttatattgtcagcgtaatatctgtgaggctaaacagagctggagagtatataaaagcagtgcgccttggtgcagaagtacagagcttaggacacagagcacatcaaaagttcccaaagagggcttgctctctcttcacctgctctgttctacagcac

SEQ ID NO: 394 - DNA, 1200 bp, Homo sapiens
ccccactggcttctgctatatcttaacaatgcatattaggccattcttgcattactataaagaaataccggagactgggtaatttctaaagaaaagaggcttaattggcccacaggccagcaggctttacaggaagcatggtgctggtatcttcttggcttctagggaggccttgggaagcttactcatggtggaaggccaagggggagcaggcacatcacatggctgtggcaaaagcaagaccgagagagagagagagttggggggggaggaccttatacatttaaatgacccagtctcttgagaactcactgtcataaagagggcaccaagccacaagggatctgcccccatgatccaaacacctctcaccaggccccacctccagcattggagattacaactcaacagagatttggacagggacaaatatccaaattatatcacagcacagtaaccattggaccaaatcaggcttagattctagtcttctgttatatcaataccttgatgtatgccttttcaaaagtcaggtaaagtgtcaaagttttatcatttataaaagagggatggcattgtacctgttgagagaaaatacaaaatacttgccgtaatattagacacacacacacacacacacacacacacactctctctctctctcacacacacatacacacacacacacacaaaattgttagctggccatgttattgtaactcctaccacacatatttttacattataatacattaataattttaatatttattgaagtatttgtagatactataaagccagccctgggaaccactggtagtatctataaagcttttcagctcttcaaaataaaatgtctgagaggtagatattttcctattttctaattacagttgacctttctctctgaatgccaaaggagataatctacacattactagttatatatttcttgaaatggatgaatttgatatataccaaggaaacgttttaaaataccaaaactttacatggatgagccaagcaggcactaatctctagctatgctcctgtgcagatgtcagcccaccaagaagggctcgtgtgacagatgctactgagaccaccatcaccattagctggagaaccaagactgagacgatcactggcttccaagttgatgccgttccagccaatggccagactccaatccagagaacc

SEQ ID NO: 395 - DNA, 923 bp, Homo sapiens
ctgtgtaacagcatgagcaaagggtgtaaatatcacccaccaaaacactctaggtttttttttggccgcccttcaaaatagaactaagcaaatagtgaaggctgagccttaaaagagctgtgttaccagcactacaaagtttaaggtgatccattactatttctttaccaaaagagacaggttgctcactgagaaaacaaactgataacatccgtttgtttgacgtgagattaccagaactgagagagaagcctgagaggttttcttagaagctgctcagcaggtatactcgtaaagtctagttcattcatttaaatgtcaaacagtttctttaaattttgaagaagtaaggaaaatgaaattattgcagatttttttcttgctatttaaatgttaagccagttatattaatatgggtaaaaataataactaatatttaaaattaatgtgtagattatcaatatacactgaaatctaaatctttacatttttatttagaaatattaccttttagaaaactaaatattcctcctaataggtactttggttttttttttactacaaactgtcctgtaaggtaaagaatgtgaacaaaatatttttttaactgcatatatttgtaagaacaattgcaaatttctatttaagctaaatgtatgctctagcaccctgaaattaaattcgtagttataagtcttcaaggctgtttatcttttccttccatgtattttagaccaatgccaggattcagagactgggacgttttatcaaattggagattcatgggagaagtatgtgcatggtgtcagataccagtgctactgctatggccgtggcattggggagtggcattgccaacctttacagacctatccaagtaagtagctctattactgcaagttgagaactgccaattgggttat

SEQ ID NO: 396 - DNA, 949 bp, Homo sapiens
aaaatcacgaactgttgcaggttcaggaaatttttgcaaggagctgcaaattcaaggtggaatcgaatgcagcctcactccactgcgctctatctagttcacttcccagccacccagccccaaacttactagactttcccgaattaattgctcccacccgggagggatctgggtaggccctccgggtctcaggaacacgaacagcaacattatttaggaattgagaaagcccaggggagcagatgtaaaggagcgcccgctttaaatttcggtcctgatatttgtagatcagggtccgagaagcatcttccaagagggtccggaaacccaggctctctgggctatccagagccagccgcttctccgttcgggcctcaatttctctcatctgtgaaatggagctggagaagtgagaaagtgaatatgggaaaaactgattcctgaggtcttttcattataaggcaatgcctgcttagcttccttgcctccttccagaggagcccagtgcggccctcgcctctacccgctgccctgcccggtgccctgccaccgacccacccttgctgttctgaaacccgggtcgtctttccacactgcgagcaggcactagacgagcaggaggctggacctaggagcgcgggtcacgcccccatgccgcccattggctgcttttgaacgttctgagcccgcccctccgggggccgtggcgtgtttataaaagacaagctgtggctccgcactctcattccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagacagcgagcggtgcgggcgaggtggtgcgctgtctgt

SEQ ID NO: 397 - DNA, 915 bp, Homo sapiens
tattgtctgtggcttaagaggggagtcgtcacaggcgtcaagtcttctttctaaagccggggacctggggaggaggtgggagtttacgggaggaagggccacggagatgggtcgcttctcctggagctagagctgcgggctggggtctccagggttcggcccggggagccgaccctggtcggccgtcggggctctgctcggccctcctgaaacctccgcctcctccagcagggggcgggccggggccgcgtctcggggggaaggcgatcaggtcgccccctcctccgattcccccgccttccaggacagcctccagcccagaggggcggtccgggggcggggtcgcaccgccccctctcgctcccaatcccggggcggccgggcgggggtgggcagggggcgtgaggccgcccctgcgtcccgggggccccccgaaaacgcgctccgggtgcccggtccctccgctgcgccctgccgccgtcctcccgggggtctcgggcggccgcggccgtgtccttcgcgtcccggcggcgcggcgggaggggccggcgtgacgcagcggttgctacgggccgcccttataaataaccgggctcaggagaaactttagcgagtcagagccgcgcacgggactgggaaggggacccacccgagggtccagccaccagccccctcactaatagcggccaccccggcagcggcggcagcagcagcagcgacgcagcggcgacagctcagagcagggaggccgcgccacctgcgggccggccggagcgggcagccccaggccccctccccgggcacccgcgttcatgcaacgcctggtggcctgggacccagcatgtctccccctgccgccgccgccgcctgcctttaaatccatggaagtggccaacttctactacgaggcggact

SEQ ID NO: 398 - DNA, 900 bp, Homo sapiens
catgacccatgtgtgctttgtaaggcaccagccacatactggaaaccccaagagcagcccatccaggcatgcgtggtggcgaatgccagctcccgggttcctctggtctcctgagtcccggagacctgggagcaggtgggggtcatagtcctgaaagccagagagcagggcgttcctagcacctcctccaatgagctcggcctgcccacggctagcaaagctcttggcaagtttacttaggtgccctgccaaggctaaaaggacaggcaatggacgcccccccccccacccaaccacaggcctcctctctgagccacgggtgagcggtgcaggttctgctgttctggagggcctgagtcccacccagcacctcataaacagggtcctccccagggctgctgcagtaggcatcaacgccagggtgcaaaatgcctcagggagccaaggctgagccaggggagtgagaaggagcatgtggaagtgcgttttggagaggcagctgcgcaggctgtcagcaggctccggccgcttctatagacagcatgacaccaagggcagtgacctcattccacaggctgagtccagccagccagccaagcatcaccagccagacgattgaccctaacggaccaaccaacccgtaacgacccctcctaccataaccagtagccagccagcccataaccagccaacttatctataaccagccacctgaccatagccaaacaaccagccggcccaccagtagcattcagcccctcagctggccctgagggtttggagacaggtcgagggtcatgcctgtctgtccaggagacagtcacaggcccccgaaagctctgccccacttggtgtgtgggagaagaggccggcaggtgaccgaagcatctctgttctgat

SEQ ID NO: 399 - DNA, 1045 bp, Homo sapiens
aagtcgtctctggtgaagaggtggcgtgcggggtgggggttggtggagggtgaaggcataagcaaacatattttaaaatccagatcgtaggaagtgtcacctggcccctcacccaggcatgctttctgggggaagcgcagggccaagctttccctagaaaagctggggcgaagagagagcaggcggcggctaaggagctcctggcaggctgggaaggtggagaagtggggtgaggtatttttctagaaagtgtagccctagctcatctcctagattggggaagagggaactgagggaggagggaaggagacccagggcagctccaggatagggaaatgttgaagaagggactgcgttctccaaccgaaccctccctcctgggaaccgcagcccagcgcggtaactgagttaccgcaaccgggcggtggggaggaagggtggtccaggaaaccggcgagggagaaaagcggtggaagggagagtcttctccctggagcggccccagcagtacaaagtgctggtcacagcgccccttccgcccctagattgacgagcagtggcgtggagccagcgcggaggctgccccctccccctcccgagcccgcagcgcggagcgcggtttagcaccaacggagccgggggcggcgtctttgggatggaaaagggccaaaggggaggagtggggtgggggtgggggtttcactggtccactataaaaggaccgctcggctgcccggttcttgcactcgctggaaagcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcctgcgcctgcctctcagtgtctccaactttgcgctggaagaaaaacttcccgcgcgccggcagaactgcagcgcctccttttagtgactccgggagcttc

SEQ ID NO: 400 - DNA, 1081 bp, Homo sapiens
agactgaaagggtatcccagaggcaggtcactggccttccagctccacctgtgggtggccttggccaggcaactgcaagagtgcagggccccggggaggtcgcacctggcaagcgctgagggagggtaaagcggagaggggtgtgagaagagaaaaacaacacagagcgtccgagctatgtgaggcgtgcgaggttaatccggcccggagagacaggtctatgcggcttcagcggtccccacccatgcctggcaattgtttaaaggcactattgctccggacccgctgccttcacccatgaacttcctttcctggaattatgatataaagaacaacgtacagccaattaatagcttgttattttcatgtaaattcttggtgagctatttaagaactgcccccctcttaagctttataaacccacttgtcactgttgcaaatcctatgttcagggcaacttgaagctatgctcccgggttgcaatcttcaaacttggcccaaataacctctctacttatatcaagtttgcctcagctttttttttcttctaggtcgacggttcccgccccgcaagggtgcagggaaggggacgcccgcacttcctagtgctcccttagctggggtcgagctgagcgccccccaccgagccccaggcggctctgtggagaagcccctcggccccgggttcggtctgcactgccagcccccagtccccggcgcgcaggatccagcagggccagcgccgggcgggcgagaaggcgagagagctagggccgggcggggagggcaccggcagggggcgcgggttcccaggaccgaaaaggcggagcctcccacgcgcactacgtgctccctacgcgcatgcgtcccgcccacgcgcaggcagcacctcgcctgactgggtagcgctgccacgtcggggcggggaagagcgtcgtcgcgtccgggtgacgtctcccgagggcgtcggcagggtcggcggcgtcggcagcagtgtcgacggcagcggcggcggcgggtgggaaatggcggagtatctggcctccatcttcggcaccgagaaagacaagtgagtgggagc

SEQ ID NO: 401 - DNA, 998 bp, Homo sapiens
acgcgttgccggccccacgtgagccgacgccccaaagcgcggctgctggcgccggctacgagatcaaggtcggcgcgtgcgcgcttgcgcgagaccggcattctcagccccgcgccggtttccagggagctgggcgcatgcgccgcgtaaggggcccggccggcggaaggaggtgctactgccggaagcgccggcgcgcttgcgcagtagctgaacgcgggcgtttctttcctccctttttttcgaattggttttgggggtagattcgagttacaaaatggccgcccggagcgtgttcggcgcggttcccccagctgtctctggctgaaccggcgctctcgcctccctgccgaacacagcgtgaggagcccccccagggatatggtgtttgagtctctgggcttgccgagcactaagtcctctgagttccgcagcgcagcaccggaagcggccgagcgcgctcagcccggcgacccctgcgggctccagacccctgcgccgctgcgccccgggtttcgccgcaaccaagacccagcgagtgcagcggcggccgccgaggaggtgaggagcggcggcgggcgcgggaggagaagaggctgagggcgggagcctggtgctgagagcccagggccgggagggcgggagcgggctcgggcctgggaggggagtgcgagtgcagggctggggactggaccctggggagggaggtgcgggttcagcgccgggggacgggcccctggggaggggtgcggggccgggggaccagaccctggggaggggcttaaggggctggaggacgggaccctgggaagtggggtacagggctagaggtcgggactctagggagggagcctgggtcgggcgcacgggccgggcggggcgcgcggtgggggagcgacgggtggagggtggggtgggatgacagcggcgacgcagccccggctgtttttgaagcggggcccgggccccaccgggctgcggcgtccgactcgagtgag

SEQ ID NO: 402 - DNA, 907 bp, Homo sapiens
gaagccaggacggaaagaaaccccagcctctggggaaggctggggggccgggcgactccctccgcagcgcgccggttcctccaagcgggccgggcgggggaggaggaagagggctgggctggagctagcaaggggatattcctctcccggcttgagtcagacgcgggcggatccgtcctcccccgttccctcccaggagacgggaacttacttcatttccctggggcaggttcgcccacgttaccaacttctccccctcccccagcacccccgtcccttccagcttccgcgccccccacccaactgggcaggacccaggtcgtgctgccaccccctcttcggggaaaggcggccgcagccgcagacacctgggggccggggctgggggtgggggctccctagcagccgccggagcgttgtccaacacgtgagactcatgtgatgaagccgggggagggcgggcaggtcgctccttccctccccggcagtggccagacgtgcctggagtcacagggtagaacacgtagctccaacccacccactcgctcccatttaacccagcccgcagcctctccattactcctcggcttgcccccccacccccccactccgccctaaccgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctcc

SEQ ID NO: 403 - DNA, 929 bp, Homo sapiens
gacttcacgtgctttgatgtgtccccacgaccgtttacttttctatgctgttgccagaggctgcctagcagggcctgtgtctcccgctgacctttaaggccagcactgcattcagatgttgggcttttccaattttgcttaaataacaacaaaatcaaccgaattttttcaaattagagtcccagggagaagaaactacagagaaaaaaatcatattatgtatatatatgtatatacatatgtgcatgtgtgtatgtatatgtatttttacaatttttttatccttgtttaaacctgggcgggaaccaaagagtaaagcgcgtgcggctccctgccccctgccgccaagacgcagtcctgtacagacgcggtcccttccctccgatttcccctgacagctcgcgctactttttcccggccattgttccgtgtccctggtgcttcctcctcccccgtcctccatcctccttgggcgccttgcccgctttgtcccgccagccgcctcagccccgactcgccggggtcagaaagccgccaggatgccctccagcagcccgcgcgccggccgcaggtgcgcgccgccccgccctgcccttcccgcggccccgccccagcgctgacgtcacagtgacgcgcagcccgcgcaggcgcagctacccggcaccccctccccgcggccggcagcccgctcggtattatgattagcgctgggtgcggggtttcggcggccgggagggagttgtcggcgccgcggccgctgcggacggacgctcgcctgccggctgaggtaggggcgagcgcggagcgcggcggggcgcggcggccgtaggcaggggtgcggggccggcctccgccgcctcagtagcctccgctgttgccgggctgggcgcccgggccggggcgctcgccgcaggcggaaagtaagttgc

SEQ ID NO: 404 - DNA, 915 bp, Homo sapiens
ttgccaagccctacactttatgtgttgtacccgggaaactcaatggaggtatggcccaacgctgacctttggcatggaggcctaagccaccctgctggtgcccagggtggccagcaaggggcttcagacaaccctggatggaaaataaaaatagtggctaatatttgttacacgctaactattgtcaggccctgtgccttcccctcctccccaagtgctcagagctgtggagtggatgggttccaccctagccctgttcctctgtcccctctggatcatcttagaccagaaagtgccacagctgagtgtcccgcttcttccgcatcctgccaggaccactccatttgtgggcgatatagccagctccacctcctccgggaagcccttgttcacagtttccaaagcaagccgcaggcgggatggatcctgcttaacaccccggcccagaaccccttggatctccttcttcctccatgtccaagacacccagcttaacaaccctgtagcccccaacttggccctagcggcacctcgcctcgaccttgccattttatactcaattggggcgtagggttctgaagcccagggtagttggtggggaggcagcacgagggtgcaggatgaggtcgggaaaagagacctcgtccgcccaccgcctagcgcttcctcctccctgcaggcgagccggggaatccccggcagcaccgatatccgcagagcccaagaagtgggcctctctgccccgcccccccggctcgccgagggctacgcggcgcgcctgcgcagaagaaggcagcgcccaaggcgcatgcgcagcggtcactcccgctgtatattaaggcgccggcgatcgcggcctgaggctgctcccggacaagggcaacgagcgtttcgtttggacttctcgacttgagt

SEQ ID NO: 405 - DNA, 979 bp, Homo sapiens
cctaagacaagcaggggtacagagtttccattctacagaggaggcctggagaaggatgactggtttaggactaagcgagccacctgatcgccaggctctggccttgaaacattcaggcccctcagacgccaccgcggccaagctctcatcctgcctctttccttgcccttcacccaccctccctccaggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggtatgtgcgtcgccaccgcccctcccagcactgacgggcctgagggacgacaagttgacgctcctttcgtcatcacctggtctaggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccaggtaaccatggcaaccccgggggtggggcctcgcttccggtagccgagagttttgttagaaccgcgtccccgccccagttccctgtccgtgagccgatttatctgcccagggtcggcgcgcgcggctgtctcagaactcatgcagctgt

SEQ ID NO: 406 - DNA, 1081 bp, Homo sapiens
tatcccatgtacataagctcccggaggagcggtggccgagcaagcctctgggcccgagcgttcggtgtctccacttcactcaggtatagtgttccctggaaccgggaggctgccagctgccagccctcctgccgctcatacggtgtcgtcagcagttttgtcaggtgcccccgccacgtcactatggcctctgccagccagcctggacccctgagaggcaggagttacaggctgaaggtctgacacaagcattagtgagatgctcccctcgaagaatagtcttgtttcttctaaggactgattctcaccccggctttggctctcctaattttagagggtaggtacgggtctccagatatactgcctaccacgctttgctcacccctccaaccggcctcggtgttccaggagccagcacagcaggtggtccagcctttcctggacctcctcgtcccggggctggtatcgatccgggtatccgtctctgaggtcaaagttggggcctggaccgttagtggggggtgggctatagtagcgcagggctcgggcatctccatggtactggcgttgagcatccagggagaagcagcccagttccgaagggcgccggtagaaaggaaagggcccagagtagagggcagggtctgtgggcagagaaggtgctggacgaggtagtttgttccgaggctcagctacctctgtcttctcagctcctctcttggtccccctgggatccatgaggtcctaagacaagcaggggtacagagtttccattctacagaggaggcctggagaaggatgactggtttaggactaagcgagccacctgatcgccaggctctggccttgaaacattcaggcccctcagacgccaccgcggccaagctctcatcctgcctctttccttgcccttcacccaccctccctccaggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctt

SEQ ID NO: 407 - DNA, 938 bp, Homo sapiens
tgctgaataaattcccaccagttgagctaatggagcaacggagctgccagtgcttcccggaggctgctgtgctcagccaattcggaggcatggcgagccacacggtgggaggtgggtaaagccggggccctccaaggctgggcgccacgttgcttttctcttctgaaataggaagacaatgcttctggctattgtataaaccagccgaggactgctttcattcgcacatcagccaaggcgtgagcagaattaaagcgccttctaattcgacccctggcaacgtgcgcgtcacggacaaatgtttagttttaacgcctggctgcgttcgccttgggaaaacacacttttaagaatggccaagtacctcagcagtcgcggtgaactgcacaagatcaaaaccaccacgccaacccagcgctggccaccgtccccgctgaaccccgccaacacccctaaggacccacccatgttttctgctaatcattttttttttctaaacagctctgcacagcctttcctcattccgttcccgctctccccacccactctgcgttcgatccgaggtttctagtccccagctggacatcacagcaccaactcccactcaggagccggccagagcccgagccgcagcgcagtgggcagctccccgcgctctccgccaggccctcggccagccagccgccactcggccgcgagtgattgacaggcggcagcagctataggccgtggaggtgggacgatgcgtcacttcctggtcttttggggggagccgggatatataagggcggtgctcacgcagcgctctcgcttacacagtatggccggcgacattagctagcgctcgctctactctctctaacgggaaagcagcggaatacaagagactgaactgtatctgcctctatttccaaaagactcacgttcaactttcgctc

SEQ ID NO: 408 - DNA, 1050 bp, Homo sapiens
ttcacatcactccagaaccagaattttcttatgttagctttgaaacaaacttaagtcagacctcctatgatgacctgatcaggaaagttgtagaagtcttcaagccaggaaaatttgtgaccaccttgtttgttaatcaggtaattttatattttattattaatcaggttatttgatttttaaaatcttaaaggaaatgagacagtgaggcctaagatgtattctgagatagcacatataccagccactcagatatccagaagtaatattgtttgaggttactggtagctgagaagctttgtttcattagacctgtgtcagtccttgttttctgtctagccaaactgatgggttcctcctgtcttgctattgacaggcctctggtgggaggaaccataagatgccctggcccctccagcacataagaaggcagctaaaataactcagatgtcttagtttcattaagataaaagtctgtcacttaactgttttggttgaaaatacttctctggattgcaaacactaacggttatttaattttttcccccagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattcccca

SEQ ID NO: 409 - DNA, 936 bp, Homo sapiens
agtatgtgtgtgtgttggggatgagggtagaaaactaattctacattatgcaaagacttataaaagtgatgaggaaaatctttaaaaagaaaagacaattaaattccttgaggtatatagcctgacaacaatttattttttggatcatttgacacagtgtatgtaaaagtgcattgggaattgtgccattttatacaaatatgaaatagcactacttgtactgctttgtacaacagcgtgcatatcttactatcttagagactttctgaaacacttatcttggaattagtttcaacaaagacgaaatgtaataataggaaggtgaaaattatctctagagcttttaaagttaggatagatttcaagaaagattaaatctggaactatatgaatagcataaaaattaaaaatattaagagaattgatactttgtaataaagtataattatacttttataagcgtaatgaacataagtgtttgttgctttatgcatttgtttctacacatgaagtctttattttctgaaggaatcccaatggccctggctataacactacaatcattttcttattttacaattaattaaaggttaaaacatttcacattgagcttgctactttgtttgtttaaagaaaagtaaatttcctcttatcttacattttgaagttgctcactataaacttatataaattaggcataatgacaattaagtaagaacttcaagccctattcatcccatggccgtcatactgtgacgtctttcagagcactttgtgattgctcagtcctaagtataagccctataaaatgatgggctttgaaatgctggtcagggtagagtgagaagcaccagcaggcagtaacagccaacccttagccattgctaagggcagagaactggtggagcctttctcttactcccaggacttcagcac

SEQ ID NO: 410 - DNA, 1100 bp, Homo sapiens
tttgcttctaaatcaaccccaaaccgtcaggcagagcccggagggaggctctgcaagtttgtacacacccccacctcccggatccagggcaacagcagaagcaagtaactgtgtatgtgcaaaaaggtggatctggggacgaggatcgctgagtttgtttacagagcagagacgcctcagctcggatgccaaagctaccaagagctgcaaacgcaaacttagcagaagcacacgtaccccgggagcggcaggcgggcccgaaagcgcggactggaattccagggcgcgggagcgggggtggccgggccctcgagcgcgctccgtccacctgcagcggctgcccctccccgcccccagctcctgtccttgaaaggagtggaggaaaaaaatgcatctacaagcggtgatctagagtaggtctacccactgcccgtatgaaaacacaaaggcacagcctaggaaggcgcgctcaggaaagggcgcattatttgtccgggtctttaaaacccaactcgaggaagcacagccattcttcgctgcctgtggaagcttttgcaaaaccggggaggcacaagggcactctggagggcggggggcgctgggcgagtccccttttcccgtagagagcggggcagatcgctaggtgaaccgagtgagaaagctgggggtggggtagatccagcctgaggggggcggtgagctctcctcgtggctatcccggcaggctctaccttcgggcggggcggcaggggaggattttccccctgcctcgggggtggctgagccaacctcgcgtttctgggccgggaagaaaccagagtcggggggcgacggggcgactgggcggcccccgggccccgcagcctctgcagcacgtgccgcgggcggcggggacgcggctccgggacccggtccagggtgttcgcggtgttccggaatccgcgtcttggcgccgcccgccctggaggctctcgctccgcctttccgaaatgcctatattaactgtggccaaagccctaagaaacacagctcattgttggcagctgccgggcggtcctgccgagctgtgagggcaacggaggggaaataaaagggaacgg

SEQ ID NO: 411 - DNA, 1063 bp, Homo sapiens
ggtgggttaaagggacgtttactccaatactatgcaaagtaaagtggacctttctgtcaaacaaaaatagtaataggccgggcatggtggctcaagcctgtaattctcagcctggtggctcaagcctgtaattgtcagcactttgggaggctgaggcgggaggatagcttgagcccaggaggtcgaggctgcagtgagccacgattgtgtcactgccctccagcctgggcgacagagtgagaccctgtctctaaagacaaaccacacacacatatacacacacacactgacacacacttattgttcaattcagtgcgtgttttgcttcgttttggatgaaaattaacaggctttcacattgtgacttaatcttatcagagactcctaaagtaaacaatagcgcagtaggagaaaccctgattgtgtaacttctgctcttgctcccctggaaataatgtcatttcctataaacccacccccaaacaatcgtgactacgtattcataccactggagtcttccaaaatagcaactgcacattatttatcaacgtttagtttgcatttgacaaagcacatccacctgggcttccatttatcattgctattattatattttattattattttcttatttccaaaatctttctagaatggaaagtaaacggggggaccaaaaccccacttagaactctgcttagaagattcggaaatgcccttgaggtttggtcctcccaggagagcacgaagtttatcctcgcgcgcagcctctcttccccggcccgcgcccaccggcctagcccggggctagcgcccgcccacgtgtgctcggctccaggcaaaccccgctgagcagcggccgcacaccgcccaccccggggattggccagcgcggccggggcccggcgggaggcgggctcggggtcgcgttccgggagcgcggaggaggcggtgccgcccggccccgcgccccgcccccgccccgggtggctacacagaggggcgcccacgtgcccagccctccttctgcagcgcggccggcgggcgctcctcttcccgggaccag

SEQ ID NO: 412 - DNA, 912 bp, Homo sapiens
ccaccagttccacaaataggaaatctctgcactgctcttgctcgtaaagtgtatttgctttttcataaattgcttatgttctttgagccaccaatggtttaatgtcagaataatatagatcattagagcctctcaagatcccacaaggaactgcactttctcctgtagttaaccatccagtcatccatgcaagaaatatttattggatgctaccatgtatcaggcactgagccagtattgagatgtgaagacacagtgcataatctaagcctttacagaggccacagatgttgggtttttatggcttgagaacaacatacattgtttctttccaggaagctaattggggtacatggagccactttgactaagtagcaaggaacaggaactgcacactggttccatcttggcttccaatttgtattcagacccaggcaagagttaaagagttcgatgatagataagcacagatgcaaaacagtacagtccagtgcctctttgcttaggctaatatctgccctctctttatcctctccagccctgccttcctgcctttgacgcagggagctaagggtctgaatgaaccctgttggaggttgcaattaaatctttgtggacaaaggcacacacacacacacatacacagaatcctcagataacaggaggcaataaatccaacagcacatccacgttcagagaacagtgtccctgctgtcttgctaacagctgccaatacctcactgagtgcctcacaccaacatgggctccaaggtaagatttttctctctccggacaaatttaatctttccttgtgatttgtgtctctgtcagaggattttgactgttaagtaaagtttactattgatttgttggcaaattcctggttttgtttgtttttgttttgggatttgg

SEQ ID NO: 413 - DNA, 1001 bp, Homo sapiens
atctgctctgcttttggcgacagcgtcccgtcggcctttcggccaggacgcagcagccgcgtctctgggcctcgacccccagggccggccggacccgggacctccgaggagagcagcgagaaccggcccggattccccgaggcgcccgagtgcggtgcgggcagccctccccgcctgccaggccgccgctgtccccacgtctggtcccccacgcctcttcccgcatctggtcccacggtggaggcgcggggcgagggcctcacgcgcgtgcccacggtcggggggcgtccttggacgcgcgggtcctctcccacgggtctccaccccccgccctccggcgacaggagccggcctgggacgcgcgcgctgcggccaagtcctggttttgatttcactcccaaccccgaggagcgaggaggttccaagcccacaaacaggaagaagagaaggccctggagtgctggcagagggagtgtcattcccagcagcgcagcgcaggccggcccgggccggggagggagcagcagcgcgggcaccctcctgcaacgtgggctgggggtccccagggccggggagggggccccggggaggaactgagagggggcgcgccccgggaaggctcggggcggctccggggggctcccagggcgcccccgccccttcccccgcggccccggggcgcccccgcggtgccggagtcggggcggggcgtgcacgtcagccggggctagaaaaggcggcggggctgggcccagcgaggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactc

SEQ ID NO: 414 - DNA, 1016 bp, Homo sapiens
taactcatgcatctctcactggccgcctctctctttaatttgggaatagaaaagggagtccacaattaattttagattgtgagaagagagacaaaaaaaggagcagagagtttctgagataacctaaaatctttgccgcaccccttactaaccccggtttgtgccccttcactatgggagtagctcttgtcatcatctaaaaaacttgaactgcattttgagagatttattggccttgcttctgcaggctcataactcctttatgtgcttgctcttgggaggaaaaagcagatagacgtttaaaagctggatgttcctgcacacccctctcctgatgcttcattcttttccaggcagaaagatggtgggactctgtctctagcaaagggatatttccagatactgaggtgttgtcagagacacctggtcagggaggttaggagaaggggcatccaggtccaccccctccaactggctgctgctttcctggcagggctgcactgggacacctcacttccttcccacttccccttcctcctcccattcgctgtctctttgcacacccctaatatggcctttcatagtaagaggtcaatatgttttcacacttgggaaatctcattcaagaatttttgtcaatggacaagtcataagaagcccttccattttagggctcgttgacgtcaccaagaggcgataaatatctgttgatataattggatgtgagattcagtgttgagatagcaaaattctgcccctcgttccttggcagggccctatgatttatgcaggagcagaggcagcacgcaatcgagctgtcaagagagcgtcagcttattaggcaaatgctgcgtggtttttgaagagggtcgacactataaaatcccactccaggctctggagtggagaaactcagagaccaagtccattgagagactgaggggaaagagaggagagaaagaaaaagagagtgggaacagtaaagagaaaggaagacaacctccagagaaagcccc

SEQ ID NO: 415 - DNA, 1027 bp, Homo sapiens
ggagacaggtcatgtttaccctggcactcaataaggtctgataatgactagcaagtagcaccacgggtgggtgggcggcggggttgttaaaaatacgtatctcagctctaactcagacctactgaatcagaatctacattttaacaagccgccagagaaaagtagttatacctttaaaaaattgacttggaccaccgtatttgctaaatttgacaacagagagtaggagattcagataacttgaaacggaggaatagttcaatgattaatagttcccaatttggcctcaagctttctcgttttaattgaaaaacaaggttaacttgcaaaaacctcgagattctcagggaaaagcagtgaggatgacctaacagtagacaccaaacaacctcactcagccattccgccatgcccagcgcgaaagactcaggtttaaaatatccggattcggcgcgccggatgtccacgccagctggcgcggcattatgggaattgtagtcccggcccgcttcccgatttaccacaaactgttgggcccggagtcggaagagacccgggtttgggaaggaccccagggtcaggcgtcctggtggaagggcgggcctctttctctcttgctcagcagggagtccagagccctggaggaaagccagctcagctccgcatcggcgtcggcggttgggacgcacacactctgcgtcatggagggctgaggccgatgatgaattccggagtgcctgtcaggcttgctgtgtcactcggcccgctcggcgcgccccttcccagccgcccttccgtaccggctctcgggctcttccggtctccggccgccccttacctgcaggctcttctcccgccgcggcccggcgctctccgagtcgcccctgcggactggtctcgcacagtgcctgggcaccgggcgccagacagacactggccatgacgagcggcgcaaccaggtaccggctgagctgctcgctccggggccacgagctggacgtacggggcctggtgtgctgcgcctatc

SEQ ID NO: 416 - DNA, 1035 bp, Homo sapiens
cagtcgtgttacgcaacaactttgcagccgtcatcttcgccctaattgtgcagggggcggtgtttgtgcgtggagctttccctcccggctccgggccgtcgcggctctcgggagaggcgccgggacattttaatcgctgcctccgccgcgcagccctgcgcagctgcccggccgcgccaaccccttccccgccgcagcgcgccccgagtgttggcagcttgccagccgccaccccccgccttccctcctgcccaccccaaggtagagggctcctctcgggagtgtgcggggaaggggaggccgaggtccgggccacgcccgggtagccgcaacccgcagtgctcagtcggcaacaggtagcccagcaggctgcggctctcaggaagacaaaaagcgcctctgcgagcaagtgagggtcgcggggagcgcagagccaccgcggcgaccgggagggtgaagggagccaagagcggacggggcggtgggacggggggctcccgggctcctccgcaggctcgctccggtcgtgtcggccgcgtgggccgttgcgcaacactcgttgcgccgggaatggggcgccagccctcgcgggcgctcggacggcggtggccctggccggggagggacgcgagctggtagtggcgccgccgcggagggggagctgagggcggggaggcggggcggggccgcggagtgcccgccccggcccgcccctgccggccgcggccattggcggcgggccgggggcgggtgcgggcgcggcgattggggccgcggccgccagtcacgcggggctggcgggcggcgacgtagcgcggcgctcggaactgacctactaacacacatctctccgcgcggccacggcgcccgcggacccggcgcgcccgcccgcctcccgcgccgcgccctcgccgccgcccgcctcccgccgcggccccggaggcccggcccggcccgagccccgagcgccggcggcccgactcccggccgcccctttctttctcctcgccggcccgagagcaggaacacggtaag

SEQ ID NO: 417 - DNA, 802 bp, Homo sapiens
acgcgtgaccgtgccgcccgctgaccccaccagtcttcgcgggcttcgaacccagggagccgacaatggcggtgagtacggccctggtcgcgcagcgaccgaacctgcgcccggttcctcgcgccccgcgctggggcggacgccgccgccgccgccgacaccactgccgccggcgtcagctcggctccagcccgccagctgcctggctggcgtcacggcccggcccagccccgcccgcgcccctccttcccctcccccgcccccacgtgcgccgagtttgttgatttagctgccatagcaacgatggaagggagcctcggggggggcggagagaagaaagggaggggcggggcatgggagaaggcggaggaaaaggctgtagcgaaggaagttataagtaaggaacgcgcgccggcggccggcagtttcccgaccagagagaacgaacgtgtctgcgggcgcgcggggagcagaggcggtggcgggcggcggcggcaccgggagccgccgagtgaccctcccccgcccctctggccccccaccctcccacccgcccgtggcccgcgcccatggccgcgcgcgctccacacaactcaccggagtccgcgccttgcgccgccgaccagttcgcagctccgcgccacggcagccagtctcacctggcggcaccgcccgcccaccgccccggccacagcccctgcgcccacggcagcactcgaggcgaccgcgacagtggtgggggacgctgctgagtggaagagagcgcagcccggccaccggacctacttactcgccttgctga

SEQ ID NO: 418 - DNA, 1082 bp, Homo sapiens
ccaaaccttctctttcttccacaacctctatgctatgtatgttattttcagaggtgtgtgttcactgtaaaccagccaccattctactttctgtctctaacattttgactaccctaaacacctcatataagtggagtcacacagaattttgtttttttgtgactggcttatttcacttagcataatgtcttcaagtttcctccaggtagcatatgtcagaattttcttgcttaagcctgaagaatttttcattgtatgccagtatcacactttgtttattcatcagtttatggacacttgggtttcccctgccttttggctatttggtgaataatgctgttatgaacatgtgtacaggtattgagtccctgctttcgcttcttttgggtatatgcccagaagtggaatctctggatcattattttcctcttcttaattaataagcatcttgggggacgatactttgagattacctaaaaagcctgttatttttctgacactttcacccactagttttagcatccatcgatttctatctgaatcaattattctaatggctgtcaaatggcaattttctaattccatcactctttctgcatttatgagctggcattctattggaaagaagaaactttccttctccccgctttatttatgaatatggactcattttattgaatgggctatgttcctttcctttttacactattgctctgagcaattcttttccctatgattccccagagtgcaagtttggggaaatgcgggaactttctgtatttctttgtcaccattaagcaaaccgggagtgcaacctgacttccccaagttgagaaaaatcactttcctgcccatgcattagtttagctcaaggggaaaccctttttcgaaagtgctttctgggtagccccgcgcgaactgcatttcccagaggtcttcggagatacgtcatcagcgagcgcggcttttttgcttgcgaagccggctttggagagctgctgtggcggcggcaacatggcggacgtgataaatgtcagtgtgaacctggaggccttttcccaggccattagtgccatccaggc

SEQ ID NO: 419 - DNA, 1055 bp, Homo sapiens
ctgggggaagaggtgagtttaatatccaggttcttcgttgcttttgtggaggtacatgagttcatggatttaaattttgtctaaccattacagcaattcctgtggccgtgagaggcacaaaagcctgacacgatgatggaggcatttgcccagggatattgtcagtgcagtaaagaataattttagttcagacgctcatgctgtctcccctttgccatcattttgttgaacagcagccataaccccagtgtcaaaaataagccccccgcaaaggctattgccattaatagaggcgccagtgatggaggagtcctgctagacaagcaactccggagtctgcagtttcctaattcaatattaacaacaatgctgtcctcttactggcttctccctcattttattttgcgtgaaactgtggataacgtaaatgcccaagcgctttctattcagtcctcaaatgcaaagcagacccttgctaataatggtaataatccgaatgggtttaactgcagcattgtaagaaaaggcaggcagtactcttagactacaggggtggatctcatcatttgattttcccgactccgccaggaaataagaggggccttggcttggggagaggtgtgtggggaggcgtaaggggtgggccccccggaaatcctgctgcgctgtttaaacctaaggtgacctaacggatggcgggagcggccgcgcgagccttggagcagggcgcggccattggtgacgcacgccggggagcacggcgcccacgtttccaccattagcgaggcctcacacccggcgctccaagttcggggctggaggcgtcccggcttcctccctcccggagcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcat

SEQ ID NO: 420 - DNA, 925 bp, Homo sapiens
gcatcagaaaggagcagacattttcagggatgaataggcttacactaggcttaataaaatgggtgccagtaacggtggctgtgatggtactcagaaaggaatttcttctcgaaaacgcacgtatggcagggatgggggattccaagtaccagctgtgacgcatggatgaccgtcataccactctcactgattctttagcttcctagtcaagcaccatcgtaactagttgaaccagtcgagtgggagttgatatttcagatcagacctcgtatgtttccctcagagtgtagaattgccatataaataacaggatgtctagttaaatttacatgtccgataaaaaacgaatgtgtagtgaagtccccaatatttggtacatgcttgtattaaacatcatttgtgctttatctgaaattaaaacttcatagtttcatctgttttgactttttgtgtatttttatttatttatctggcaaacgtcccagagcggtaagaaccggcacggttttgccgtggcacagctgattacaaacaaaaagtctctccaatcagaagcaagcgcgcagagaactggcgtccggaatagagacgctgtaaccaggaaaccagggtgagcacccaccctaccgtcggccgcttctaggagacgggcgcaggcgcgcgctgacgttacatctcgcgcttaagggtggggacgacagagcgtctctctcggacgtgacctcagcgcctctttgtgattggctgcctcgggggcgcggcccttgggcgcggacgccctagattggtgctgcggaacagcagggagggactccggctgcagccgcgggaggtccggacactggcggccatggaactcaccggtgagtgcgcgtcgcgccgcccctctccagcgctctgggccgctttcggatggggctgttct

SEQ ID NO: 421 - DNA, 959 bp, Homo sapiens
acacaaccacacacgtaaaccaccaaacgcacgcagacacacagcattcggctctcccactccaggctcactcgtgagcctaatcaaacacctgcccgccctctccaccccaggagctgacacccgcccgccaagccctctccagacggcagcagatccaggcggggagaagagccccgagaggcaaattccagtgggtttgtttacacagcgcgggggagggggcctgagccgggtactggggcccgactgactgggagccccagctcagactgggccagctccagctgtgcagcctgaggactgcgcacaaacgcccctccgttccaccccacccccgctgcacgccggtacgcgtctcccctcctcttcacacgctgttcacaaacattagcatacgtctgtcaaagagtttcacacgcttccacacacgcggctgtgatactactcacaaatgctttcatgctagcgcgccatcacacgtatttcatgtgtggttacagtttgtcacccttcatgcccagattctcacagtccatattcaagagcctgttcgcacggtgtacgcgtgtgttgttacatatactcaggttattagcgctctttgacttatctaaaataagaacggccccctctcgagcccagggtcccgcgtgtcgctcctgcgggcaggcactgatgtgatggacagaggcgtccttagccccggccgcacacgttacacactcgatcacacaaagcgttgcactttattcccggcatctaggcgatgacacaatctccagaacaaagacaacattgacaaacccaacaaaaacaaacagccgcgtgtgtgtggggaggggcagtcaagcgcagagtccgggaaggggatgggggaggaggagagtgtgggaacgcgggcgcccgagcctgggcatgcgaggctcagaaaggtgcggggcatgtcaacaacctcg

SEQ ID NO: 422 - DNA, 932 bp, Homo sapiens
taatggatctgaagagtaccccgggacagtccggggagatggagattcggaaagtatccatggagatcttacagaatcccctgtgcggaccaggaaactcttgtagatccctgcctatctgaggcccaggcgctgggctgtttctcacaatattccttcaagatgagattgtggtccccatttcaaagatgagtacactgagcctctgtgaagttacttgcccatgatcacacaaccaggaattgggccaactgtaattgaactcctgtctaacaaagttcttgctcccagctccgtctcttgtttcccacgagccctggccctctgtgggtaataccagctactggagtcagatttcttgggcccagaacccacccttaggggcattaacctttaaaatctcacttgggcaggggtctgggatcagagttggaagagtccctacaatcctggaccctttccgccaaatcgtgaaaccaggggtggagtggggcgagggttcaaaaccaggccggactgagaggtgaaattcaccatgacgtcaaactgccctcaaattcccgctcactttaagggcgttacttgttggtgcccccaccatcccccaccatttccatcaatgacctcaatgcaaatacaagtgggacggtcctgctggatcctccaggttctggaagcatgagggtgacgcaacccaggggcaaaggacccctccgcccattggttgctgtgcactggcggaactttcccgacccacagcggcgggaataagagcagtcgctggcgctgggaggcatcagagacactgcccagcccaagtgtcgccgccgcttccacagggctctggctggacgccgccgccgccgctgccaccgcctctgatccaagccacctcccgccaggtgagccccgagatcctggctcaggtatat

SEQ ID NO: 423 - DNA, 802 bp, Homo sapiens
gcttccttgcgatggtggggtggtacccagtaggtgggaactctgttctggcttcttactggggtgccctttaggataacactttgttaaatgaactgagctgggtggtttcatagtatgttcaagcatgtgaacatctgcttgctgataaatcgtactgggtcaccagctcacactaatcaccaggtaacatgtgccctggtgagggatccagtcttctggccctgtggggagacaggcccatgatgtcaccagttcccaggtggacaacccaaggcatagtgaggtctcggcaggaaggaggaagacattagactccttcttttttcttctccccattgaatcttctgctcctttccttaggccagatgccctgtctctctcctggctggctttcccagccctggccctggccctcccttctttgtgaaactcgaacaccactgccctttcatctttccaccagaacttgtgagcagtggcttttgaccgccgctcttccagctcacccctgacctagtgtttgtttttttatccttccctcagtctactcaaggcccacccctaagccagagattggctcccaagcagcctctctctcctgggagcggtaaaggaggggacagttctggaaagtcattgacaggggattaacctagaacatcaattataaacaggcagcaggcctcaggcccagacttgggtgttacaggaacagtgtggcctctctggaactctgcagaccaactgccgtggtaagagaaccgactttcagaggcctctaggcactttgtcctgggta

SEQ ID NO: 424 - DNA, 1054 bp, Homo sapiens
taaagccctctttctcaatgacgtcaagatctttaccaagattaggctttcacttctctattgcagcaattagccagggaatgtataaaaggcgtcagggagactcactgggctgcagagagaggcactttgcaccacagacagatagcaagaagggaaagacagagagtgagaaaaaagaggagtcagtcgctcctggggaagggagagagtgagactgggagaaagagaagcacagaaagtgtgtgtaaaacggagtaaagaaagaaaaaaaaaaaactacccttaaagcacatttaaaaaaaaaaaaaactctggcaattcaagaaagaaacaggctacgtttaaagagcatagagacaatgaaaggctaaagaaaattttaaaatctctgccacagtctcataggtgcttggaaatgaaagtagaactgcctgtctttaacggactctgacagaggtaactggattagggacgagtacgccagctttttttttttttttttttttttttttttaacatcttaaatcctgaaaaaaaaaaaaaaaaaaaaaaaaaggcagcagctccgaattgaatgaattgatgggcacactccaactgctgggctggagagactggacttagtcttgccatttctgcttctttgaaagaggagacaacttgggcttccttttaatttagttttttttccccttctcccccaacccccaaccttcccccttacctcccccaccccctttatcaccaccccccttttaaataagagggtgaaggggaaccagagcgcacaagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacaggtgagctgagct

SEQ ID NO: 425 - DNA, 987 bp, Homo sapiens
acgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgattttaggttctgcctctgagtttattcctgaggggaagctcgagccggggcctctgccctaatgaagcggatgtctaagaaagatccctccacccccaaggaaaaaggtcactggctagtgtagctagtgtaaacaggacccaggcgatgcatgggaccctgcccttttttttctagtgagcctccgacgctgttgcacaagctgactcttcgtcacgtgatgcgaccgggctccgccccggcggcaacacgctgtatagacgcgccgggtgcctcgtgcgcatgcgcggcaggcccttcgggacgagctggaggcagagcgtgagtacaaagtgatcggcctcggccgcacgtagtagcccccctactccccggccaagtcagggcctccctcttcccgcggagtcgcaaccacgggtagctcgtgtaggtaacggcaggtccaggcctccgcatgagcggagggccccccgcgcgaccttgaatggcccgggcgcgcgcggtcgtgtgggagttgtagtcctccgtccccgtccgcgcggactccgtttcccgtggtgccccgggcggcccgcttccggcgcagttagttacgagtcggcgcacgcggcctcggtccggttgactttgcggagccatggagggcggcttcggctccgatttcgggggctccggcagcgggaagctggacccagggctcataatggagcaggt

SEQ ID NO: 426 - DNA, 917 bp, Homo sapiens
tgctggaagtcccagagactaagtgatttgaatttgcaacaaactctgaatttttgtgcatttttgaaaaatgcatttttcaaaactgtcaattcacgaggaattatcagcattgtaatttgtctgggataatgtctttagtttcagaaagttttgtgtttggcatcattaccactctgttgacatataaatttcctcttgagcttaggaggcttctctgagagtcaaacatttactttgagagtgggcagatcttgctttacttggaaggatacacttacaggatagaaacacagaatacttgaacactgaagaatttgaaaatgtcaattctcagaagatcttgaacacttatctccaaatgtgacacagaaacttactgtaataacccctaaaatctgcttgaattacttagcacaagaaaaaaatgaatgcttgagctggctattttgaattgagtcaatttaagattttaaaattcatatgtagcttagaatcagtacatcttactctttggtttatggcaaatcatggtattgatgagacaggaacgaaatgttggatgtacgttaatttcccctacaccttcctcacttcctaaactggtggtgtcttttcttttttttttctcttcctcccccgggtgggaaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaac

SEQ ID NO: 427 - DNA, 1084 bp, Homo sapiens
ccctgagactaaggctgtgttgtaaaggagtaaagaccaaagggtaacaacctgaatgaatgctcattagaaaaggaactggttaaatacattctattgtatccattcaatgtaatacatcattcaaaagaagatgcagctgtatatgttccaaaataagtcaaacctaaattataggagtagtaaagttgtgttgactgaaagaggaattgaggaacttgagatttggaaataaagggagaagggagacttttatagtaaatccttttgtaccgtctgattttttttttaaaccatgtgtatatgttatgtattcagagagggaggaggaagagagacagagaatcatgaataggagatataatcatggataggtagatggatatgcagacaaaaagaaaagtttgagagaacagcaggtcccatattctccggctgcacttttaacttttaaagctatcactgtcttttccattttccctgaccaaccatttagttctctctcggtagcaggagtgttttcctcagctaggtcgaggagacacaaacagacctcgtcacgcacacatctcagcacacaggcatatagtctcaaacacacggttttagatttgatggtgtgtggggggagatggggagcaggctgaggcactcgaagcgggacctcccgcctcccctaccatctcagatctgcactactcccctcggccgtccattctttggcccgcctttcccccacccccgctccagaccctgcacaccaggcgactggactggcgtaaatttccgcccatttgcgtcgccgcctgggggtgctgcttcgtgacgtcagggctgagctagggggcgcccgctcctggctgcccgctcctcccggccctgcggcccccgcctgccctttaaaagagcggggcctgcgccggccgcgccacaccgcggggaccaggaggcacgctggttttccggggccgctccatcgcgccttcctcctgcgcctcgcttctccggtccagccgccatcttcctttccgcacaggggccgccgagcggggccatgcagccaacgctgcttctcagcctcctg

SEQ ID NO: 428 - DNA, 872 bp, Homo sapiens
gagctcagaggctgcctggcctacgggccaggagacctcagcgcaaaaagcgcaggactcgttcccctgctctacagctgagtgcccaggacggatctcactggctgaaaaaaacagaagagaaggcacccaatgcaaaatcaaatgtcagcgaacgaggggtcctttaacaggcggcccacacggcccctcctggcgccgagacccagcccctccgggccaccccggccaggtacgaccagcagggtcacctgcgcgcgtcccccgagacggggcctcctgatgtgaagcgaccccagtggcacctcacacgattcccgagggttgcgggcggcctctcctcagccctgcagctcccacacgcggacaccgcgggcctcggccatgtccactgaccgaccttcctcgccggaactcctcgcgcatcgccggcccctcagcggcgactagcgcgcgaacatcctggaagacgcgttgccggccccacgtgagccgacgccccaaagcgcggctgctggcgccggctacgagatcaaggtcggcgcgtgcgcgcttgcgcgagaccggcattctcagccccgcgccggtttccagggagctgggcgcatgcgccgcgtaaggggcccggccggcggaaggaggtgctactgccggaagcgccggcgcgcttgcgcagtagctgaacgcgggcgtttctttcctccctttttttcgaattggttttgggggtagattcgagttacaaaatggccgcccggagcgtgttcggcgcggttcccccagctgtctctggctgaaccggcgctctcgcctccctgccgaacacagcgtgaggagcccccccagggatatggtgtttgagtctctgggct

SEQ ID NO: 429 - DNA, 900 bp, Homo sapiens
cctgtgcacatatttagcttcagatatgatctgtgtgagaagaccatcttgaaggaagtcaagaaatctaagaatgagtcccgttttcagcatcaagtggatatataatcattagaacagggaataacctcactttccccgttcattaaatggggtaacactcgtggtcatctctcagggttgttttgaagactgaacaagataagtcatgtgaatgtgttttgtaagttgtatagttagaggaattagaagtgtaatcattgttaaaggagatgtttgaaacactgcatatatcatcactgccaatggagataacaggctgagtccgggttatttctcgttaggacgcgtccttgtgctgagtaaatggtaggttaccttatcagactgcgcagtgagtcttgatccgggaagcgcctaactcctgaatttttaccagaaaataaaggactacactaaaaagaaaccagaaagaacgtgggaaggagggaattcgcaggcagaggaggaggaaaagcaaagacgaggcaaagttaggagaatgaaaggcgaattcagaggaatgataggggcgggtagggccgagccggcctggcaggacagggtggtggcgaatgagctgctagcccggcgacctgcccgcggccccggcgggggaggaggaggggcttggcaaagggcaacgccagagccagacttaaaagggagatgatcctagctagttgacgccaccggtgacctccgacgccccgggcaagagaacgccaggagggataacgggaggaaggccggccggggccgccaaggcagtcccaggctcgcgtaggaggcgcgcagaccttgcaccttgcaccttcgcagcgccctgcaccccgccaccatgtgcgagctgtacagtaa

SEQ ID NO: 430 - DNA, 986 bp, Homo sapiens
gaccagaattcatgggatcaaaaatttttttttcttttctttgagacggagttccgctcttgttgcacaggctggagtgcaatggtgtgatccgggctcaccgcaacctctgcctcctgggttcaaatgattctcctacctcagcctcctaagtagttgggattacaggtatgcgccaccaggcccggctaattttgtattcttagtagagatgcggtttttccgtgttggagactggtattgaactcccgacctcaggtgatccgcccgcctcagcctcccaaagtgctgggattacaggcgtgagccacaacgcccggcgggatcactaattatccgtgtttttctcttcgggaggaaaatccttttggtcagatttcccttggcttggtggtggagagggtgagatcttgcagttttcaaacacttcctaagggggttccgtccccaagagagcaagcagcagaaatgccagaggaaccgtgcctatggggacaaagctgaactcctcatggaaggagattactgcagttccggtcttgtgagccaaagctcctgttcaatcgtcctagagcatcccaagcagcaaatgattttaaacatgttaatgtatttaatctcatttagttgttaaaatatgcctaaatttcctctttgggaacgcaagacttgcagagatgactccatggagagcggactctgccggcgggaactggagtcgttggtgacgtcatcccagtctgatctgtgaagggtagggccagcaggcagcaccaaagttcccgtatgcgcgttttcagtcttcatttaggtccgaattcccggcatataagaatactaccgtcgcttgtttttcagatttttgcggctattttcgttggtgtgttggtcatgtctggtcgcggcaaaggcggaaagggactgggtaaaggaggcgctaagcgtcaccgtaaggtcctgcgagataacatccagggcattaccaa

SEQ ID NO: 431 - DNA, 975 bp, Homo sapiens
ggttgcgtaggtcatagaaggaaaagtggtttgtgatctgatagggaatctgaggacagacccagggagagcagaaataagcgcgccgccggggggtcgccagaattggaggcttgtgcgcctctgacaagtatttgcaacataagtatgcatatggataatgtatcaatacacacgtgtaatagatgccaaacaaattcttcaaataattgtcacacatttaaattttcagacattcacaaaatcaaatgtaaaatattaaactgaaagttcacaacttaaattttcaaaaattaaatctaattaaatttccaaagttgaactgttttcaaaattaaattttaaaatattcaaaattccgaggtaaatttccagaaatagttaaaacctcaaaactcaaaatttttaaatgaaatttataaactttaaaaggtgagtcattcctcagctggaatcgcacccggggcccttgaataaaatgctattttgatcgctagaacacatagaaacttctctaaaattgttctgcaaaattccctaaaaagccggcatcaacccgccttttagcgtctcgacaaggcgttctatagggtaggttatatttggggatctgccttttctggttctgcctgtcctgagttggagatctgaccgggaatctgagcctaacccaagtttcccatcccgcttccacgctctgaatcaggcttccgacctgacacaccacttcctccctctcccctcggccttcccctggacccgactgtattgcccaatcatttcctttcatttgtcatcaccaccttggacccgccccctcgtctcaggccgtcgcacgcgttttgcgtcagttggcaaggcactttacggccgtcgtgccgctcgtgtcagtcaacatggaggcagaggaatcggagaaggccgcaacggagcaagagccgctggaagggacagaacagacactagatgcggagg

SEQ ID NO: 432 - DNA, 1064 bp, Homo sapiens
aagaaaaggtgaatggttgggatgcatactggaaggaaacaacggaaatctgaaaaggtgtaagaacctaaacaaatttgtttatcacagaaaataaatcacaaaacaactttgcgttctttggcaagtttctttatgttaaacaagaattgctttttgcatcacatagatcttctaaactctttgttgaagaggtccttggtagtctgtatctaagccagttccttacggaagtggcactgagcggagtagataaagataggaacttttgaagggtcataatctctgtgtgcaaaaaagaagccacagtagtctgaagagctgtgcaggttttagggtgacactgggttgggaaccttggagctaagtgtcccacacctggcaagccatgacatacatattttctgttcaggcagaaactgagctttacaaaagtgaaatgagaaaaaaaaaaaaaccaaaaaccaggcacgtatattgagaaccattcagtccttcttagaattgcctcatacctttctcatgcatctttattaaattcagatgcaaattaattttagaaaagtctaaataggtgtgtgttttatttttctgtttcctaattaaatagtggtataagcctggaaatgctctatatctattttcggaaatctatagctcttgtttaggtaaatatcaggtacttagctaattaaatgtctcttgtttataggaaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttactgagaactcataagacgaagctaaaatccctcttcggatccac

SEQ ID NO: 433 - DNA, 1059 bp, Homo sapiens
aattgcagatcgaaatgggtctagttttattcattcttctactcggggcgataaaggtttattgaatggtgtacatggtgagtgtgaaaaccagatgccagctgcccccagccccagtccacttcagtccagctccccggggctttcccgccccctcctcgtacccagcaccgcgggcctctcaaggttcccagtctttgggctaggggaggggagcaaggctcagttcaagtccaggtttctaagggattcagcaaagtggacaaggacgaggtgaggtgggaggatcagggaagcctcctccccgcgggtcgcccgggtcgtggcgggggatgggctcacgggtattatcagggagcagcctggcccatgtccttacctggactgcgcctgccccacagcgcgtgttaggaatgcagagtattggggctccatggccctaaaggagctgcattggtaggatgcactttaagcagcttcccaagggattcggctgcggggtccacggtctacactgggcaggactgcgtctctgctctcctcccggccagcacagttgaggtgaggggccggaattagtcggggaagctgtgccagacgtcccgaggggacaacgggacgaggggataacagcagccaggacccttcagcagggctgggcgcgctccaggcccggggcagggcggcgggagctggtgcaccgccgtcgccggcccgcagggggagctcgcaggctgcttcccggctcgcccaccctcctccccacgtggaagggggctgggacccaaggaatgcggcccgccccgaggctgacgtacgcgtctgcggccagcccggactctttaaaagccggcggtgcgcggggcatcccagccaagccggagaggaggcgagcagcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgttt

SEQ ID NO: 434 - DNA, 1041 bp, Homo sapiens
agcacaggaaagagacattttggccagataagggttaagggaaggcttcatggatgaagtggcattcgctctgggtcttgaaggtcagcagatggagagggctcctggggaggaaggactctaacggggaaggaacagcctgacgaagaggaactttgggtaccagccagctgacgacagcaagatctggtccggtgcgcgcgggaggaagctgggaagggacgtcgcgcccagatcccgaggtccttgaggaccaggccctctctgcaaggaatcggggaggaaaatctcaaactattaatagaagagcggcaaaaaggaattcgtgcgcacccctctctgttggaaggaccttccctgccagagaccaaggctggcaggacaggtatacttccctcagggggaaacagccgacaaaggtggtcaaggtcgcccgcgcaggctccggagctgcacgtcctggacgaacactcccgtcccgagcacagacgctgggtatttggctgccagcccgggcccgccaggccgggcctggcaccgccaacacctgctcggcgggaacaggaagacctgtgttcgggaactccctccggccacctccccgtatcctcctggccctcgaaggtcgaaaggtggcctctcagggacacccgccgctcgctcggctcctcccctcagccgggagacccaaggaataacagcctctgcgataggagcacgctctaccaatcaaccgtagtcttcgcccacgcctcagccggaggaaattgcattggttgcatcattctcggcagccgataaattgttttcttggattggctaatagcgttccttctcccctgtgccttcgtcgtcagaagctggcgattggttaatcgcgttgccaagctttggacgcggctcgaccattggaggccgcgggcccgcccccgccggctaggtgaaggtgagtgtctcctccagtcgcaacggccagacctgacctgccagctccgggcgtggggtgaaatctcttgattcctagtctctcgatatggcacc

SEQ ID NO: 435 - DNA, 919 bp, Homo sapiens
aaaagaattaggggttctccacgtgcagctgggaaagacgttccaacaatcctcatttgtaccaggccctttggtgggccagtcccttagggcatctctaatgctcctaatgtccatcctagaaattcagggagggaaagaaagtgctggggcgagcatgggtcaggagagaatagggtcaggatttagggccctgaagaagcctcgggcaaactctttggacagacagaccttccaagagggccctcaggctccgcacgtggtctgggcgggaagtgcgggcagagagactaggaagccttcccagcagcgccggcggaccggggcaaggaaagggtcgaatagttaccatgccattctggggccgtccctctgattggcccgagctccctcagcccgagtcgcggcgctccaaggaagggggcggagtctctatgttgcgtcaccacccttcccgacaccccgccggtgcttcccaatctagccattcacaagcccacttcgagaggccctgtgtgacgtcacgacacgctcccgccaaccgcggcggcgaggggcgggactccacggccctctcaccgctcctaccctgtgcctccccgaactccttctgcccctcctcttccctctcgccccttcccccttcagttcggtttcaaaagacgcgttgcccaatgaataacagggtcgacccagagtggcggccgcgtccaccaattcgcggacggcgagggcggagcgtccgcaacgagcctctgacgccgggcggcgtgtgacgcagtcgggccctctgcgcgctgcgcccgaagcggcggtcggtggcaggggtggtagcggcggcggcgacggtttcgtgggggccgcgcgctgctctgtgagcggcgggtggcagcaggggactcctgacacttccccttcc

SEQ ID NO: 436 - DNA, 926 bp, Homo sapiens
taacagaagcaggtgaaacaccaaatttaaagagctttcattaataatttctcagccttatggcttcttaatgctattcaatggaaagttttaattttatctgcaaaatgaagctaaaagaatgtcgcctagctccttccctgtctggaggaacttggattttttttttttttttcattagaagcttgggtaaaactaaaaagaaacctgtattcaagtttctgcaagaagctttaaagaaatgctgggatggtactcaaatagtttacaagttttccacctacaactcattttgcattttcttaaataagataatgactcaaaaaaatttaaaggacctaggtcacagatcttacaaagggttggagtcatggtataaaggtataaagattgtatataaatgttcatattttccaagaaacagagcaaagaccgcctgtgataactcttccttttttctacctgccttccaggatcctttctttccaaaacccctcataaattaatgataatgataatcagaagagagagtgttggccatatcaatctgcacattatattaaattacttttcccaaagtttggaagcatttcctgaaggctgtcaagggtattagtttttttctctctttaaatcacaaagcaaaattccactgtctctccccaaccccttctaaaaaaaaaaagttgtcgagttttgcttttctattcactgcaatcctggccaaagtaaagccctctttctcaatgacgtcaagatctttaccaagattaggctttcacttctctattgcagcaattagccagggaatgtataaaaggcgtcagggagactcactgggctgcagagagaggcactttgcaccacagacagatagcaagaagggaaagacagagagtgagaaaaaagaggagtcagtcgctcct

SEQ ID NO: 437 - DNA, 1020 bp, Homo sapiens
tccttccaggtttaagagttcccatgggccccaggacccgcctgctttatggtgtcggggacttgggttcaagttttcgccttgttactgactagcgtgttacaggcgaacagattacgtaacccccctgcatctcggtctcatttgtgaggcggggggagtatgtgagctggcctcctcagagtttgtgagaagcgcctggcctggcccgcagaaaacaatcaggaagaggctctcttattttcatcgtcaccaagacaccgtgctgagatctgaagaccgcttcaccctaatactctcaccttccagcttcagggagcctcggtgggacccagggccggaaccccagcgccagaggcgccctagtcacgcccgggtctctgtacaaagtgcgccttatacgctgccaccgctcacggctgcgcctgcgcagatttagcagccgtggttaagagtgtcgtcaaggaaaatccccagcttctgggtaaacaagttgccgcgtgagaccgccggcacgtgtaccctacagctccaagacctctcagcctatgagaaagcttggagagcgggactggcatttacgtcaccaatcttggcaggtcgggggttatttccccagccaataagaacctcagaagtgtcgagggcgtggcttccggtcaggcttccaatccccgcgttggggcggcccctctctcacgtgtatctctcccgcccccgttggcctgctgaccaatgagaagacgatggcggccggaggtgccaatggaggctgtgcgggggccggcggctgcacgcggcacggggcatgggtcggcgcccctaagccaataagcgtggggggcgtggcagcccggcccgtgggcgggtttggaggagccagtgtaatgctagaagtcctagaagaaatttggagtgtgcgtgcgcgccgagcggtgagtgctcggggatgggggagagatgcggggcgatcggtgtggacttttccggggtggtgtggtcggttaggaaggtgttaga

SEQ ID NO: 438 - DNA, 1064 bp, Homo sapiens
cagaacctaaagcctacggatgaaaagggaaagggtggtgaaggagggcgcgagtccctgagtcattgccctcggagccccccttgttcattttttcatttgaaataccgtttccttccacccagttggaaattattctgattgtttcctggggaagcccggggtctaaggccccaaatccaaacgaggaatttctgaaagacggggtgggggtgggattcaagaactaccttgctccgaaaaacctgcatttgtgaggtagaaggcaatttttcctttttctgcatggaaacaggaaaatttttttggcccttttcctttaccatctactttcaccctcctgaatgtaaagtctgagcgggaactttagatgtgtcggtaactcacattcttacacccgtccccccctccccccgcccccttttaaccactgctgtttttttctttattgtttatacctttaaaaaaaatatgtttcaaatgaacttactacagtcaaagcagctctgttacatatgagagagggcataaagagcaaagaccctggctccaaaagaaatagacaagatcaagaccaaagcggaaagaaaaaaaaaatctctaaaccaaagcccagagggagagtagcaaagggttaaaatccttttgattgacgttgtagcctccggtgccctgggctcaggcgcgcgccattggccgccagaccttgtgcctggcggccaatgggggggcgcggtccacgagcggtgccgcgtgtctcctcctcccattggctgaaagttactgtgggaaagaaagtttgggaagtttcacacgagccgttcgcgtgcagtcccagatatatatagaggccgccagggcctagggatcacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaa

SEQ ID NO: 439 - DNA, 1133 bp, Homo sapiens
cttaaccttactcgccccagtctgtcccgacgtgacttcctcgaccctctaaagacgtacagaccagacacggcggcggcggcgggagaggggattccctgcgcccccggacctcagggccgctcagattcctggagaggaagccaagtgtccttctgccctcccccggtatcccatccaaggcgatcagtccagaactggctctcggaagcgctcgggcaaagactgcgaagaagaaaagacatctggcggaaacctgtgcgcctggggcggtggaactcggggaggagagggagggatcagacaggagagtggggactaccccctctgctcccaaattggggcagcttcctgggtttccgattttctcatttccgtgggtaaaaaaccctgcccccaccgggcttacgcaatttttttaaggggagaggagggaaaaatttgtggggggtacgaaaaggcggaaagaaacagtcatttcgtcacatgggcttggttttcagtcttataaaaaggaaggttctctcggttagcgaccaattgtcatacgacttgcagtgagcgtcaggagcacgtccaggaactcctcagcagcgcctccttcagctccacagccagacgccctcagacagcaaagcctacccccgcgccgcgccctgcccgccgctgcgatgctcgcccgcgccctgctgctgtgcgcggtcctggcgctcagccatacaggtgagtacctggcgccgcgcaccggggactccggttccacgcacccgggcagagtttccgctctgacctcctgggtctatcccagtactccgacttctctccgaatagagaagctacgtgacttgggaaagagcttggaccgctagagttcgaaagaactccgtggatattccagctttcccacaagcactgatcattatgagccagttacttaaccgatctgagacactctcacctcctaaatagggatagatgatactaatttgcaggttgtcattatgataagacaggatctgatcaatatatgtgaattgtttatatttggaacctttttattgagtggaagaagttgttttaaatattctagtcagttctttcctgctcccaggaaagcccggattatgttttaa

SEQ ID NO: 440 - DNA, 1009 bp, Homo sapiens
gaggtccaacaattgccagtaagtgtttaatttttttgtacctgtaacctccattcccgaacaacctttaccgtcttatctactcctctctggcaaatgcctaccctaagaatccgccacagcatcactatcacgccgaattaactgttgcctcctcttaagttcccggggacaatacttctgtgaattccagaccagggccgctatggatcgcgactcccagcgggcagagacctactccctcctacaaccactacctgctacatgacacctttggaaaaccttggctgactaaatttaaaaaccacatcacccaaggcacacatctcctacatcatacacgtcaatctccacagcctacgtaggaaaatcctcaagggaaccccggcacgaattcaaggccagacccacaagccaggtacacacccacacgcccacgcccgcgcgctgccggagccccggggcctgctggccagcacacctccacacccgcggcgcggcctccgggcaacttacaggaagttctccatcgagatgcggacgatagagccttccacgaaaggcccggacgactgcaacagcggcagctgcggggccgaattcttcctcttgctcgggacctccgacgaagggtctctcgggagagctctcttggaaggctgggggcttggagttgacgtcttcttgctcggagtcgccatcctggcttcctcagcgtcccacagcgacttccgttcccaccgtccggcagcccaggcgcccaagcgcccatccacccaggcgccccgctcccgcgcgaactgccgcgaactgttaccgcgcgctcgctcccgcgatctcgcgccgcgcctgcgcagttcaggtccggcgacgtcagcaggcccgccccgcccctcccgcgctccgccgcgctgtgcgaggcccagactgagggcgaaacagcaggcaggactgggtggagacgttcggggacgtggcaactggagtttcttctccgtatatttcggca

SEQ ID NO: 441 - DNA, 988 bp, Homo sapiens
agtcaccatctcaaggacacacaaagaaaatcagtcacacttgaaatcccaccgtcacacgctcaccctctcacagtatctcacaacccacgtaggaagtctcaaacggcaaccatctctgtcagtcacacactccatggttagtgttacactcaacctatcagaatcacacactccaacccgtcagatacacacacccaagaggtgtcagacacagaaccgcctatcagacacataaacgggtccgccccacaccctcccaggccactggtcctacattttatctgttatctgtccgcccgctccacacttcgtccgccccacacccggtcaatcagtccatccgacacacactccgtcagtccgacacattctccgtcggtccgtccggcactcagtgtgtcattccgcaccacattcggtccgtgagtctgtccacaccgggtccgtcagtccgtgcacacacggtccgtccacgcctggtccgtcagtccgtcacatcctctgcgcgtgtgtccggcactcgcagtccgtctactcacgtcccctagtcagcctctcactctctacccgctgggcggtaccccgcatctcgctctggccgccccagaggttcgcggcttctggacctgctgtgcccctctccagcctggatcaggacggagaacacccccgaaacccacctcaccagcacagccggcggacccttccggaggtggccgcagagactagccaacttgcgcgcccgccgacccggaccacagctcccagcacacctcaagggcccacgcccgccaggactacaattcccggcgtcctccggaagctcaagtgtacccaggcgcggtgcctgctgggaattgtagttgacgttggtcagcacggaggccacaggatcccagcccggcctttgtgggactgaggtggcgctgagtgggagagcagcaggcgatgcgcgaaaggcgggacttggaggtgagggaaatgt

SEQ ID NO: 442 - DNA, 1029 bp, Homo sapiens
acctgaactctgtgagaacctcggaagagagatagcataggaagccgcctcagcacggtgtttaatacagacgccgccatcttgacgtacgcccaggacaggaattgacggaaaggcaactgcgcatgcttcaggaaactgagtagggcagggccaaggacaagcccgcagtgcggaaggcggccccacgtttgcgtcaggacggaagcgtgaaagggaaggcatgggggagaagctaatttcaactgcgtcacaatcgaattagaccccaaaattgcggttttttttggccagtcactacgactcttagatcgcattgttaaagtttgccttttaagcaattttgaaggcgatttttagcggtatcctctcagtgcgcatgcgctcttaggtttctaccaatcctgggtgagaaatgttctccagggcggaagtggcggaagcagaggaaagggaggtgctaggctcctggtcacgcgcacgcgacagggaggcaggaaggaggcggaagagagtgccagggaaaggggcggagcaaaggtgaagtgagagtagccaatcagttggcgagttgtcatttgggttgaccaatgagttcacgcctcgcgtataatgtctcgcgacaagggcgtttcactagcacgtttgggcgcgttgggcggcgtccgggtataaaagactccacccgagcgggcggccgccattctggggttcgtttagaggtaagtttgcctactttgtcgtctagtgggtaaaattttgcggagagcgttggatctgggaagcgggatagggatggatgggttcatttgagagccacggcttaaagcggttgcgatcaggatgggacacaggtttgtttggggacaacaaagatggcatttgtgagtgttttgaagcaacccgtactgattacatctttctcccttgtgttccttttatcccaggtttgaattttctcggagaaagacaggccggccacgaggaaaacagaaacaagccgcagcaacatctaagcccttgaaagga

SEQ ID NO: 443 - DNA, 918 bp, Homo sapiens
cctcaggctcatgttctgaatctcctcccccacaaatgaaacacaacggatacgaattacagagaattttacggaagacactggagcttaagtctgcagattagttttttgtctacaagcggaggcgactggaaaatcaagccaaataagcgttggataactctaaacagccaaagaagcttcaatgggatagggtccaggttcaccaaaggaggcaacaccagcaactgacgaaaccatagcgacggctgaccgaccatgactcgaggtacaagacgtcaaacctaaggctactaatcaacgtgcgtaagaagcggccccaaccgacccgggcgatgccaaccgcgcaaccactggtcgccgcgccaccccaggcccaggaatagcccagtccgcaacagggagacctcaaccagggagaggaggagcggggcaaaggggctgggtgtcccccaagccgctgcgcgggacgtggaagggacgaaagaggtgaggaagagtagtaaatcaattcaatacactcacacttctgctgtgctcccaggactacgagaagcgggtagggggcgactcccggcctctttcacttcgtaaaggccttcaactgggtctctcggtcaacccctcagctaccgccatcttgaaacctcgcgcccctccgcactcctcacgtcatttcccattcctctgtcccgccttctcttagcgccgcttgaccctggaaccatagagaatacccaagaattccaggaccagagtctcttccggttccatacaatactcaattggttggttgtcggctaagagcccgcctcattgcgctcatctagtacaataggaattagaagaagatagctgctaactgagtggctgacggtcctgtctctcgagttggaggcatcttgacttagttgctgg

SEQ ID NO: 444 - DNA, 1046 bp, Homo sapiens
ggggtaattttccacatatggctaatcctagcctcatcagattaagtttccctgtcttgtcatttccgaggatgtatcctattagaagtctagccctttattcctacaaattgaatttccactactgtaggctaacatctgaatggactcatcttactattccatgcatagtaccaggcacgttgcgtgcttttactacattttgtataatttttacgtctgtgtttgatgtcctgaaaaataccgtccacaattacttcacagctagccccagcacttggcgcccagcgggttttcctagtccctccctgccaaatcacgttgggactgagacaagaggcactgcgggtctcttacctatagttacgaagcaatggactcccttattacttcgtttcccaaatagggggtgggacacacaaccgagggagtatgaggaaaacaacttgcgggtcttcgagccacttgcgtctttctgtgggcgagcctttccaggccaattacattttctttactcatattgcataaatagcagaactacatttaccacaaaggcccgacattcatggtcatggatccttgcgcatgttttctaagagcaaactgtacaaacacataaactctgaaacactgacgcacaagcgaaaacacacgcacatgtttgggtcttctcccgctgcgcaagttctttgaaactgagcggagaaaaatcgtcttcacatggtgtctcacactttcgacacaatcttatcgggaaacgtaacacgtaaacaaaattttttaaaatgcattatcaaaaacgatgacaatccctttcgtcttatgttcctttttgtctttaagctttggggggatttatgttgcgtttccaaactgcttctgcctgtcggcgcctgtgtggaaactgcgacgagtctgggagcggctgccggagaggcggggcagaggtgtgacgtcatcgccgcggggcggaggcgacagtgtctagcgggagctccgcgtgtagctacgccggccgcctggctttgagacaacgtgattctccg

SEQ ID NO: 445 - DNA, 1222 bp, Homo sapiens
gaagacacggagggaagaaaaataactgtaaggctgggtggctccttatggggaaaactggaagcatgaggagtggatggtgactggtcagaggaacagtgatgccaagggagggacaaagacacaaggggtaatgatgacgtaagagttgcattagcgcgatttaagaagagcgatggggacagtagccatgcgaaggtgacttgggggtatgatgagggtttaaagagaaatgaggattttataaaggagaaatggcaacaaaagcaggatgcaggtaacatatggcgatgacgaatttaaagggagcgattacgacctatggtggcaaagagggcttacagggaacgaaagcgagttaagggcgttgatgacaacaagaggagttgtgaggatttaaagagggtgatggcgacagaaggagttgtgaggatttaagtgggatgagacagaaggagaggaatggtgacataaagagaccgaggacgacataaattatagcgtggaagacaacgctataattatatatattatattccatatattatattccatataatatatattatattccatgcattatagcgtggaagacaacacgaggagggtagccgaggcgccgcgcccccagatcgcacagtacctgcactccacgtctcccactccgagacccagccccacacgcaccttccaggctgtatccccgcctgacggcccctcctagccgcgcgcaggcgcactacggctagactgcaggccggcgggggccaggcatgcgcctttctcattggccgcgccgcttgctagcttcgggcggaggggagcgccgggccgacggtgggcggtcacgtgacggttacgactgcactctcgctggtgtcggtgggcggtcacgtgatggttatggccgcactctcgctggtggcggcctgttggggtagagcggccgcggacgagtcagttcagcttccggcggtgagaggatgcttccggggcgggcagcccgggccgggggaggagtgtctgacagttggcgccgccgggagggagggcgggcggcgcgagtgggcgcgggcccggtgggccaggtgaggcgcgggccgggggtggtgggactgggccggttgcggtagggacgggtggcgtccgggtgtctggactcagttcgggctccgttgtacggcttcggacttacgatttgtttctttgagcctcagtttcc

SEQ ID NO: 446 - DNA, 1009 bp, Homo sapiens
cacatccgagaaaaaggtacgaccaatgcctagcagtttctagggaacacagctcaggaaatactgtagttctttaatgtataaatggcctccaaactcatgcaaggggagttatcccaggaatgaatactacacctatgccctccccttcacgtcttcccaggaaacttcatttatctatcttatctatctatctatctatctatctattatctatcatttatctatcttctatatatcatctatgtaatctatctatatgcgtgtgtgtgtgtgtataagacctcacgaagagattccatcacagacatcacagagtcggaaaaatgacgctttacccaaaacaaactcctacaggctcacggaaaaaaacgaacaaacaaacaaacaaaaaaaaacaaaaaaacacttctaccccgttcacacttatagttggtcacaacagtgctgtcacacgatcacgtcaccgtagaccagggtcacacgatagaccccgcccctactcaccgtcctgagtccgatcaaacagcacccacggcacacactagggtctccgtctctcacacacacacaccacaatgacgtcgtaaacaatagcactaaccaccatcgtccgcagctcccgcgtacagaggcctcaggctcccggctccacgtggaccgacctcgcccggcagcgcggggccacctcaccgcgagctcctcccgcagcccggcccgggtcacctcgactcgccaggcttaactcaataaccacaacaccggaaaaggaagcaaaggtcgaagttcatccgcggccctgaggcctgtgggaaacgtagtccaacaacgaaagagccctgaagctcaagcggagcccgctggccgcaggggccgcaccacgccccagaccctggagtttccgggtgcgcagacccttgccatcagcagaggctgccgctgcgcgtcccctaggcgcggaagaggcggctggtggtccctgacggcaaggtgaagtcgaggcagtaat

SEQ ID NO: 447 - DNA, 908 bp, Homo sapiens
acgcactctgcacaccatatctagcaagtgttagttcccttccgtaactggattttttactctttgaggacgatggcagagtcctgcaaaagaagatgataattttagaatataaatcctcacgttcgctatcttctggcagccacagctcagctccaatctgcgaaatacggcactctctttattgactactgcttctctcggcacccgtacttccgcaaggacgccgtcataggccgggcgcgccccaaacctccccacgccgggcccctatgcgcccttactgtctgaaaacgggaactacaagtgctgccgaagacttttgcgcgtgcgcatagataactaggccaaggaactgatgggtgtgcaggacgggggggcggggtaagaaggacgatagatgatagagtggaccgcaagaaaaaggacggagagttaattagacttcgcccaagctgtgcgaccctataggccgcttgtaacttactccgttcgactcccaaaatacagggtcaagtactgcggccttcggacatttccgtctccggatcctgatagtctcggttactttcgcgtcataggatgagcgacaacgttttccggtcccaattgagaaagacgggcccggaggcagtgcgcgctccacctacgtcacaggcgaggtggttccaggagggctgggcatcggagagcgcggccggctgagagactcgaagccaaggaagaatttgattggcgatttgaaagcggcggtttttggcttaggcggaggtgggcgggccaagttttgggtcctcatctggtgaggtcccgcgttaatgacgtcacgttgtttcgcgggagaaattcgaaagtggattttgtgcaatttgacaggtgaggtgaagtgtttctcgggatttcctagg

SEQ ID NO: 448 - DNA, 995 bp, Homo sapiens
aaagccctctttggtcctcatacctactcgaaattgcaaagcaaggcctgggaaaaacggtgaagaggcaccacttactacaagcagtccgagtagctgtgactgcgaccaccccaatcctggttccaaacagcatccttcccggttctcttcttaaggagcagagtctttcgtcccttcgccccaaatcgctcaagtcattcctaggaaatcccgagaaacacttcacctcacctgtcaaattgcacaaaatccactttcgaatttctcccgcgaaacaacgtgacgtcattaacgcgggacctcaccagatgaggacccaaaacttggcccgcccacctccgcctaagccaaaaaccgccgctttcaaatcgccaatcaaattcttccttggcttcgagtctctcagccggccgcgctctccgatgcccagccctcctggaaccacctcgcctgtgacgtaggtggagcgcgcactgcctccgggcccgtctttctcaattgggaccggaaaacgttgtcgctcatcctatgacgcgaaagtaaccgagactatcaggatccggagacggaaatgtccgaaggccgcagtacttgaccctgtattttgggagtcgaacggagtaagttacaagcggcctatagggtcgcacagcttgggcgaagtctaattaactctccgtcctttttcttgcggtccactctatcatctatcgtccttcttaccccgcccccccgtcctgcacacccatcagttccttggcctagttatctatgcgcacgcgcaaaagtcttcggcagcacttgtagttcccgttttcagacagtaagggcgcataggggcccggcgtggggaggtttggggcgcgcccggcctatgacggcgtccttgcggaagtacgggtgccgagagaagcagtagtcaataaagagagtgccgtatttcgcagattggagctgagctgtggctgccagaagatagcgaacgtgaggat

SEQ ID NO: 449 - DNA, 1062 bp, Homo sapiens
gtaccttgctcccattacttcccgttttctcgatctgctgctcgtctcaggctcgtagttcgccttcaacatgccggaaccagcgaagtccgctcccgcgcccaagaagggctcgaagaaagccgtgactaaggcgcagaagaaggacggcaagaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcgggtgaggcttcccgcctggcgcattacaacaagcgctcgaccatcacctccagggagatccagacggccgtgcgcctgctgctgcccggggagttggccaagcacgccgtgtccgagggcaccaaggccgtcaccaagtacaccagcgctaagtaaacttgccaagtaagcgtcttaaagcccaaccccaaaggctcttttaagagccacttaaattatcgatattagagctgtaaacacgtgttcctaatccaggcttaaattcgggcgatctttttaaagggattatcatgatcttatcacactgagtaatgcatgcagtgcttgtaatcgagtctggctaaggagaagccacatacactttgttagtactgagtgaggaatatggcgcctaaaaaattagggatgtgcaggaaacttgtgttaacagaaagtgcttcctggctcttggcgcgaaaatggatacttccgttgtgtcgagtgctgtgacttcctgttagaacttgttgaaagcctattgtgtcacgtgtactttccaccatgtaatggcgttctaacgtgagtttatatattagtaaatttggttcccgatggcgttccagtacgtatggctttcgctcgagcagttaccttatttaacctcttctaggctgtacccagctctgccttgctttgcttccccctcaccccctgattccatctctgcagcccacgggacatcgggaagatgccagaccaccaggcaggatagtctgcaagggtaaggg

SEQ ID NO: 450 - DNA, 1011 bp, Homo sapiens
aacccgatgaaatcatcaagagattaagcgaaaagaaagagaagtccaaggagccagtgctgggggtactgatacatttagaggtcaggaaaaagaggagaggctagcaaaagaaacagagaaggtggggcagggatggaggagaaaaacaagcgtgtgcactgccaaaagccaagtgaagaaagttttgcggaggagagggtgataaactgtatcaaaaattgctgatagagcaggtaagaggaggacttgggagagactgagtttggctggagggagttcaacagagtgggaggagagagctggacaaagaatatatacactcttccaaggagttacggtattcagaaagcgaagggatggggtgggagctggagccaccacagggttctcaggaagggggaaattacatgtttatatgctgatgggaacgatcccttcgagaagaagttaaggctcaaaaaggtcaggttatcccggcaccagtctggtccaaactcttcttcccacccctaaactactgaagtgatacatttaagtcttcccagccctcctgccttacacgaaatccgattagggcagtttgcatttttactttaatggggacatgtgatatttagcaccttcggtcaagacgcccctcaaataggttttcgggctctgcgtcccagcacggcctcccgcgcgctttcgaaacgtcacccttgtcagctgtccagttttcctccaatcccgcctcgggggcggggctggcgcaccgtctctacagcaacgccttagccagagggtgctcaggttttcgggaccgcgcgtggcgctctcagatgacgtcacacacccgcggcgcttgcgtgacgtaagccctgctcagtaagaaggctccgcaggtcggcaggtaggaagagcactacctcgcacactgcgcatgcgccacctcgggtggcctcaaggttgctgtcgggagttgggtttgaggtcggctccctctggctgctgtctctttaacctgaa

SEQ ID NO: 451 - DNA, 985 bp, Homo sapiens
ctcccagtgtgaatcataggaccatcatgaggcccataaacgctgacctgcccaactccacttctggcggttgatgtgaccctggccgggtaactgccctttctggggcacaagttccccttctcccgagactggctgcctaatgcactgggatcctactttgtgtttgtgctctgcggggagggaaggtaaggtaaggtgcgggcaggattgtgtatatgtttgcctttttattaaatccaacaaacaaaagcaaaagatggaaacgacattctgcctctatcacttcagtctcagtaacaatttatttctcttcccaaacttagcaccgctacccagacttaggcccgaacgccacgcccactctcaacccgccaactcctctctcggtcgaatctcccggtcccacccccaaaaactgacgtcacccatctgatcctcccgggtctaccccaaatcctcccagcagttgcagcacaactgctctcccggctgctttgagaatcccgccctcctctctctccctctgcccactcctcactagcgcagcgtgtggtccgccatggggttggagtgagcacgttgccggtagtagcgcttctggggcggtggggcctctgctccggccacgttccgagtctcggctgccatgatcccagtccggggtttctctaccaaatccacgtggaggcgcaggccagaggcgcaagttaatgacgcagccatgcgcgttggtggcagttcccgccccttaaagacccaagagcaaattcagctgggctgggctgggctgggctgggctaggtggggagggctgtaaggagcgagtgctggagggaacctccgcaccgttagcctccaactgggagggcgaggccaggcccagggacccaacgttttctcttagcttgcttctgcctggtctgggttaccatcctggttgcaggcacctgtgcaccccacaggtgagaggggtctagagacc

SEQ ID NO: 452 - DNA, 915 bp, Homo sapiens
ctcttgcgcttctacctcaactcccacttcgcagagagggctaaaagcgacgtcgtaaacttattacgtaataaggcagcgcccagaggcggaagaggccggtttttgctccggccacgtgaggagggtgggcggggcgttaaagttcatatcccagtgtcctttgaatcgacttccttttttcttttttccggcgttcaagatgtcgaagcgaggtgaggttttgtttctggaggatcctccaccatctgtcgtgcagtggctggcggattcgtcaggagcggtggccctaggcagctggggcgctttgctctccttcaggccggagagagagagccaggccaccgcgagagcactgccagggccctcgaaagtggcagtggggtgctggagagttgagatggcaggatcccgacgtgaatgtagtctggataccgcgagatcgctccgcgaatagggctatcgtaatggggttgaagttagactggattaggccctggtttgcgcgacctctgcggttttatgccttgcaggagtaattgcgttttgcgaaagttagagcaagggttgagtcgtctaggtttcttaatttcgatgtcagagtgttaatagtaagaaataggctactttccgtgagaatcgggtggcacatggggacggcataagtaaaatccgagcgagctaatctatagcgtacagtctatcaaagcatgtgcggtgaattacagcttgagtatgagggggaactccgaaccatgtctagattgtgatctctttatcctgtttcccttccctttatatccacaggacgtggtgggtcctctggtgcgaaattccggatttccttgggtcttccggtaggagctgtaatcaattgtgctgacaacacaggtgaggtctttgcacgttgctata

SEQ ID NO: 453 - DNA, 943 bp, Homo sapiens
taaaactttggattccctgagcaatcttttgatgactaactccagtgcggagtgtcaggagagcgggcaatccgtcttcagtggttttggtcagcaggccacaaacagggttgactattcccagacgggtcgtgagtggtacaagatgagtgatccctccagggtgtgactgtagggatgagctcgccctcagtcccagacgtcgcgactgttggcagtggatcaattcacaacagcctggcgtagcttcaatttcggctccggaatcgccctttgctgtgtcatagacctgaggctggactggaccgctaggcgcaggactgcagggccggccgggtgggcggggcacacccagtgcgcatgcgcagcaccccggcccggaaacagcgcggggtccgctatggcggcggcagccgagggcgtactggcgacccggagtgatgagcccgcccgaggtacccggaatggatggggaggaagcgtccggtggggggcctggggctccgtctcgggtgggcgaggttgagtgtgtggtggctcacctggcaggaacgggctggtgagaggagtgcacttgtcgctgcgcgcgagtgtttgtcctgtcagggtgactgggatggtgccaggatgagcgggggtgccgggtatgggcgaggggcggtgcgagggaggcgagttgatgtgtcagatgggcagggacgcagtgaaggacttgaaattatggcagatggagaatggagccgacttgatggaatgaaggcaagtggagggatgtcggaacaggctgctttggctggattagcaccgggtgtaggcgggacacttagtcattctcccttggcccagacgatgccgccgtggagacagctgaggaagcaaaggagcctgctgaagctgacatcactgagctctgccgggacatgttctccaaaatggccactta

SEQ ID NO: 454 - DNA, 1090 bp, Homo sapiens
cgtgacctgaggttatgtttggtatgaaaaggtcacattttatattcagttttctgaagttttggttgcataaccaacctgtggaaggcatgaacacccatgtgcgccctaaccaaaggtttttctgaatcatccttcacatgagaattcctaatgggaccaagtacagtactgtggtccaacataaacacacaagtcaggctgagagaatctcagaaggttgtggaagggtctatctactttgggagcattttgcagaggaagaaactgaggtcctggcaggttgcattctcctgatggcaaaatgcagctcttcctatatgtataccctgaatctccgcccccttcccctcagatgccccctgtcagttcccccagctgctaaatatagctgtctgtggctggctgcgtatgcaaccgcacaccccattctatctgccctatctcggttacagtgtagtcctccccagggtcatcctatgtacacactacgtatttctagccaacgaggagggggaatcaaacagaaagagagacaaacagagatatatcggagtctggcacggggcacataaggcagcacattagagaaagccggcccctggatccgtctttcgcgtttattttaagcccagtcttccctgggccacctttagcagatcctcgtgcgcccccgccccctggccgtgaaactcagcctctatccagcagcgacgacaagtaaagtaaagttcagggaagctgctctttgggatcgctccaaatcgagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctg

SEQ ID NO: 455 - DNA, 1186 bp, Homo sapiens
ggcacgtgttcatcactgctattatttctggctactcggtgccaggacaggggcctcagctgagggccccccagagcctggcaggcccagtgaaggagtgagatggggaggccacgactcctccccagtcagcagctgtcctgtggccatgggggcctggtgaggccagatcttcaggttgttctagaaaagtgagtattctagaattatgtttcaagcctcttggtttgcaaatactagtaactatttttaaaatgttttggtatttggcctggcacagtgtttgacccctgtaatcccagcactttgggaggccaaggtgggaggatcacttaaacccaggagttggagaccagcctgggcaacatagcaagattctctctctaccaaaaaaatgaaaaaattagctgggtgtggtggtgcacgcctgtagtcccagctactcgggaggctgtggtgggaggatcacttgagcccaggaggatgagcctgcagcaagctgtgatgccaccactgcactccagcctgggtgacagagtgagatcctgtctcagaaataaaaagtaaataaagttttggatgctttgagcatctggcagaaatcttcgctatgccccgctgatgtcctgggcccgatgtgggcgcctggccatggctcggtcactcctgacggtttttcagggcctcagacacctcttcttcttcttcttcttctttttttgagactgattttcgctcttgttgcccaggctggagtgcaatggtgtaatctcggctcaccacaacctccgcctcccggattcaagtgattctcctgcctcagcctcccgagtagctgggaccacaggcatgcaccaccatacccggctaactttgtatttttagtagagatggggtttctccatgttggtcaggctggtctcgaactctcgacttcaggcagacacctgttctttgccatgcctctgtctgaagagtatatggaaaggggttgcacaagcaatggttgctgttcctgttgctgccactgcggtgagggctgtggctggacgtccctcctggcactttgcctctgtcccctccatccgccgccagcatttttcctcccctccccttcctccagctcgtcccaagcctgcctgtccccagcgtggaggcgggacagtggaagactgggtgagtgaag

SEQ ID NO: 456 - DNA, 3547 bp, Homo sapiens
ctgtgtgtgtatgcctcaggttcaggtgcacctgcctttgtggggagagcacagcttccctgcataactgctggagggtgggtcgtcgagtgctgctgtgtgtgtgggcctcaggttcaggtgcacctgcctttgtggggagagcacagcttccctgcataactgctggagggtgggtcgtggagtgctgctctgtgtgtatgcctcgggttcaggtgcacctgcctttgtgggaagagcacagcttctctgcataactgctggagggtgggtcgtccagtgctgctgtgtgtgtatgcctcaggttcaggtgcacctgcctttgtgggaagagcacagcttccctgcataactgctggagggcgggtcatcgagtgctgctgtgtgtgtatgcctcgggttcaggtgcacctgcctttgtgggaagagcacagcttccctgcataactgctggagggcggatcattgagtgctgctctgtgtgtgtgtgtgtgtgtgtgtgtgtgtgtgtgtgtgccttgggttcaggtgcacctgcctttgtgggaatagcacagcttccctgcataactgctggagggcgggtcgtggagtgctgctgtgtgtgtgtgtgtgtgtgtatgcctcgggttcaggtgcacctgcctttgtggtaagagcacagcttccctgcataactgctggagggcgggtcatcgagtgctgctgtgtgtgtgggcctcaggttcaggtgcacctgcctttgtgggaagggcacagcttccctgcataactgctggagggtgggtcgtggagtgctgctctgtgtgtatgcctcaggttcaggtgcacctgcctttgtggggagagcacagcttccctgcataactgctggagggcgggtcatggagtgctgctgctgtgtgtgtgtgtgtgtgtgtgtatgcctcgggttcaggtgcacctgccttagtggggagagcacagcttccctgcataactgctggagggcgggtcatcgagtgctgctctgtgtgtatgccatgggttcaggtgcacctgcctttgtgggaagagcacagcttccccgcataactgctggagggtgggtcatcgagtgctgctgtgtgtgtgggccacgggttcaggtgcacctgcctttgtggggagagcacagcttccctgcataactgctggagggtgggtcatcgagtgctgtgtgtgtgggccacaggttcaggtgcacctgcctttgtggggagagcacagcttccctgcataactgctggagggcggatcattgagtgctgctctgtgtgtatgcctcaggttcaggtgcacctgcctttgtgggaagagcacagcttccctgcataactgctggagggcgggatcttcccaaggggaagttgggaggtgctcaggcggagcaaatggatttaacttctgggctgggagaatgtggtacccccgtggaagtctccctgaggaaggaaaggaaggagctggagggagggtgtgtgtgtcttaggaggggacgcacttcaggtgagagcgggcatggcactaggaggagccccatgagcccagagtggtggcacgtagaggcctaagggaccatgccagcagaccccaccgcccgtgctccaccaggagcctgacattgttctctgagatcagggggctgtctctgtgtactgcccaggactgtggcatttttgtgcataaaaaaaaaaaaaaactgtgtgtctaacacagacggggtatgaggagagccactggtctctcctgaccttaaaaatatttttttagttcatttttagtgagtatggaaattactgaaggtacaaatcactctgaagataggttcttgtgtgcgaaggtcatcagtgaatcttcattctcagagttgataaatggttgtgagcgctcaagggtatcagattcaacgatgagtctgaggatagtacagctttcctattcagtttcaaggaaaatcatataaagcccagaccgtaatttgtcaggaatgtttgaagtgtggtgtgatggatgtcttcaccgtgctttaggatgattactgagggagaacggaaggaaggggtctggtacttgcacctttcagtagaattagtgtgaatgccacagcgaccaagctatgttcaggtgtctgcaggcagtggtggccttgatgatggattttctgaaatgggaattcgtgaagtcctctaacaaaactaagtgcgaacttctcaacttagctggtgactgcatccttgaaaaattctgtgtgtaaaatgatacagaaccatttcttggttatctgttaaataagagtgcatgtccagccgcgatgactgtggacggccttggaggtctgggaggccacgaaggactcccacacacagcagggtgtgaacccaccaggcagtgctttggccccctcccaggagtcatggcagccgacacgtcacctggagtgtctagaaaaccactaccttagagcccccactgcttttcctggtgcctccaggtatagatcacaaactcagtgtcccagaaagattttccttttactttaactcctgttgttgtttgttttcaggcacgtggactccctttaatccagtgactgtcaggtcgatcatatgtaagtatcggcagacggaccaacctgggctgctttgtatccgacccgcttgggtacccgcttgtgtttcctttgtctgtgggtccgtatcactttgctcccttctggaattccacttagatgagcgtcggccctttcatccctctccctccgtctctgtaccttttcacatctctccgtgtatgtttgctctattcttgattctgtttatttttaatgtacggtgtaacctgtcctttcagtttctaattctaaagatgacatatatttaaaatttctaaattattagttactttcacatcttatctgggtgtttttgatagacattgcttatttatttttgtgattccattctttattcaaatatttcatatgatagtcttcagttttaagaacatgcttttttgaaaagcgctagatatttgtgacatggagctccttgactgtgtttgaagtccttgggagggtggtctacagccagatatttttcctgctcaagcccacacagagtgaccaacttccttgatgcttctgtaatttttgtttgttttgtgggttcatgtgtagccttaatgtgagggtctgcatcatttctttgggtccagggtctccccagctgtataggcagctgggtttttgtttgtttcttttaagagacagggtgtccctgtgctgcccaggcctggtctggaattcctgggctcacgcaatcctcctgcctcagcctcccaaaaagtggggattacaggtgtgcacccccatgcccagacggtagccggggtgtgagctgaggctccaggcgcaggcaggtgttcaggagagtcgtgctgtgtctccatcccccgtagccaggtgggagctgcagctccaggggcaggcaggcctgggaggcaggtgttcaggagagtcatgtttcca

SEQ ID NO: 457 - DNA, 3343 bp, Homo sapiens
ccactctgccactgtcaacatacagtccctccagagaagtacccctcatgttacaaatggggcacgttcaccagactcagcttcaggacaagaccccaggtcattcccaactgaggctccgaggtgcaggagctccgtcctgtctgtaaaactccctcagttttcggctctgggtttggtgggggttgttcctcccacctccaacctagaaagagaagccagaggaagggaggtcacatggtctgccccccaacctctcagcagagatgcaaagctacctgtccaggatggcggactccagatgggccccgccctgtggtgcagaagtgagatttgctgctcctcctgcgtctgcccctctcctgccctcctctccctcccctatctggctgtcatggtagaagccactgctggccaggccactgaagtactaagtggcccaagtgttgaggaaggatggggactgggtcctgagggcccatccgacctccagttgagagcccctcccctgacctccagctgcccggccaccccagccggtccctgggaactgaggtggcagctgagctccccattatctttccccacagctccccacctgtggagggagaggttgagatattggagtccacgggtggtgcccccactcagtgattccctttgcctgctgagcccctggagctggggtttcttcctcccttgccttggctggccacctggcttctgggaccgccacctggggcacccttctgctttaaggcccaatatgggaggggtcgtccctaccagcccctcccttgtgcccattccactcccgcctggctgccgtctccagctggtcccggctgcctgcccggtcacccgatccgccctctaaactttacggcacggcgggcggtgcgtggggcggtggctggcctggtgggggcgggggctgcttcttaaaggagccgtcagagggtccccagcggccccagggtgggaaggggccagagtggagagatgctgctgcggaagtcctcggtggagtgtgagaaggcagccagtgttggcctggaagacctctagaacctgagaagaggcagcggcaagtgtcagcggagggaaggagggaggtgggggtcctggcctgggatggggccaggagctgggcaggagtgtgggtggaggggcctggaacctgcctcagcagctgctccacttgcttaatcccacctggaaccttgtcccactccctgggctcctgtgtccagcacctgcccagctgacccctgggaaggagggtgggcatagcagccaggtctttgccccagctgagggccagggggaggtgtctggctcctagagtgaaggggctcaaagatggggaagaactcaaggggtgagagaagtgaagggagaggctcagagaggctgtggaggcgttgagagggaaggccagctcagcgaggccaggaggctggggtgcaaatgaagggctgcctcaccttgcccctctttgattcctcaggggtgtggagagagagccctcaagctcaaatgcagaggctgcttcagctgggttgggagcagtccccaagtcagaggctgaggcttctgcccaggtcttgggtctcctgggtagcacttctccctctgaggaatggagtgattgatgctgcagttggatttgctcacttgcatgcccagagacatgtctattcttatgggtgcacacgtttgcacatgcacaaatgtgcaacacatctgtgtgcaaaatatgcacatatcacacatatgtactgcatggattgcacagtgccacatgtgtgtgcacaccaacccatatccacacatgtgcaatatgacacactatatatttgcacatagatgtgcacacacatgcacatacacactacacacatgcgcacatcacaaggggacactcggaaacacattcacaggcacccacacccttggctccagcctcaaaagtgtctctgtgtttttctgcgggactgtggggacactgccacctccagaggcctgaccccctcctgtcactctcactcttttgactggcttgttttgctcattgcacttggcaccctctgcatccatctgattccttgttggcactctgtcccctttcacatggggaccttgtctatgtctcccagtatccctcctcccaggtctaggctggcatgaagtgggtggcacattgtgaattaatgtctgtgagtgtgtatacaagagaggagattactgggaagggtgacgtggtgaggcgggcttgccagtgcagggtgaccctgagggtgtgcccagtggcgtgggtgtgtctgtgattgtggccaggcggggcaccctcggaggggagggttcggaagtggaatgcgaccccccagcctctttcccctaggggctgtaatctgatccctggggactccccccctagcctcccgccctcgccctcactgctgactcctcttccagatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagcccccacgccttcggctctccttccaaggtaggtgcacctggcaggcgggagggcccagcttgaggtgggcaggaaagggtccccgtatggccagggggctctgtgttggctgttgccccatgtgcgtgcctgtcaccagactctggtaggattagtgggcactctcaggccacctccagttaaccctgtccgggcctcagcccccagcctctgcccacattctcttcgtgctttctcaggaagacccctcctgtccccacagcaacagaccttgtctctgttccgttcagtacccccaacaaggcgatactccttcagcagagcaacagggaagtcagagcccccttctcatgcctcctgtataggagggtggcccctgggcagtggcagtgaataggcagttctgctgagctcaggctggtggtggagtggcaggaaaggaactctcagcctgacttttgggagttggggttctggccatccctgcatgccagtctcccccaggactctggtgtccataagccttgcctcccagtgcgcccgcctggagacaccacctgtctgagcatgcccaagttcaacctgccttcctcttcctggggggatgtaccacctaccctggcagctccacacgtgcacctgggtgggcttgggtttgcgtgtgtaaactcacacacatgtaaactcacatgtgtacaggccag

SEQ ID NO: 458 - DNA, 3257 bp, Homo sapiens
gatggatggtgggtcatttagaaagagattaggaggaggtgggtttgacaaataaacttgagtcatgttaggcagatagggaagtcatacctggttcccagggaagactgacacatgacgggccctggctggaggagccacagggcgaggaaaggacagacaccatggccaaggggcccccagaccctaccgctatgtcccattgatgtgggggtcaagggagatgagcttcctctcgtggaaagaccatagatttaggtatcaagcagcctcataacaacctcaaacactggagacgtcacattatttttacaaatgagaaactgagatcacagaggtcgtcgcttgtccaaggtcctacagttgatcagacccaagtatggacattccagcccagcattgagttcagcctgtgcatgtcagaaagcagcactggtcctgctatagattgagagatggggcttgtcatgggagttacataaggagaggcagggaaaccccccttcatgacgcatcccccataagccaggcacatgctggggaaatggttggttttagggagagtcacaggctctcctgggacaggtatcgttcagtttttccttacaacaaccactatgaggtctttttaaaaattattattactattttctctactttactgatgaagaagcggaggctcagagaagctaagtaatgtaccaaagatcacacagctggtaagtgctgtcattcgggtttgaacccagctctcctcatctctaagtcctcagttcctttttctataacaccacaggctgagcaaaggcaagaattccaggtagaaaatctgcttacccctcttgctcccacagtgacaacaaacatggtgcttcattgggcctcaggttactcatctgtaaaatgggaataaccattatgcctatcctttaggattcaatgggattacgactataacatagctttgtgcacagtattcaagaaatgagagctattattcccagatggttgttttcattttacagattagagggcatgtaagattcccttcatttccatagactctaaagagcaaaggctgaagtctggattcaaagcaatacataagaaattccaaagttcacttgagcttcttcttcatttcagtctgagataagaaaaaggaagatggcatttcaggcaggtggaatgagtaggcaaagacatgagatgggattagacctgtgcaaatagggttggtatggggaagcacgatgacatcagattttagccacttttgggagtggcatcttaaatgccaaggtgagctatcagggcttcaatccaacgttcaggctcaatgtcaggggagcctgccacatgccagagtctgtgcctggcagagctgagccctggcacacgcactgtttacagctgcctggtatggcagtggtgatatcacccttagagactttgccctcttctctctgacccaaccttcaaccactggggcagtaggttatgcattgcctagaaggcaactgtaagattcaggggctgctatggatgcattacccaggagataagggcaacctcaggtgggccggggccctcacagcaaccttacgagaggggttgtatcatgcccatttgatggaagagaaaactaagattccattagaattgatgtgacgtatcctaaatcacacagctgcagcaggactaggatttgaatgcgggtcaatctgcctccaacactactgccttttcctccatgctggattaggctattggcttctgaaagcacagacaggtgagatgggtcaaacatggcctgaagcacccaggcacaggtgggagatggcaagcagaggcaggttcaaaacgtggggccaggactggtctgaaagatagtcgttaaatagcactgaggagagggagtgagagagatgtgggtcttgggggagtggggtcttgagaaccctgaaatcagcagtgtctgcccactttgccctggaccagcctctctgtctgtatccttcccccagagaaaggaccatgggctgacctgggccaaggacacctggctggagccccttctctgacattaactagctccgtgacctggggaaagccaccctccctcctgagcctcacttttcctgtctgtaaaatggcctccccgtcatcacacccacacaggtgtcttgaggagtgaatgatggtgtgctccaaggcccccatggagagcccggcacatggcaggcactcggtgttcaagcactgtgttcccatagactctgggctcctgccctcctcgcccccaacccccttcctaggaaccagccccggcttgtcagagagccagctagctgtcaaccccaccccagctggccagttaatgagtgaccaggactcctgagcctgacctataaggaggtgctaggcagggacacagatgggagacggtggacagcggcagggggaacccagggagcgcgatgggctgcagggctgcatcagggctcctgccaggagtggccgtggtcctcctgctgctgctgcagagcacacagtcagtctacatccaggtgagtcccttggccagcgttccctttgcctgaagggccccatggtgggaggctaggctggagagggtgtactgggaattcagaggggcaccgggggagcacggggcccggggctcagcccaacacccatcacagcccagagaccaaggcagctggtgggtgggggcagccagatgttgatggcagtgatgatggcaatgacaacaccaaactgattcagcgctgctcccctcaaaggcccgtgctggtcacagaggtcagggtgtggaacagaaggctcctccttgcatgggaggaggccagaaagggaaggagacaccctgttatgctcccacagttccgtatattcacccacatgtaggtggaggaggacaggctccagaaaaattttcctgagaagtaacccttgagctggcattgcaagatgaacaggaggttgccagacacagatgatggggaaactgttccaggccaaggggcacagcatgtgcaaagaccagatagaagactatgggggttccagtgcccttccagggggcatgggagagtggcagtagtcgtcacagcagggcctgtctgccacgtcacaggggatgctgctggcctcgcccagcatagcagagacgtctgtggccctgggtgtcacatccctgactctgggcatggtctccttgggaagaacaaagt

SEQ ID NO: 459 - DNA, 3058 bp, Homo sapiens
accagtaagatcacatggtggctgaaggtggtgtggctagtcagggacaggtcccttggccacagagccactggcgggtggcaatgtgccacgaccatggggtctggcagagatggcagtgtccctggccacagtgtccagcagcagcatggcagccgcagcagggctctgtggtcagacaggggtgctgctgtgacctgagactgtgggctcctttgaaggtggtgaccctgcccctcgtgtggagcccagctgtgctgtggggctgagctgtggtgtcctcctctttcaggatgtggctctgttttcactgcctaccagctctccagccttccccttggttcttggagacctgatttgcttccaatcaaccccttcctactcagtggccagcctatttctccatttgcaaccagcaaccctggctataacttctggggaaacttctggctataacttctgaggcacggagcggggcaggagcttgcccagggtcacagcgctctcggccagtctgggagtggcagccaggccacctcctcctcctgcaggaagcttcctccacctttcagcagccctggagccgcatggagcagggaagggagttgtctaccctccggcatcctgtgtgttccaggctgtgtgggagcaggtgcagctgccaggcatggcaggagcctgggcccgggccagcactcaggaatgcagcagggccctgcctctccctgtagggataagcaagtgccaggcgcccagggcagcggatgtgtctgtggctacagccccaacggcccccgcctccgcaccggctgtcctgggccagccccttgggggcctgggatgtgtggggagcatgaatggggctctgtgacccagcaactgttctgcggaaggcggctggtggctgcacaggtgactgcgggggtgggtgggggatgcaaaattctgcttcctgggcctggtgtcccccgccttgcatgaggccctgacaagacatcaccgaagcaccaaagccaacccttgtggcccaccggagacctgtctcttggatcacaggggcagtggggaggggcgcccagggctcccgatgcctctgagccctgctctgaggtcagccgatgtggctcagtcctggctgtgaggcctcacgctgccctgattccatttgctcctcagtgcgaggcagacagagcccagcctagggtctggatgggatgaaatgaagacgtctcctccctaacgggacactgtctaccccttccttcttctcccccgagaaccgtcagccccgtgaggatggggtctagggtagggcatgtggacggagctttgctgtttgtccaggtgcttatcttctagggtgccatcgcccctccccactgctgttcccgtatctgctgggtgtccccaaccccagggtggtggaggccgtctctcggatggggctgacacccaaggcacggacctgccaggtcccccaaagcacatggcctctctgcagaagaacctggatgtgacatctaatgcccaggccagagcttggggacagctggactggagccacagggtcaaggagggggagtccagaagcgcaaagtccacccagctgggagggctgctggcaggtcctttacaaagcaggcagctcctctgcccatcggagccggctggcctaaccagggcctgctcttgcctgggatgggggcagaagaggtggagacctggggccctgaggcggcactgtgggtcctggacccgcccacctgcactggggtccctgcaggcttttaatgggaacagaaatggaggaagagacagaggctgccaggggctccccgacccctactgcctgcctggggaggggtcacctcagtgtgggggaagcctggggatgtgagagcatcctaggcctgggctgcctgtggccagtctgttgtccgggtgtctagtgacccctggggtaggggcagatgccagtctgggaagccggattgtttgaagaccaactttaaagttgggagcagtgcccagagcggggccgatgtctgctaggtggttgtctctgctttttgaaaaagaagtccccgcccgacccccgccccgccaggcgctggtctgagcgtctgagcccagatggtgcgcttgctccagagggcgggcggctccagtggccgccgcgggacggtggggccagaggggcccgtgggggtgggggagccgcccgcaggagaaggagccccgcccgcgccggccctggagtcgccggtgtcgccgccctgcccgcgggcccgccctcctggcccagcccagggccctgcgagctattttgaaagtgaccctgggctggggcgccggggcgagcgcggcggcgcggaaccatgacagaagatgaccgaggcggcgctggtggagggccaggtcaagctgcgggacggcaagaaggtcggggcgcgtcgggggcgcggggggggggggcgcgggcgcgggcggcggctcacgctcccccctgtccccgcagtggaagagtaggtggctggtgctgcggaagccgtcgcccgtggcaggtgagcggggcgggcgggggacggggggcgcgggggtagcgacacgggttaccgaggcccggggcagtaatgccagcttgcccaaaatcgccgccgctgtcaccccgccgggaaacccgagagccccgtgcggacccggaccccccggcgcccctgggagcgcaggtgggggccctggacggaagaaccctctttccagcagggcagactgaggcccgaggggctgcctggtggccctgtaggcggaggggacgcaggccctgagccccccagcagagcagcaaggggccccccagaagcaaagccccacatacctgagggttgagctgtgcttgtggaaacgctcagagcagggcccccgaacccagcctccaggggtgctgcgtgggttagcgctgaccctggacccctcccaggcagacgagaggctgggctgcggtagggcagggcagagtgactgccacattgctgggggaacagtcctctgggaggag

SEQ ID NO: 460 - DNA, 3038 bp, Homo sapiens
tattttctctctgtcagcggctctgctggccagcttgcctttgggaaaggcctagctgtgggcggtggggaggcaggaggccgactccagttctgccccagtcactgactcactgcatgaccccagatgagggcaaacgctgcctgtctctgggcctcagtttcctcctcagtgaaagggaagtattggggtcagtgaaccccaaaactgtttgtatttccaaggtaagcagaatttgggggctgccagagccagaaggttaggatgtagagccacttcctctccccatggctggggtggggacactgggcctggtcccaggatcttggggtgtagggttccagcactcatggagcccagcaccagcccccacggggtcatccatgcatcagctgacgtgtgtggagagccactggtgtctggccctcgcatgcagtgcattacacagtctgcacagctctttgagggaggccttctctttatttctatatcccctacaacagttgaggaaactgaggcagagggaggcttaagaaacgtgtccaagtcacacacttggtacgagggcgaagccaagatttgaagcagatccttgtgattactgagcctgcctctcaatcaccaggcctctttgcctcttatcgaggccctgggcaccatttctccctgggagcccctgcctgtgcacagtgaggtggagcccaggctgaggcccttaccgagccccttggcgtgtatggaggcctatgcttcacgtgatgtgggcaccacctctcccgctgtgagccacgatctttgttctgagaggagctcagccctgcagtcaggtttcctggtttttagaggtgggcactccggtgcagagaggcacagtgactgttcacggccttgcatcggggcaccttcacagccatagcttgaattcagggttctgcacatcccagcctccagctgagaccccagagaagcccaccagccaggcctctgggtgtcatcctccctcctgccctcagggctctgtgggcagtagggggcgtgttggtgggccgttgaggagatgggccagctgagccccacccaacaaggatggttgtgtgcccacactcccagtgcacccgcaggccctgcacttctgcctgctgccatctctgccccgagcaccactgtctctggtctggaccctggagcagcgtccccactgctcttctgcctcctcctattcctccaagcccttctcccttcacagccatgggggcttcctaaactagaactagggtcacatccctcagctgcccagatgctgctgtggctcctgcccaccctctttcttactgtccctggcccctggtctccactcacggcacccctcccttgctcagtgcatctgctacaccacagaccccaagtcctccactgggccaggcacttttctctatcttggagtcttcacatatgctgttccctctgcctggaatgctgtttgctgcatcttggtctgcctctccctggcttgttgctcaacttcacttctccagagaggccacctgggaccttgagtctctgctgtgtggctcctggactcattgtttgtttctggcaagcactgcttttacttttgtatcatttgattctttgctctcgtctgagtctccgcaagggtagggatcactatcacatcagcatgcttgctgaatgtttgttgaatgaatgagtgaatgcgaagtgcctttgtcattgcatctccctggattctcccggtgaccttgagacatactttgaccccactttgacacgtgaggaaattgaaccccagagagtctgagagcatatctgtaatcacataaccagtaactggcaggtgtggggagtcaggggcctgtttatgccagggcaccccatcatgtcccttcagagtccccctctgtcagatggggatgatatggtggcagtgggcagtggcctcatggtcagtgccgggcctctactgtgggtagacccgctgacctcccactttcattgcagcaggatggagctggagtgaggtggaggggccgcaagctgctgaccggcgtgtggaacactggtggtttgcagatcactgaggtaggtgtgccacggggctggcgggaggtggctgggtcggacgcaggtgagtcctcatgagggcaggtgctagccctagcacgctggacctttgactcgggcctcagccctgaggggcaggagcgggcacaagccacctttgctgggacctcatcatgcccccaatgggctgtccctctacctggcacccagggacctcttggcctggcctttctctagagcagctgctaggggtgggggctgcaggtctgcccggggagaggggcaggtctggccacctggtcttggcacagcagccctgtctgcaccactctaaaccctgtggagtatgggcagccccaccaaaggaggcctgggtgagcaggagcatgtcggctgaaatgggtgcagggctacccaccccttctgcccactctcacaaacatgccgagatggatacactgggctctggggtcagaccacctggattcaaatcctgactggcatgcatggttactctgtgcctctgtttacccatctatcaaatgggaatgagatggcggtgcctgctccactctcgcagtgaggagactacacacctggcacacagcaaggactagggacatgtcagtccttttcctcaagggtgctaggacccacctttctccccacacacctcagtttccaccaccctgctccccctgaggacccaccagtgccaggatggacacgaactggaccccccgcctgataaggggggcagggcaccttgaggagcaactgagagcagctggggccagcaggtcctaaggtcggggccagcaggtcctgaggtcaagcccagctctgtcccgtgccccagcatttctcatcatggggtggcatttcagggttgatctcacttggccctgtgcccgagggtgacctgtgtaatccctgtttacttggcaactctc

SEQ ID NO: 461 - DNA, 2998 bp, Homo sapiens
ggaacttggctgctttttctttctgcagttagcagagggccttggccaacacataagcctttctgccagcacttggcattccagctgacctcgacccaaggcctctgtgacttcaggaggcggcagctgggaagggtcagggcagttccaggcagagcacagacgtcagctcagacatcctaccccccgccaaccccccgcccccggggtttccagagcaaccaacaccaccaagctccaggacactggaaaaaaaatctttgcaaagaagcaaggggccatctcagaaaatccaggtcccccaaattgatgtagggagaggagggctttgacagcattcagcactccagagggtcacgaggatacagaaaccatttggagccacctctgcttctcagccccacccaggcaagccctggatcttcaagggactgatttgtacctgggaataaactcatgcatggatgagattcagagtcaatcacaccctaaaatgcagagcccatagtattggtgagttgttcatgtgtctctgaagcaaatttagggctgtggttcaaacatcgtaaaagttaaaaaaaattcactggatacacacagtaggctcttttaaattagcctcatttgaacttaattacatatttaaatactcaaataataaatgatggctgggtgcggtgtctcatgcctgtaatcccagcactttgggaggctgaggcaggctgatcacttgaggtcaggagttcgagcccagcctggccaacatggtgaaaccccgtctctactaaaaatacaaaaattagccatgcatggtggcgggtgcctgtaatcccagctacttgggaggctgaggcagcagaagcacttgaacccaggaggcagtggttgcaatgagccgagatcgcaccactgcattccagcctgggtgacagagcaacactgtgtctcaaaagaaaattttttttaataaaaataaaaaataaaataaaataagtgagtccactgaaagcggtttctaccttgatagttgggtgtgtggcgtcatcaacatcacagaaggctgatcgatattaccaggtgtggttgagtgcaagtgtttgaggtctcgtgggggaagagtttggaattcagaatccattgaggccttcactcaccactttccctctctcgctgtgttcccaaatgtgccacttttctgttggctcacatgcacccatgctctatttgatattcagggctctgaatttcaagccagactcagtcagtgtgattgtcactgctttcctgtccttcctttatcatctgtagacttgggtcccgtttttgcaggttgatgttctgtcttcgctgggctctggactcactgctcacgagtgcggtgtctgcatgggcactgcccagacatgcactgttggtccctcgatggctgcatggtcaggcctcagggctctctgccaggccgacctacagcccatacagacctgatttctgggcctggatccaggggatgccatctgggaagtgcgggatcttcccacgatgtcactgtaaaactcaccagggaggttttagaaattgaaccggcatcattcagattccatcctgctttttggtcctgagaaaatcctgcttttccctgagtaactgggataatgggtcaccagctcccatgccctagatgaggactagttagcattttctagtgcctggagatttccagatggaagctgtacttgggtctgtgtatctttgttacaggattcaataattcatgcactgaatttcccttcccggcaactccagacaccaaatcgcttcccatggtgtcccccaatcacttaggaatttagcctgtgtctaaagaccctctctgcagcctgacgtggctagccatcccagtacttccacgtttttcatgcctttctccaacagcgttgccgtggccccttaggcggcgatcgttttatcaatggtcgctccctctttttatctgttggcaggagccctttttcaacgccctcgctggagtctggcctgcacgccttgctgaatgaagccggaacctcagccccgcttccctttgaaatgaatgttcctggggcgccctctcgtggattttggagctaatcgtctgtgaatgccaagtgatggcaactgccctcccgccgcgtctccagccggtgcgggggaacgagaccctgcgggagcattaccagtacgtggggaagttggcgggcaggctgaaggaggcctccgagggcagcacgctcaccaccgtgctcttcttggtcatctgcagcttcatcgtcttggagaacctgatggttttgattgccatctggaaaaacaataaatttcacaaccgcatgtactttttcattggcaacctggctctctgcgacctgctggccggcatcgcttacaaggtcaacattctgatgtctggcaagaagacgttcagcctgtctcccacggtctggttcctcagggagggcagtatgttcgtggcccttggggcgtccacctgcagcttactggccatcgccatcgagcggcacttgacaatgatcaaaatgaggccttacgacgccaacaagaggcaccgcgtcttcctcctgatcgggatgtgctggctcattgccttcacgctgggcgccctgcccattctgggctggaactgcctgcacaatctccctgactgctctaccatcctgcccctctactccaagaagtacattgccttctgcatcagcatcttcacggccatcctggtgaccatcgtgatcctctacgcacgcatctacttcctggtgaagtccagcagccgtaaggtggccaaccacaacaactcggagcggtccatggcactgctgcggaccgtggtgattgtggtgagcgtgttcatcgcctgctggtccccactcttcatcctcttcctcattgatgtggcctgcagggtgcaggcgtgccccatcctcttcaaggctcagtggttcat

SEQ ID NO: 462 - DNA, 2796 bp, Homo sapiens
gctgtttctctcccagaagactcagaacataagcacctggaatggatgggtcgcatttaggactccaaatgagttctgctttccctttttgttttcaatctatgtgctctttcaggtactcaaacctgttaccgttttatcagcaaaatgggactttctaccaatttggtgggatgagtctcgccgggagtgatgtgtgtgtcacggaattgtggtcatgcatcgggatggctaattcactgatgtcagatgctaacgaagtggcctcggctactgagcatcacgtcactgttgggtttagacacaacacgatcttatgtatggatgacagcaccactaataacaaatgccagtgacctaaacggggaataacttcaaatgaaacaaaaagcacctcatatcatatttatcctgaaagacacaactggctgaataaaatctgaatacaggaaacatagcaatgggttgataattttggtggaacttgatgatgtgtgacccacgcccaacacagtgtgacccaagcccccaggagggttctctaagtgagtttggtcggaggctgccattcacagtgacttgtatttgccacagcagctctttctaagcccagtcctgggattatctcagggatcatcccacaccccagcggggagatgggccaagtccccacctgacctcatcttaggtagagaggcttccatggaagtgtgggctggctgtggggggttgagacctagccccgttcttttgacatttcaccctgtgttctccaaactccagcaagcagcttccatagctcattaaatttgactgaaggtctgatggcttgcaaagcaaattctttacaactgttataaaggtttcattgcttaagcatataatctagcaaaactgccaagccccctccactccctaaactctaagacttgccagggaagagaacagtggccagtggactgcaggagtaactgcactcagcccagaactccctggaggacacagggaaggttctggaaaggtggcggtacctcacagggagagacgtggtgctccagggcccaacttgctcatgttcagatcctcactctgcaacccaccagccggctgtgagtggctacacaatctctgcctcagtttccctatctgtacatgggttgttcatagcctccacctcagagggtagtaatgatgccaagctcttagaacagtgctcagcatgtgtgcatcctgtgcctactctatgccaagcactacagagagaaaaatgaacaaaatagggagaaatccctgccctcatggagtttacatcggggcagggggcgggggcggcacagagcagacaatcaatacagtgattagcccccagttaggttaggcatttccaatctttgccaataagccacatatttgcccaagttagggtgcatccttcccatgaactttgactgtgacctttgactatggggtgacatcttatagctgtggtgttttgccaaccagcagctcttggtacacaaaatgtgctgctagcaggtgccccggccaaccttgtccttgacccacctgcctgttaagaaaagggtgttgtgttttgcaacagcagtaaaatgggtcaaggtttagtcagttggaagttgtgtcaaaactcactatggttggttgagggctcgaagtctcccagcattcattaacaactatctgttcaatgattatctccctggggcgtgttgcagtgagttggcccaaagcataactgaccctggccgtgatccagagacctgccccctgacgtcagtggcgagcctccctgggtgcagctgaggggcagggctattcttttccacagtatttaaagctgggaggttctgccaccaagcacggccttcccactgggaacacaaacttgctggcgggaagagcccggaaagaaacctgtggatctcccttcgagatcatccaaagagaagaaaggtaagtagagctttgcatttacattttgaaaaattacaaagatgaactcatttttttcctgagagcaataactatttggcaatgcacagccctggcaaaaggccgtcgaatgtgtttgaaggtgtctgttgttgtttttgttcaggacgcttgcgttttctatttcaggtgacctcacattcgtgccccttagcagcactctgcagaaatgcctcctcagctgcaaaacggcctgaacctctcggccaaagttgtccagggaagcctggacagcctaccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactggtaagctcggcccccgctgcctgtcccagcaccctgcaggcagggctcccctgcgtctcctgggagttggtggagaaaggtgaatgaaggccttcgggtagtttcagactcttgagaagatgaatgcaatggtcagaaccatacagacttgaattttgtgacattagtgggccagcccaagctttaaatgaggtgtgtgcacaaaagctctgccaactagattcctgattaaaaaaaaggcagcccctctcctacagaccaggtcctagtggagtaaatgtccacctggccatgtcttagatggtctgtgtgttcacactgatggactgttgttagcgtgctcagcactctgctaggcatggaaagccacggtactgaaggagatggttc

SEQ ID NO: 463 - DNA, 2767 bp, Homo sapiens
taactggggactcctgctgattacaaactgatcacttttctttactggacaggactaggcttcatcccctctggggtttggggatggtgcttctgactctcctgaggcagtctgaccctggtccctgcctggctgtctcctctgactcaagactctgatccttcagtgtttgtgggttcagagcagagcctgggaatgagcccgctggggagcaggacactgactccaccataggacagggctcaggatcattggttaatggtttgtaaaatggaccaggcctcatccagatgctgtccccagcccctatgaaaacatggaaagtttccactggtgcacaaacactagtgcttgcctccctttcctgatcaaccgtcggactcacatgggctgtttgtgaaaatgcctgtcccaggccatactcaggctgaccaaggtggtctggtctccagggaagggccgtgaaatgtatttttaggaagtggtccaaaggactcttctgatccagatcatcaggaagcatggcgtggatggaagaaactggcacttggcatctggtgcctctgtgtggctgtagaagctacagaaatgtcttctgcagtgactgcagcgtggccctggctgagctggtgcttgtgaggaagcctctgcttgtgtgcaggggtgaacagcagctcaccccttcccatgcacagtcctcaccttactaccttcacccttactggaagcatctcttgacttctctttggccagccagaccctcccagctccctgtgctccccatttaaacaccttccctccctgagcttagcccatggctgggtggggaggcgtgagcactgtttgcatttggtcagggcctagaagggatcaaggaggcctcatgaggaccatgtcatagccccaccctcactccccacccctgacctgagcaaacctgtttggctggattgatgatggagaggcaggcagtgaccagaccaagagacgccttggatggtggagaataggtgaccctctgttgggtaaaagaggactcaagccctcacacagtgagttggctaactttttgtctcaacagtgggcgggggtagctgtctgcctcctggagctggcccttcctgggtcaaaatgcagaaggagatggtgagaagaaccacaccagagaggctggagtaggccagcctggcttgggaccgagtcccgagtccctggctggaccctcggttttcccttccgtggcagggctcacctggatccttaatgccgcccttggaggagttaggaggatcctggatgagaaaactcaccctcaggatgattgccccagggagcagcttcctgctttctggtggaagggaggggcagacagtgggtgtgtcctgctccagtgtctaggcaggagagtttgtgaagctgaccggacacctgtggctcttatttcctaggtggcccgaggcagccgggatgacagctctccccaggaatcctgctgcctgctgagaaacatggtcagcaagtcccgtgagtgtcatccgagggctcccccaccctggaggacaggcctcagaagccgtcttcagcaggatcctgggacctctgggggctgtggagggacagacagggagccaggggcccttctcttcatcttgaaggacagtgggtacaatcagggtcaagccctcagccagggccaggagagggccagagactgcttctgttgagttaggggtcggagggactcagaagggggcaggtgggaaggtggacgggggttgtacctgcctgttgctgcctctagctcctctctgcatgtgtcctgcaggctggaagctcctggccatgttggctctggtcctggtcgtcatggtgtggtattccatctcccgggaagacaggtacatcgagctgtgagttcaccttccatgtccttccagtggctcttgtcagggacagggcttagggatggagcatcatggagcgggggacctagtagggcaggaaggttccaagagccggcacatgacctcatcccttcagctgctggtacggagtgtttccatgagggtgggtgggggtagggcctgggatgtctcactgggccctcacccagggagtgcaggggcaggaagacctggatcctcaaggacttgggttccaagtggaacttaacttgagatgattcctccccggcaccttgggaccttcatgccgtgggagaaggcttaggctgcctggaacatgggtccctgggtctgactggggcttctgcctcctgtccttttttctctccagtttttattttcccatcccagagaagaaggagccgtgcctccagggtgaggcagagagcaaggcctctaagctctttggcaagtaagtacttaaggatgaggagggtagagcagggcatggagcgagctgggattgagggtttcacagtgtggggagtagatggaaagagcagctgtgttggtggacatgggttaggtgaagccagggagggaagagaaggccttataatattagtcatgggcctaaccctacttctggcatcaagattaattctgttctcatccccacccggctttcacctctgtgcagctactcccgggatcagcccatcttcctgcggcttgaggattatttctgggtcaagacgccatctgcttacgagctgccctatgggaccaaggggagtggtaagttcctacccggctcgtgggaaccatgggctcaccctgaccacgttgcttcctattctctg

SEQ ID NO: 464 - DNA, 2732 bp, Homo sapiens
gacggggttttatcatgttagccaggatggtctcgatctcccgacctcgtgatccgcctgcctcggcctcccaaaatgctgggattacaggtgtgagtcaccgcgcccggccccgcatttagtcttaatgataatctggtaggtaggtgctattatattattactttttatagagaggaaactgaaccatagagaactaagtaagcgcccacgggcactgagctggtaagaggcagatccagggtttgaaccccccaaagacgggtgccacacgcctcttgataggaagtaaatcaaaaataaagacaaggaaggccgggcgcggtggctcacgcctgtaatcccaacactttgggaggccgaggcgggcggatcatgaggtcaggggtttgagaccatcctggccaacatggtgaaaccccatctgtactaaaaatacaaaaaattagctgggtatgatggcgggcgcctgtaatcccagctactcgggaggctgaggcagaattttttgaacccgggaggcggaggttgcagtgagccaagatcgagctactgcactccagcccaggtgacagtgagagactctgtctcaattaaaaaaaaaaaaaaaaaaaaaagacaaggaaaacctgaggcctgggcacagcgcctcacacctataatcccagaactttgggaggccaatggagtcaggatctcttaaacccaggtgttcaagaccagcctgggcaacattgcgagaccccatctctacagaaaaacaaacaaacaaacaaaaactaaaaattagccgggtgtggtggcgcctgtctgtggtcccagctactcaggaggctgaggtgggaggatcgcttgaggccaggagctcaaggctgcagtgagccgcgattgcgccactgcactccagcctgggcgtgcagatcagagcgagaccttgtctctaaaggaaaaaaaaaaagaaagaaagaaagaaaagaaaagaaaagaaaacctagcgaggtagataattttccctagatcctgcggccgccggaccacgaggccggcgctgtgcgttgttaaaaggagaatagcagatggtggcgcgcagccccgcgaggagacatccagcaacgaaatcgggagatggaagggacagtgagaaggggggcctggctgtgcgcccccgcccgatgccccactcctcgccgacgggcgccgggcacctgcgggaagggcgggagaatcgccgctcctttcccgccgcgccctttccgccctctccccgcctccttttcgggcgtcccgaggccgctccccaaccgacaaccaagaccccgcaggccacgcagccctggagccgaggccccccgacggcggaggcgcccgcgggtcccctacagccaaggtaaggcaggaatctcctggactgggtcgcggtcccccggcttcccggaagcgcagtgcgcgggtggcatcactgtgcccggagcccctgcgcgccccggccatccccaccccgagggaccccctacggaggcgacctgggggctgaggtgagcgcttgggcagcagcgacggggaggggtgtccaccccacccctggtgcgggccggggcgcgcaggcctggaactcggggttcagactccccgcgactcggaccacgcggctaagcgcgctcagggtcgcgtgcccccgccccgccgccatgctgggcgccgtggtggccgcgcagctgggcgacagcaggcgtgggcgggggtggggagcggcccctcagcggtccctaccgcctgaggccagggcccggggacttttattgtgacacggcgggcgcccggctctgcttagtcatggtgacctgcgcgcgctccgcgcctcccccacgcgcagcgatggaggcgccggggctcgggcggtggaggcggagccggagcgcggccatggcggggtgagtgaggcgggatgtgcccgggctgcgggcatcgcgggccgcgagcgcccctgcggccgtgcccggagaccaggaaaacgggcgccacggcccagggcgcctccgagttccccgccaggactcggagggccaggagggcgcgacctgggtggatatttttgttggacggcgcaactcttggggtggcccgggagcggcggaaaccgagcgagagaaccaggaggcgctgcgcagaaggaggcccgggggctccgaggcgttgaggggctcgatctgcgttctggggttggcagccgagaggccgcggtggggtcacttcctcgcctcactgggcctggtggaggctcaggaggggcatgcgcagtcgcccacttgccgctttgtagggtgggggaagtgcccggtgcccaaggggcattgttgaccgattggccaaagaccaagaggcaaacccagggccttggcaccagagtgggggccgagtggcacccagggagggtggaggaggccgctctggcaggcacggtggcagggcagttagccaaccacccgtttattgacccctgcgcagtgccaggccccaggcgagaggcacaggagagggttggcccgacgccgacctacataggtctccctgccatttgaggcgctggggccggggacgagagacagtcgatcaacagacaagcaaaggaggtcatttcagttcctgacaagcgcagtgatgacaataaaacagggaagaggagactttgagttgagtcccagaaagaggggagtgagaacttgcagatccac

SEQ ID NO: 465 - DNA, 2732 bp, Homo sapiens
tttgatgtgcttcatcctttgtgggcttgaagagtctcttgttcccaaaattattccctggggccctctgcttcacaggcaaataaaagcaaaaagaagcttgctcagccttaagtgaggaaatgactcacaggtttaaaacaaaaaaggaaaagatggaggcattttgtaggtgaaagggcgagagtcttctgatgcaaagtaagaggtcattagagcagggatggattatcaataagcagagcaaacatttgcttagggaacaaacagcgccggaacacgaaaaagaaaagaaaaacataataatttaattacttaaaacactgaagatggcaacataggaaaaaacccaaaccagaacatttttggacttcataacattttatggttcagtatttatggcttagtattttattttgaattacatgtggggaggaggggtaaaaatactttaatttttcttgctaagtaagtactattatatattcaggtataatgggataagggataccattttaatgggtccgtttggagctttaaatatgatcaacagtatctgtgtgcatgcaagattggttaagaaactgggttagaccgagtgcggtggctcacgcctgtaatcccagcactttgggaggccaaggcgggcggatcacgaggtcaagcgatcgagaccatcctggccaacatggtgaaaccccgtctctactaaaaatacaaaaattagctgggcgtggtggcccgcgcttgtagtcccagctactcgggaggctgaggcaagagaatcacttgaacccgggaggctggggttgcagtgagccaagatcgcgccactgcactccagcctggcgacagagcgagactccgtctcaaaaaacaacaacaacaacaacaacaacagaaaatgaaaacaaattggggtaaaagtctctgagagcttcctacagttacaactccaaagcttcacaaagccagtccctcctggctggagccagggactccaacgctgtgggcctctcagggggcggacccgcggcgccagcgcctgctcccttcccacctcccaaccctcctctctgctgtatcctccctgcgagctgtgtcgggggccggggggggggagtgggggccgaggccggacagcttcatctggaaatcccccgccactcacgggggaagaagtcccacgagccctatctggcctcgggcgctggcgcaacttgtctgctcaaataatctcgttccaaatctgtgcgttttacacaagaaacaaacaaacaaaacaacaacaacaaaaaaacacaactgggactcagatgacgttttaagttgtctttgaaaaacaatgcataaccctgcacgtataaagttgcctatgtcacataaccctaggcagctgtcattctggagtgatctggagttaagttttttgttttctttttcttttttcttttctttttttttttttagacagggtctcagtcactcaggctggggtgcagtggtacagtggcgcgatctcgactcattgcagcctcgaccacctgggctcaaaagattctttcacctcagccacccacccgcctgcccccaaccccgctaaacagccgggactagctgggactacaggcgcgcgccaccacgctgggctgctttctttgtattttgagagagacggggtttcgccatgttggccaggctggtgattcgctcgcctcggcctcccaaagtgctaggattacaggcgtgagccaccgcgcccagccgccacaaaacttttaaaagttattacttcgctaaaaataacagcgtagaagccattgtgcagcgccacgcgatctcggctcactgcagcctcgacctcccaggctcaagcgatcctcccatcttagcctcgcaggtagctggggccacaggcgcacgacaccacgctgggctattttttaaaataaaataaaaatcttcgccaggctggtctcgaactcctaggctcgacagatcctctcgcctcagcatcccaaagtgttgtgattacaggcgtgagccaccgcttccatttttagagttctattctgaggactaacgccgttcaacaagttggtgtgaatttgtttgcatttttcaaaaccccaaagccggcctgggcgccatccccatttgccccgggcctctcaggaccccgaccacaggcaggaccccgaccacaggcagcgccccgactccaggcagcgccccgactccaggcagggctacctccaactcccagcctccccaggccgggcccccgcccggctcccgacaggctcctctccccgtggcggggcccctcgcccaggcagcacaccctctcaacccgaccgggcccccaccactctaggagggccggcgttgggggagggcgccgggacgtgcccgagggtgacactcgggcttgggacagggcgtgctgccgcgggtcacgtgctgcggaggcttggggaggggcggcgaggcggggtttatagcccgggcgcccgcgggccccacgctttgaccgggtcgtggcagccggagtcgtcttcgggacgcgcctgctcttcgcctttcgctgcagtccgtcggtgagtgcgcgcccagtgggtgccccagcgaaccggtcccgggcccccagcggcgcccagttggggtggggggctccccggggccttgggaccgctgctctgctccccgcggggctcaaaggtggacgggac

SEQ ID NO: 466 - DNA, 2711 bp, Homo sapiens
ctgactcatcagaaaggcctgccgcgcggcccggggggcgggggaacgtgggggaccgcggggagctgccgggcaggcggcagccgaggtcgtttgaggcgcgcagagccggaaaaccccacggagacggctgggcgggggcggggcgatcggcactgaccaggtcacctgcagcgcgggctgacggcgggcgactgaaggagggagcaagtctcccacccccagcagccggcggccgcttccgaagtctgcccccttccactgcggagcggcgccccgcgggcccccagccagcgcgcccgaggcgcccccgccccgtgtcgctcgcgctgcgttattgggagaaggcggttcctgagcaccagcacgggcctcggtgacaccggaggtcgctggggtcttccccttccccttaagactctgggtctgtctgtgggaagagctttcattccccaccccactctatgccgaccctctccgggggaggctccactggcactgtagacaccacgtgctgggtaaaaaggcctggtcccagcgcttccctgtcactgactgctaaccacaaggcgccgtggcactcaggaaatgcggcaggggggctggagaactatcaggaaggggtgtgggcagagaagaggcttccaccctgtcttggaacacggacacagtccatggcattcaaaagaggtgggaggctcctctgtgcacgtgccttccgcccccgggacaggtggaggaggggatttgactggtcctcaccctctgcatttatagtctgggcacaccttgggcagtgccgcaggagggcgctgtggagtacaggcacatgcagaaggtgtggcgagggcttcctggtggagctggcagtagggcagggaccttgaaaaggaatgatttgaacagatcggaaaagacattccagacagaaacaaatgcctgaaacccaaaccgagaagcaggaaagagcagactgcgttctcggaatggcagggagtccagtttgactggaagacctgaggctcagaggcgcatcacggcccagatgcagaccacagaggcaggcacagtggcccaggaggaccgaggacctggagtcacggggttccgcccgctgcccctggggaaccgagtcatgccagttcccagacagatgaattccttccaagaattccacagtcctgctcaatcctagccgccaagcctcctggccttggatggctgctgtctaatgcagatcctctttcatccagatttcaaatatttttcctattctgtcctttgatcactaacgtttatgtttatctacatcagcatccctcaatcctgacggcactctgaaattatctaggggtgctttaaaaaagaaaaatgttgatgcatggccctcctccaggaaatctgattttattggtctggggtggggcccaggcatcagcagacttttaatgagcagttagagaggagaaccactgatggagatggtcaccagggagtgtccaggtcagaccgccacagaagagtgcagcctcctggccttcagacccaactgggacaaaccctgagaacagccttggcagacctccaggggcagctggactccctgaggctggatgttgcagcctctcccaggcatccactctgcagctgaggccaaagtttccaacgggaagggagggtgaggcttctatttgtttcccaagagccagctgacctttgaagctagtgataaccaccacaaacctcactggtgggagaacgaggcactgcagccagttctcatcaaccccacatccctgcagggggccccaaggcggatgtgtcaccatcctctgcaacgctgggcctcagaggtggaggaggcccagccatggccagatgggggatctggggaacaggtcctctgctttctgggaaaatagaggtgatgattcctggccccaaaggttcttgttgggagtcttgagataaatcccctagcagtgctcagcatggggagaattttcagtgactgttcccttcctcctgttttgctaataactcttttcacaaatttaggagagtctccgagtctgggccttgccactcctcactcagcatctgaccatccccacctcctggatctacagggttcatagaggaggacccagaagagggaaagtcaggctgaggaacttggcctccctgctgcaagggaaatgacatcggttaccaaggaggtgaccagctatccttttccaagactgaaaagcagaaatacggccctgaggctagagggtctaagagaacaataggaagaatttcctgacaaaggacaatgttgcctaaaggactcaggaagctctgtgaaaacaggagactcccgagcagagcaccagacccttctccaccaggcagtgtttttcccatatgacaggtgagaaaactgaggctgagagacatgtaataacttgctgaagcagcaaccagcacaccatatagctgaaatctgtagatcagcagttaaaagtggtagggcaagtcctctctgactttcagcgctaagagcctaggattctgtgtttttctgcttaagcctgggaatcagagtcctacaaaagccgcgcctaatcctgggggtgtgggctttaaacccagagagaaagcatgttattggaatactcctgcacttttctccctttgaatcccaccacggaaagaaaattctgtga

SEQ ID NO: 467 - DNA, 2679 bp, Homo sapiens
agaggagattactgggaagggtgacgtggtgaggcgggcttgccagtgcagggtgaccctgagggtgtgcccagtggcgtgggtgtgtctgtgattgtggccaggcggggcaccctcggaggggagggttcggaagtggaatgcgaccccccagcctctttcccctaggggctgtaatctgatccctggggactccccccctagcctcccgccctcgccctcactgctgactcctcttccagatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagcccccacgccttcggctctccttccaaggtaggtgcacctggcaggcgggagggcccagcttgaggtgggcaggaaagggtccccgtatggccagggggctctgtgttggctgttgccccatgtgcgtgcctgtcaccagactctggtaggattagtgggcactctcaggccacctccagttaaccctgtccgggcctcagcccccagcctctgcccacattctcttcgtgctttctcaggaagacccctcctgtccccacagcaacagaccttgtctctgttccgttcagtacccccaacaaggcgatactccttcagcagagcaacagggaagtcagagcccccttctcatgcctcctgtataggagggtggcccctgggcagtggcagtgaataggcagttctgctgagctcaggctggtggtggagtggcaggaaaggaactctcagcctgacttttgggagttggggttctggccatccctgcatgccagtctcccccaggactctggtgtccataagccttgcctcccagtgcgcccgcctggagacaccacctgtctgagcatgcccaagttcaacctgccttcctcttcctggggggatgtaccacctaccctggcagctccacacgtgcacctgggtgggcttgggtttgcgtgtgtaaactcacacacatgtaaactcacatgtgtacaggccaggtcctaatggcaaccttggccgatagagtcaccaccaggcaggacctgggggaggcttccagcatggctggcgagtcatcagcagtgtcctgccctgcagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaaggtgccagggactcccaaccccagcactccccagggaaggagccctgggaccccactccagcctggagagacccagaggaatggctccctgaggtagagaatatcccaagttcctgacctgtgtcccctctcccccaacctcccgatagctggcctggccggcccctgtggaatggcgagaggagtgcaactgggcagggaaggacattggtgtgagtgccagctgcccgggccgggagtggggagggtcagcccctcaccccagagacagggcagggctaaaacagaggcctgcctgttctggctgggatgagggcagggaggtcgaggtggctgaggtctgggggtggtgagtcagggtgggggctcgtgtaattcttctggggtgcctctgagtcatgggaggctttgcaggcctgtgcttccccagacacccaccctcgtgaggcctgggctggtcagcaagggcccccaggtccctgtagcccatgttagtacttgcctgggctgatgccgaagagagggaggggtgaggatgccactggtgagctgggacctcttaaggctacgtccctgggggaagcctcacacctccaaccctactagactgagtgcatgaacttcgtgaagttgctgcatgcctacaaccgcacccatttgctggcctgtggcacgggagccttccacccaacctgtgcctttgtggaagtgggccaccgggcagaggtaaggccggatctaggcagggagggaggtcaggagggtaagaagggcctggtagtcacaacttgccacacctcccaggagcccgtcctccggctggacccaggaaggatagaggatggcaaggggaagagtccttatgaccccaggcatcgggctgcctccgtgctggtgggtgagtccaagggctaaggccccaagagaaccccttagaaactctagaacctcacaaagtcccaagacccccaagagctccagggaatcccccataacctcactcactcccagagctccccaggccctcctgccccaagagccctccatttgcctgagtggcccttgctctgtctgcaggggaggagctatactcaggggtggcagcagacctcatgggacgagactttaccatctttcgcagcctagggcaacgtccaagtctccgaacagagccacacgactcccgctggctcaatggtgagaggctggtggggttggtgggtagaggtcgtcaccctcccacagggcaggtgccaagcaaggcccataaagtaagtgagcagtgggtgtggccaggtcttaccaaataccctcc

SEQ ID NO: 468 - DNA, 2659 bp, Homo sapiens
ttctttgattccacccactgtttacttgtgcatcaagtgaagggtctgtttgattcccatgttttagcatgaggccaccaaggtcatgcaggacaccatcaatgagttcggtggcacaccagaagagaaccgcatcaccattgccaacgtggacttggtcctgagcaagggcaatgtggacgtggcgctgaacatgctaaggaacatcttgcccaagcagtcctgctatatggaagccagagagaagatggccaacatctacctgcagaccctcagagacaggcgcctctacatcagatgctaccggtaagccccacaggcagcacaatgacagcttcttctccaatggtatcttagggagtgtttccttcagatggtatttcttcaacctgggtctccagaatgtgtccttggagtgtagttgatgaatgtatggaattgtccatgggttacaatttgagcatgaaaggtcagtaagccctgttcatggatgaggatacagaatcgaattggccctgagccctgcttgcctccccctcacctgcttgcacatgctagtgggagactgtaggcctggttctcagagcagacacactgaagctccaagctgctgtctctgtatgattttgcattgggacctccaaggtgccttcctcatccctttcttctggcagagctgcatctaagcaatttaaagtgggaggtggggatgctgagggagtagggaaggctatccagcagtgggaaaccagtgaacagtatggaggcacggccagattggagttttagaaagagtgacattgctgcctcatggagagggatctggagggatagcaggtagagtgagaggaacaggtagagggcctggccatggcctaactacagagatggatgtggagagcctgactcaggtagctagcacagtgcctcattcacagtggactttctataaatattgattgatgaatgaatgaatgtcagccagaatcagtgggaaggaagtgaaggagatgatttcaggaacatgaggtgtgtgcgaacctgggataagcttttggttactcttgcttgcagtgagctctgtgaacatctgcctggcccccacaccagcctgctactgggcgatgccttaatgagcattctggaggtaagtgagaggcctcacagccttgccaagtggccccccagtctcccttctccagtgggagagaagaggaagacccaaagacactttccccaccagcccgagaaggccctggaggtctatgatgaggcctatagacagaacccacatgacgcctccctggccagcagaattgggcacgcttatgtgaaggcccaccagtatactgaggtcaggctgggctagggtgtgaaggggcagggagggccagcccagcagggaaggaggaggacggtacatgactggggagctctgggtgggaggagagtggctgacttttcactcagctccttgctgaatggggtgccaaggggagaactcagcaactctctgctgctgaccacacctgcttaagctgagggttacaccctgtgccagctgggaggagtgccttttcactttaggctatgttctggaggggcacactggtgtgatggctgctgaggggaacatggtgtcgggcactgaagggcagaaccaggccagaggctaatatttactgtttgcactaaggcaattgagtattatgaggctgcccagaagattaatggacaggactttctgtgctgcgatctgggcaaactgctcctgaagttaaagaaggtcaataaagcagaaaaagttttgaagcaggcactggaacatgacattggtgaggcagcattgtaacccatttctagcatttggagcagacatactcctcccccattccccattagctgaagtcctgatcccagcgctccccaccaacacagcttcccaggagccagtgaactaacactaatttgagtttccatttaacagtccaagacatcccatccatgatgaatgatgttaagtgcctgcttttgctggcaaaggtttacaagagccataaaaaagaagctgtgatagaaactttgaacaaggtaattgacaggtggactcaagctctttatctgccatctgctgatgggggctgaaggaggaggaaggagagagctccaggtctggaaagccccagacctcttccttaaaaaaggacctaggttacacctctgacatccaccttcacttattttcccgtcctggttcattcagttatggtacactaatgtgctctgagctgtggtgggctgggaaaggcaggaagtaagagagtgcctttgtcctcaagggtgatagtagagataataaggatggtaatgacaatagctcccatgcattgaaagctctgtgctaggttctgtagggtttttgctttcttattgaatgatcacagtagccctttgtaataagcattgtgacattcccatgtagcagataagtctctaggaggttgagaaatgtgcccaaagttgggttcagttgtgttagtctgtattctgttggtgtataccagaatacttgaaactgggtaattcatacattttctacagttctagaggctgagaagttcaaggtggaggagccacatctggtgagatcctttctgct

SEQ ID NO: 469 - DNA, 2637 bp, Homo sapiens
agcactgtatgcagagtcgagggcgggacagcccggtgtgtgaggcagatggagtgcagatcgcatcttggtgacctggaagtcagcagccgtgggtgtggagggcccaggagggctgaggaacctcggggcatgggggagggaggctggacaggagagggctcacccaggccctgtcctctgccccaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatctgtgagtatctcgctggcccacagcccgtggtaccctctgccctgggcagcgaagggagttgagaggcgtcggccgtctccacccacatggggcgaagcgtgttgggtggcaggagggttcaggtcactgcagtgtccgccagtgacacgcagcccacatggttcagggataagacacacagcgcagcaccagctaatctctcaggacgagggattccggaaaaccaggctactgctgccaagtaacaaaatcctgctggctgccaccagcggacacagcagacttacccagaaaggcagaaagaggcagaggcaggcggatcacttgaggtcaggagttcaagaccagcctggccaacatggtgaaactctgtctctactaaaaatacacagatcagctgggtgtagtggcacacacctgtaatcccagctactcaggaggctgaggcaggagaatcacttgaacccgggagacggaggttgcagtgagccgagatcgcaccattgcactccagcctgggcgacagagcgagactcttctcaaaaaaaaaaaaaaaggcagaaggagaaacccgccccccggccctgtgtgcagcggcagccccaggggtgctttgtcaccaagctcaggaccccgtcctcagcgcctgcaaatgtggccaggctcgtagaaaaaggccggggtgcttgcgggcctacatgctgatccccatgtcactgggtggcttggagaattcccgggatggcagcaacacaggcagggagaccccccacccctaccccacactctgatcaccgccagggtcatggtagaacatttgcctcaagctttgcagtgggatctgcattaactgtcattcaggacaccaagagcttaaagcaaacccccgtctctatcctgaaagcagtccccctccacagagtgatgtctctgtagacagtcccaggcgcgacaggtcttccgaggacccgttagcagattggcccctccggccctgcctgctgtgaacagtccaggcatgtgtccaggtggtggcccgggtgtggacctgcaggaaggcctgtcatccccccgttgcactttgctgagacaccagggcctggttcgtgtgccccaggggccgcactctgcctccccagggttctgaagcaggcgaggggtgggccgagtgggatgtggcacttccgcatttcagttgaagacagcgcctcgggcacccggcacccacatgcgcaagtacacaagggaaggttccttaaaatcccagcgctgggcagcggcgctgggtttggtgacagcagggctgggggagccccagctcacgcccccgtgtcccacgggtgcctacccagcccccaggctaacacagctgtcttctctcctgacagtctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttct

SEQ ID NO: 470 - DNA, 2636 bp, Homo sapiens
gaaccgtgattaaaaaggggaagaaccacaagtcccaatttaagtcagcagagctgctgtctgggcagtgagagggaaagtgcttgtggctggcagatttcagcagccatttggcattggctgggtaccgggctgctctgtgggtgctgcctggcagctgcatggctacagacaagtaactgttctctcttggccgcagtgtccccaggtataagaaagtgatcaaataatatgggatgatccattcagactttttttttttttttttttagagacagagcctacctctgtctcccaggctcgagtgcagtgatgcaatcttggctcactgcagtgtccacctcccaggttcaagcgattcttctgcctctgcctccccagtagctgggactacaggtgcgtgcaaccatgcctggctaatttttgtatttttagtagagacagggtttcaccctgttgaccaggctggtctcaaactcctgacctcaggtgatccgctggcctcagcctcccaaagtgctgagattgcaggtgtgagccactacacccggcctcgtttagacttcattgacattcccccaccccacccctcttcccacatcctcagatgccgtgtgaacagcttgaatcccacactccacaggtccttctcctcacaaccctccatggcaccctactgccttcaaaataattcccaaagtccccaccaagaccttcaagacaccatgtgatgggcccacctttgaaacatcatctcttaccagtataggtgtcaccactgcctttatgactttattccaaagcaccacatgtattcccacctcagcacctttgcacatgctgttcctttggcctggaatgctcttccctcagacgttatagcacctggatccttcttgtcatggagggttctaagctcacatgttagttccgcagaggtgtccttcctgagccctggatctaagacatccccttccagctctccatcccgtaactgttttgtcattgtcatagctgatcccacttgcttattcgtgccttatgtccccccactagaatatcagctccacgcaggcagggatatctgtgttgttcactgctgtgttcccagcgcctagaacagtgcctggaaatgtgcggaaagcagatttttgtggcctttttcttcaaggtcattggacaccaggaatcctgtagcagaccgctcccttcccccatctactcggagtctggaaatccccaccttctggggaaccccttcctgtagttctaaggtcaggactggggccgatttgtttaacacagagagcttcctggagccaagcctcgagctaactgctttaatgcattaactcacttaattctcactgccaggagagtgggtacacattatttccatttcataggcaaggaagtggagaggtacggagaagtcaagtcatttgcccgggtaggaagagggggaggcagtggaatggagacacttgctgcctgggaagactcgaggtggcccctccaagctgggggcgtgggcgacttgtttcctgttgggggagggggagaagagtacattcctccctccccgccctcccacatgttgggggagaggctggctgagagcatgtcccactccggactagggggaaccccactgtccgtctcagctccccatgaggccgtggagaaaatgtaagtagcccgggggcgggcaggggggtgggcgcagaggccacggaagccagcggtcggagagggcttcctggagaaagatgcacccctcctagaattgggggacaggacgggcggccggagcgaggctgggctatacgggcaccggctgtagcaaaggcaaagctgagggctggggccagaacccaaatcgggggcctggggccgtggcgggtcgggtcagcatgatcgcagatagtcagggtcgggcagggctgggctccctccctggggcgatgatgaaagccgtggtcgctattgcaccgcccagccctgcgggcactgataaggccctgcaggagggagtcagcaagggcgcgccccctggaggccaggcccctcgaccctgcccgccctaggccccgccccttcatctggccccgcctccaggcgctgaggcacctggtgacctgccggcgttgagtgggtggggctaaagtcgccccgcccctccgatcctcacttctatcttcagactgtgggacgcgaaatcgggtgggcacgtggtgggcgtggcttcgcaaggcctcgcctttttccggacccgcgccaggagagccctccgaccctggcagccgcggactagcgggattggtaggcggggccagtccgggctccgccctcatggcccgcccctccagccgaatctccgactcgcgcgcggcctgaggcgtggctcctggtggccccgcccctgccccgcccctgtcgcggccggcctcccccgccgggctccgctcgcacggccggttcctctttacataacggcgcggggcggcatgggcccgggccaccgcctccgcccggctgcccgcccggactgtcgcggcccgcggtggcgacggcggccgctgcaaagtttccccggcggcggcggcccgggggcgcatcctcccgcaactgtcaag

SEQ ID NO: 471 - DNA, 2596 bp, Homo sapiens
cagccttatgtgagaaacaagcagtacaaccagtgcacacatggtggtgctggcccgaggccagagcagggactcttcctctgcatagtgagaaggcagtgagaaggcaatgtgtggggtataaaggcaggcaatttgccagatttgctcatggaaaacggagttattcttttctgattgtttctattttctcagtgaattcagagtcaaagtgatcagctgagaatgagtagaaaggggctatggcagaagagaagttgtgactagccctcttgggatgggagagcaaatggactgggaaaaggtagtagagttaccaggccatggtgagggtccacttgagatgtatgtttgtaaatttaaagctaacaagttagtacaaagttgtgtttttcttcatctatgtttagctgctcagatgcaggcgcagagtagattaagagttgggtttaaccaaaattgaaggtttgctaggccagtccgacagagagcacaaattgcaaagtgtgtgcaagggattgcttatggtgaggcaccatggttaatctgatctggataaggagagaaaagaggtgatgaggtgtaacaaatgctaaaaacatagaggagtcagtggtggtctcagtgggagaaaaaggtgtgagggtactttaaacaggagcagggaatatagaggtggttggaaattggaatgcatgaaactaaaatgttggaggtggcatagacactgtaataacaaagtccacattatgactgtggagtgggaggctaaagtcatgtccatgaacacggacatggctgtgggagcttcagtgagaggctagggcaggtgaattatcttatgtggagattgacatctcacatccattgagatgactgatggtggagaggaaagtagtgatctatgtgcttaaattttatcaatgagggacagtggaacatgacagttagttgactgcaagaataagggcactgggtggcacagactgtagcatgtgctttaagacagcaggggttttgagaggaggaagaggagaaataccctggaagagatagtatgaagcaaagaggacacaggccttgttgtaagcatttaaagtgcattggattgacaagaagcaacaggtatttcagagaagagattggaaatgaagaatttcactgacgacagaactttgcaaaaggctgagtgtaagagcaggaggtgacacagcaaggtaggagattgagttagaacaccaacacaccaagatatatggagataagaatttaaagataagatggaagacctagatatcctggactgctgggggcacctagacattctctgtctgtaggaacatgaagtcaactatatcctcctaaagcaggaaccactccagctcttttctgtgttccctacacactcatattagacagggggttggtgatggggatgactgaatgaactaaggagtgaatgcatgactcacaaaaggtagaggaagattggtgctgtgggaggagtggagggagacattcatttggaaaatcagatggcaggagcctttttattgagtagtagaagagcaaagcagaaggaccagaatctggagtcaaaagacatggttgagttctcattctgcaacttcctagctgcaggtctttgggaaaatgactcctttatacataactctgacctcatctataaagtaaacctttcctccttaggagattgagcttcaaactgtcacctctttgaggctcctgtccctttactacaacactaatttcatcccacttggaaattgtgtagagctgtacaagtaaaagggtggacaataaacaggagaaatatagtaggttccacatactctaacgcccagcccttggcctatgtgccaacactcactcccaactccttgaaaagctactattaaaagagtttccctttggtttagaaagatgtttcttataatgcatagcacattaaaataataacaactaacaccacagagaggagtgtggaacacccagtgagagtaatacagataaggagccagggtctaaaacaagacacatagggttaccttgggatgtgatacaacaaggaacatcataacctcctgcttaggtagctgggcagaatcaaggctgccacagagcctgatggagtaggaggaacaatgcccagccattcccacacatgctcaggagcagggcagctatgtacatgttggagagatgctgtttgtctttgactcgcccgtgttctgagtgagccctttgacccagttttagaagcagactgagccacggtgagcagaggcggggcttagggaggcaggagtcttggggctttataaagtcctgccgggcaccactgggcatctctttcaaggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggtgagtcactttctgagaagcaccttgtaactagtaaaagatagtttttccctgctattgggg

SEQ ID NO: 472 - DNA, 2579 bp, Homo sapiens
ggcaaaacaagatggctattgacaactgtcgggtttgggtgatggtgtcatggggcacactgcctctctttgtgtatatttttaaacatgtccatttaaaaaggaggttggccacagtggcttacacctgtcatcctagcactctgggaagccaaggtgggaggatcatttgaggccaggagttcttgaccagcctgagcaatataatgagatcccatctctacaaaaaattttttttaaagtagctgagcatagtggtggacccctgtagtcccagctacttgggaggctgagaaagaaggatcgcttgagcccaggaggtcgaggctgcagggagccatgttgtgctactgcactccagcctgggtgagagagtgagactctatctttaaaacaatgaaaattaaaaattaaaaaaatttaaaattttttaaaaagttacaaggacgatataggatgtcataacgcctaatcaattctcatatcttcatgggtttctggacagagaatgtaccttcactttaccattagcctaagatcactcaaaacatctggaagttattattttaaaaagaatctcagaagtatgcctgcctctcactgttaaatatatgtgatggtgcagattattcagagcagtgttaaggcatcaacataagtgcagccccatggagtcagggacagaggtcaaggtgaagtgtttctttacctttgaagacttctggcacccaggcttacacctacacttcagctcggcaatccggatgtcagggaagtgagaggcgaagtttgaacccatgtgaactgtacattttgggacttgagtattcaggaacttggctctctttgatgagaaattacttccctcctccatcggctcagcttttcttcttccaccttccctttcctccctctctccctcctctttccccttcctctcttcttcctctttcccttcctctcttcctccttcctttcttccttcctccttttaagtcatcaccaccaccagcactacaaaaacctatagcatgttcatgtcagaacttctaaagagttgttgtaaagattaagatacaagtggggaagaaagaaatttaaattcattagaataattttgatcatcataattaaaacaatttttctttattatggacactttcaagcatataaacatctgactaatccaatgaaccccttgtactaatcactcaccttcagtaaagttggccaatctctatttcatcctttcatctttctccccaatcatgtccaccctcctcctgaccccacctgagattacttcagaacaaatccaaggcatcatattgtttcatctgtaaataattcagcagtatttataagagataatctctcttattttaaacataatcacaatactatcatatctaaaaaaaataatttgttaatattataaaatattcagtcagttctcaaatttccctgattatctcctttttattcttggtttgttcaaatgaggacccaaataagacgcactcattgcatgctgctgaaatagctcttgtcgctcatagtctgtaggcttccttgccctcctgttttcttgccgtttatttattgaagaaactgagctatttgttttgcagaatttttaccattctgcattttgctgattgcatcttcatggtatcatttaacatgttcttgtaattcctgtaattacctagaattcctgtaattacctgtaattcctatcagctgatagttatacctagaagcttgtcattattagtagcaatatcaaaaacttcacttttgagactggcaatttctacgtctgacatcttaccacagtgaacaaggcagcatcccaaactcttctgagtcaataagaaaagggtaactcttgcagtaatgccaagttcagtttctgttcactttgcaaaaaatgtatgcccactactagacccatgactgtcaactagaatgtgctgggcctcctctcctgtctgtgcatgggaatgggcacaaccaggtggaaagaacatgaacttgggagtcagatagctctagatgtgaattctgacttcaggttttatgaagtacatagcttgtctagtgaattcatatctccacttctcagattccttgtatacaaggataatgtctgtcttaccaggctgccaagatgtacctgacatgtagtatgtgttcaataattgtttcttttccagcttaggttaaaaatgggaattttcaagaaaccacaaacccacagagtttgtttagatccaaacacagatatggcatttgccagcctcataaacaatagaggaggctttcaggcaagccccaagaaagcatgttcagaaaggggaaggaacgtggggacaggaactattgctccccttctctctttgtactcagaaaatccaggaaattcttcctcaagaaagcatgacccatttcagcctaaaagcgtgcttttctctggactgtgctggcttgagaacatatttcttttaccaaaaaatgagttcacagtaagtgactcagaagcatatggatgaaatttcctttaagccactcaaggg

SEQ ID NO: 473 - DNA, 2567 bp, Homo sapiens
gccagctcatctagtctcctcacagccccctgggatgcggggatagggcgaggtattcccactgggacaggtgccgagagggaaggtgtctgcctggcccagggtagtaggagtgggtgctgggctcccagcactcggagccccggctgagtgaggctggccctgagacaggcagggaaggtcgcgccagggcttagtctcgccagccctccccagggacagagggagggcagcatgagcctacctcccagcctggcgtgcgtgggacgggcctgctgcctactgcctctggggaggcagaggcctggtgggtgtggagccctggccagggtcaccaggagtgggtgtgggcgacagggaggctgtgatgaaagcagacctggagaggcggcaggccgggtcccaaatgccaggctgggcaacagtgggggcctgaaggggctgggagccagggcgagggtaggacagacatgcacagccctgggagggaaagtagcggtgatagtatgcagccacccaaggcagtacctgtgacagatggcgctgttcccaccgtccctcaatgcatctgcattccacctgcctgggttccacccgtgtgctcctcactgtcccactcgggcacctccaggaggaactcccgtgagatccggtgcctgacaccccccgggcagagccctggcagcgctcccatcatcatcaacatcaaccgcgcccagctcaccaaccctgaggtgaagtacaactacaccgaggaccccaccatcctgaggatcgaccccgagtggagcatcaacaggtggggcccagcaacacccattccctatccccagctattgagagcagcgctgagccaggagctcttccactgggcacttggcggtggccctcctgcatgccgggtactatcctgccgggaagcaccccttgccaagagcttttacctgtttcctgtctttggggaaggcaggctttgcctggctgagctgtggcccacgtttccagctcactgggccccagcatcatttggtgacccccccacccctgtcctgttccagcggtgggaccctcctgacggtcacaggcaccaacctggccactgtccgtgaaccccgaatccgggccaagtatggaggcattgagagggagaacgtgagtccctgccctcagctgcccacctcggtccaggccttcacctgggatggggctcctgctaggaatacccgtgtccctgcccctgcccctacccctgccccttcccagcttatgccaaccttggctgtgcctggagacccctggggaggcacctgtcctgcctggcgggtagaaggtctggctctgggttgctggctgcacacacctctccttcaggccacatgtccctggtccacgtcgggtgggtggcccaggaccagccctgctagtgcctggcatcatctgtgcagggagcaggcagcccccaggccaggggctctgtcactgggagctgccgggccactcgcggaggtcccgcccagcatccccaccctgtgtctccagggctgcctggtgtacaatgacaccaccatggtatgccgcgccccgtctgtggccaaccctgtgcgcagcccaccagagctgggggagcggccggatgagctgggcttcgtcatggacaacgtgcgctccctgcttgtgctcaactccacctccttcctctactaccctgaccccgtactggagccactcagccccactggcctgctggagctgaagcccagctccccactcatcctcaaggtgggtcaccattgcccgtaggctgggccaagccagggaagaggcccctcgtcctgggctctggctcacccccatctcctacagggccggaacctcttgccacctgcacccggcaactcccgactcaactacacggtgctcatcggctccacaccctgtaccctcaccgtgtcggagacgcaactgctgtgcgaggcgcccaacctcactgggcagcacaaggtcacggtgcgtctgtccaccgggggtgcagagctgggagagccatgccccacctgtggaccctgccccactagcacagccccagctctgaccttgcccgagactcacccctagctcagagggcgcccggctccagtgcaggccctgccgtagccttcagcctgccacctccttgagccccccgagactgcctacccaccctgagcccttgccatgccagtggtgccctggctggccaggcgcctgccctgggtcccagtgtctccaccctggtgaccactctgtgcccctgtcggtgggacctttcccacaggcaggtgttgggggtgggtcttgcccatcgggaggggctcccaagctttgtggaaagcatgggaagctcctgagtggcctccacccactggcaggtgcgggcaggtggcttcgagttctcgccagggacactgcaggtgtactcggacagcctgctgacgctgcctgccattgtgggcattggcggaggcgggggtctcctgctgctggtcatcgtggctgtgctcatcgcctacaagcgcaagtcacgagat

SEQ ID NO: 474 - DNA, 2558 bp, Homo sapiens
ttttagtcagcactgggtgtgaagtgggccctatgctttatgggtaaaatcagagaaagtggatgccactctgtccttaggaaacccacagagaggagagacagtacgggggccaagtgccataatggagtcctgtgatagtgcagaacttcaattagttctgattagggcacagtttctacttctaggggccatccagccgacctcaggggtttcaggtcagcttttcatcctcaccccgcccccgcccctgggataaaagacccatattgcctacagttcaaacatctgcctgattatcctagcagagtggtaggaactgattttctgatctcctctactacccgcctcacctgcacagagagtaccagctgtctcagcctagcttcttcagtgggccttggctgtaaaatgtgtgtatccaccccaggtaattaggttagctctttgtgctcgtatgactgacccctaccttttaggccacctggtgtttgttctagaagttattcctataaacagattttcacctaaaatttgaatctttatgaatcaaataaggaaaattttaagtaaacttgggctgtggataactgatgattcattaccaaaaaggtagtcatttaaaattataaaatgacacaaaaaatttaaatggaaaacatcctgtttatgcttggtcaggtctttgagttgatgtgactcaagtaacatctgatcattttcttaacctttttaaaaagactcccctaaattcttcctcccaaagattttactgtgtttgttcacagtgggttctgtgaaaggattattacaagcccacaatccattatcctcaattctacaaatccaaaaaattctgaaaaccaaacattctttttgtaactcattcatcagcaaaaccagacctgaaccaaagtgaccctattcatattctttgattatctgtcctactgggacatatatggtttgctgcagaaatattaatgtatttaattataggatactgccctagatagttcatatatgtggtatatgcaccatactgcttttctaaattaaaaaatctgaattctaaagcatatctacttccaaacatttaaatcggacttgtggacatatgtaagtataaagcagcctttgcagagtggtttaaaaggctgctttactattgtggggagcttttaattttgataaactagtgagttcatgtaaataaaacataacaaaaacactaatccttaattttctgttaactcgagaatacccagatatgatagttttgtggctaggggttagacatagaaagtgtaactatgaatgcatgtatctgtttgacttcttgtacccccaaaataaaggctaaaataaatataatcagctaaccaaagctatagccacagtcatatatactgtgtaagaaaaaagcctctgatggaggttgcagtgagccgagatcatgccactgcactccagcctgggcgacggggccagactgtctcaaaacaaaagaaaaaagaaaaatgggaattgtgtaagcattcatgtataaaaaaatgatcaaaaatgttacactggcctggtgcggtggttcacgcctgtaatcccagcactttgggaggccgaggtaggcggattgcttgaggtcaagagttcaagatcaccctggccaacatggagaatccccatctctacgaaaaatacaaaaattagcctggtgtggtggtgggcgcctgtaatctcagctacttgggaggctgaggcaggagaatcgcttgaatccgagatgtggaggttgcagtgtgccaagatcgcaccattgcactccagcttgggcaacaaagcgagactccatctcaaaaataataacaatgttacactgtatcttgtacatttttagtgggataaatgccaagagcagttttattagttcttgattcctccacactttaagagaatataagttcgtctacccatgattttaagaagcaaagagtgtgatgtttcccacctacccacacccccttaaaactattcaaatgaaaccatttaattctttaattatagtggaatagaactgacctattttctgtatgatcataaagaaatatttacttttaacgcagaaatttttttcttaagatccacattttccagcttaatgaagtgattgtgtttttacttggactcttccctttcctttttccttgttctgtgcagattatcaacgcctgatgactgtggcagaaggcatcaccacacttttgttcccatttcaatggcaacatgtttatgtgcccattctacctgcttctctgctacattttcttgatgctcctgtcccttatctgatgggccttcagtcaaaagaaggaactgaccgttctaaactagaacttcctcaagaggtaaaactacaatgaatgatgaagcatttgctgtttgctgatttaggtcaaggcgactttcgttagattgcattgtctttgtcaaaattttatctgtctctttgactctcctaaatctccaagtatggctaggggagagcctgagctatagaa

SEQ ID NO: 475 - DNA, 2537 bp, Homo sapiens
tgtatatggaaatgccaaggacctacatagccaaaacaattttgaagaagaataaagatgcaggaggagtcacactacttgattccaggatttactgaaaaatgatcgtaatgaagacagtgtgacacaggtgtgtggagggttccctcgagggacagaactaacaggagaaatatatatataaaggggtttattgagtattaactccacgatcacaagtccccacgataggttgcccgcaagctgaggagcaaggagagccggtcccgagtctcagaacggaagaacctggagtcccatgtttgagggcaggaggcgtccagcacagaagaaagatgcgggctgggagggtaggcccgtctcccctcttctcctttttctgcctgctttatattctctggcggctgatgagatggtgcccaccagattaagcttgggtccgccttccccagccccctgacccaaacaggaatctcctctggcaacaccctcacagacacacccaggatcagtactttgcatccttcaacccaatcaagctgacactcagtattaaccatcacaaggcgtgaggacagatagctgcatccgcaaaatagagaaccaagaaatagtcccacaccaaagtcaggatcaaatgattcctggacaagccaccaagtcaattcaactgagagaaagaagcctttgcaccagttggtgctggaagttctggatatgcacctggataagtgaacccccctccgtcaccacacacaaacgttaatttgagatggattgcaaacataaaagctaaaaccattaacacttcttgaaggtaacatagaatattttgtaatgttatgataggcaaaagtctcttaggacacacaaaaaaattaaccataaaagaagaaaatggctgggtgcagtggctcacacctttaacaccagcatgttaggaggctgaggcaggagcgtcccttgagctcaggagttcaagcccagactgggcaacatagtgagaccctgaaagaaaaagaaacaaacacatacattggacttcctcaaaattaaagtcttctgttcttcaaaagacaccaccgagaaaatgacaaggcacagatcaggagaaaatattcacaatgccattatgcctgacaaggaacctgtatctggaatacataaagaattcataaagttcaataataaagataatttgattttttaaagagggaaaggattttagcaggcacttcacaaaaggaaacatgcaaatggctctcacggcacttgaaaaatccctcagatgcactggctattagggaaatgctgagcgtatctacattgagacaattcctccccccaagaacagctgaaattaaactgagatacttcctcctcacaagaacggcagtgcagaagtcaccaccacacagcagagacgggcgtcctgtgggcagtgcagagttcaccaccacgcagcagagacgggcgtcctgtgggcagtgcagaggtcaccaccacgcagcagagacaggcgtccccacgggcagtgcagaggtcaccaccatgcagcagagacaggcatcctgtgggcggtgcagaggtcaccaccacgcagcagagacaggtgtcctgtgggcggtgcagaggtcaccaccacgcagcagagacaggcgtcctgtgggcagtgcagaggtcaccaccacgcagcagagacaggcgtcctcacaggcagtgcagaggtcaccaccacgcagcagagacaggcgtccccacgggcagtgcagaggtcaccaccacacagcagagacaggcgtcctgtgggcggtgcagaggtcaccaccacgcagcagagacaggcgtcctgtgggcgatgcagaggtcaccccacgcagcagagacaggcgtcctgtgggcgatgcagaggtcaccaccacgcagcagagacggccgtccccacaggcagtgcagaggtcaccaccacgcagcagagacaggcgtccccacgggcagtgcagaggtcaccaccacacagcagagacaggcgtcctgtgggcggtgcagaggtcaccaccacgcagcagagacaggcgtcctgtgggcgatgcagaggtcaccccacgcagcagagacaggcgtcctgtgggcgatgcagaggtcaccaccacacagcagagacgggcgtccccacaggcagtgcagaggtcaccaccacgcagcagagacaggcgtccccacgggcagtgcaaaggtcaccaccacacagcagagataggcgtcctgtgggcgatgcagaggtcaccaccacgcagcagagacaggcgtcctgtgggcggtgcagaggtcaccaccacgcagcagagacgggcgtccccacaggcagtgcagaggtcaccaccacgcagcagagacaggcgtcctgtgggcgatgcagaggtcaccccacgcagcagagacaggcgtcctgtgggcgatgcagaggtcaccaccacgcagcagagacaggcgtccccacaggcagtgcagaggtcaccaccacacatcagagacag

SEQ ID NO: 476 - DNA, 2522 bp, Homo sapiens
ggggtaataataaggcatcagcctggatgggatagaaaattcttatggcagaggaagtgaaactaaagcccacttgcagcagacattagaagtcttccagaacagtctaagggtggggttatggctccctgggcctgcatgactcccctaaaacactcaccctcactccttttcccagtcccgccttgactccatatgtttcatcaaacatatcttggatttattatctataatcttgttaattgtctggcttgagatttagaatttggtcatctctgtgttctctacaagctcatgcttgagcatgcatttcctgtttcagattacaggactgcattttaatttcttgatagaatgcctgatatagccttacctggcacagccttacctgcagaaagttgtgtgcacaatgacttttgatgatgcctccatgatccttcactttgcatgtacagacacagacacggagatgcaaactcctgcatcctacaagggtcatctgcaaattggcttatcagttttctcactcctctgtctcctctgcggtaccagccctttatatgccaggcactgagaagcaacctaattacaggcgaggagacagggagggagcaggccataggctctgtccctcaagatgtacccacatagaagaaactccaggtctgtctgggttttctggattaaacccagattcaggtattggaattacaattcagtttgaagataatttaacatatccctcacccatctccctcccagaacctcccagcagcagcaaaggtgagcttgacttttttttttttttttttttttgagacggagtctcacccctgtcacctaggctggagtgccgtggcacaatctcagctcactgcaacctccacctcccgggttcaagcgattctcttgcctcaggctcccgagtagctgggactacatgtgcatgccaccatgccaggctaattttgtatttttagtagagatggggtttcaccgtgttagccaggatggtctcgatctcttgacctagcgatccgcaggcctcagcctcccaaagtgctgggattaagcgtgagccaccgctcccggccgagcttgactcttttttttttttttttttgagccggagtcttgctctagagtgcaatggcacgatctcgactcaccgcaacttctgcctcctgggttcaagcgattctcctgtctcagcctcccgagtagctaggattacaggcaggcgccaccatgcctggctaattttgtatttttagtaaagacgtggtttctccatgttggtcaagctggtctccaactcccgacctcacgtgatccgcccccctcggcctcccaaagtgctgggattacaggcgtgagccaccgcgcctggccgagcttgactctttagagcatttccttcccttcctgtcctgggccagagctagggctggagccaaaacaagcccagccctggctcctgtgcctaaatttgtagatttcaccaccaccacgcctgtcctcacacctgcttccattccagggaccttaacaacttctagaatccatcaggagggcagcagtgagggagctgggaacggtgatgtggaaatcgccctgggtttgggagtgggaatgccccagccctaggcccctctgtgccacccatggctacatatcctaggtcatgttgctcctccagagcttgtgtggcctcttcctatccttcagggcaggacttatgtcgtccgctggggaggccctcccccatctaagttggccctctctgtgctccatatcattgccccctccttgacttcctttcgcaatttatcacgcgcatatgtatgtgtatgcataaacagatataattttgtttgctcgcttatttggttcgtcgcctcactagattccggactgtgggctccaggaatgcagacagtgtgcctttgacccttgcatcctcctcagagcctggcagagtgccaagtacataggaggagctagaaaagtaattcggcgaatgaataaatccatgaatggcagctgaccccgatgatctctcaggtttctgccagttgagaaagtgtagcagtgccctggacggggaggcgggcggggcgaactgcgagctcctgccccttcccagggctcaggcgactgtggaccccgatcagcgcaggctcgcggcccgctgtggccccgcctcctggccgccagccgggcggagccaggccgccccccaagccgggtggccttcggggtgcttgcccggctggaggtggtgagggggcgggtccaaaggagaggtcaatgggcggggcggggccacaacgcccccacgtccagagccggcaggcaggttccccgcggggggccggggccgggccgttgcctagcaacgccgagccccgcccggccggcgcgtgcctgcccccagcatggcttggcagggctggcccgcggcgtggcagtgggtcgccggctgctggctcctcctcgtccttgtcctcgtcctacttgtg

SEQ ID NO: 477 - DNA, 2495 bp, Homo sapiens
tgtttcaatctccatgtattggtgagaattaagagacttgcagttcgccatgtcctgtcatgttagcttattttgtagggaaatcaaatctggcacctttcaattaacttctttacctctctaatctaaaaacagatagaatacattctggagcaagaaggcatgattactatctgtggattgccttgacttcctcaactgtgtcttctgtcatttcgaaatttgctaaaagacctcctataaaagcaggaaagcacagacggaaggaaggtggtgctgttgaaaaataatttacccctagtcgtgagcttggcaactcttcaagggatcacaatggtgtatctcatctggacctagaggtctcgaaggaggagataagtggaaatgttttgtgggctggagcttagtcattctcctcggtgacttgaggtgcaagctattttggaggaagataaagaggaagggagacaagaagtgggaaagaaaaaagtctctctgccttcatacatgcttctgttcactacgtttatactacttttttttctttgaaaaattttttctttgaatttcttttttttctttgaatgattgttttaaatcatgtggtaatgtggtcatgacatatgttaggtaacaaaaagaaaaataatgattccaattttgttaagtatatgtatagaaaaaaggaaagtaagcaaatcgatcagttatctttgagtgataatataatgaataatctttatcaccttcatactgtgttctttatattttattctctaaaattttccattaagcatgaataaggttttgtatcagagttttaaaatacattttaaaaggaaatggcaacttattcagctacagcttttttataacatagtatatgaaagttcatatctagtaaatgtatttggaaatataatacatttggaataacttttctgtaaggatgcatctttttaagtgactttattagtctccatgttgcatttttaaatatataactctgcagggcttcacattttccccttcacttttgctagctgtcagtcatcacctctaccttgaaactagtctatgaccagtaggatttgtagataattatcattaactgattgagtggattcagcagtgtgcctgttgtaattaagtgtttggatatgcaaatagataaagaatagataaaagagaaggtactgattaggatgttaaattcacaatatgatggttgatagtgacaggtaatagcatgatgtccttttgaagatactatattaattatttcttgaataccttttcaagtaagttactgttatttgaaattccacttaatgccagccctggcccctcaacatttcatcccaatctcgttgtttttgaaaggctcagagtcatattgggcacttctttcattactgcctttaactgaccatttcctcttttctttcctgcaacagattgcagattgagcttaaccaagaagttcgtaggctaatcaaggctggcttgacctacaaaagaagaagagagttctgcctgcccacttgggcttgtgttgacacggctgataacttgccatcacctgttgccagtgtggaaaaattctccctgttgaattttttgcacatggaggacagcagcaaagagggcaacacaggctgataagaccagagacagcagggagattattttaccatacgccctcaggacgttccctctagctggagttctggacttcaacagaaccccatccagtcattttgattttgctgtttattttttttttctttttctttttcccaccacattgtattttatttccgtacttcagaaatgggcctacagaccacaaagtggcccagccatggggcttttttcctgaagtcttggcttatcatttccctggggctctactcacaggtgtccaaactcctggcctgccctagtgtgtgccgctgcgacaggaactttgtctactgtaatgagcgaagcttgacctcagtgcctcttgggatcccggagggcgtaactgtactctacctccacaacaaccaaattaataatgctggatttcctgcagaactgcacaatgtacagtcggtgcacacggtctacctgtatggcaaccaactggacgaattccccatgaaccttcccaagaatgtcagagttctccatttgcaggaaaacaatattcagaccatttcacgggctgctcttgcccagctcttgaagcttgaagagctgcacctggatgacaactccatatccacagtgggggtggaagacggggccttccgggaggctattagcctcaaattgttgtttttgtctaagaatcacctgagcagtgtgcctgttgggcttcctgtggacttgcaagagctgagagtggatgaaaatcgaattgctgtcatatccgacatggccttccagaatctcacgagcttggagcgtcttattgtggacgggaacctcctgaccaacaagggtat

SEQ ID NO: 478 - DNA, 2475 bp, Homo sapiens
ctttcccactttcagcttccagagtctggcatgttccccgggcctccccgctgctgaccgcctgtcctactcaggccgccctggaagccgacaggtgaggctccctgggggaggacaggctggaggaacagaagcacctcccgttcctgtgggttgccagtgccccgggactgcaggcggccaggcccacctgggcagccatggcctccttctcctggccacaggcatgctctgctcctgagccagggaggccatgcttctggtcgtgggccacctgtgctgtgcccaagacctgcccagcagtgcccagtagcccgtccatctcctgcacccctcccctcatccccctcccctcccatcctgctgacttcctccctgcccagtatgtttctcttgggctgtggctgaaatagtttcgctgctgttgttgggatgattccctttcgtctctggctgcatctctcgaacacattcctccccattccaagacccgggcctgcctgactcccacccacaccctcccttcctcctctgactcagcccagagatgccccagtgggactgcggttctgccttgagcgctcttggcttattctgtctcctcctccccctacccccgccagctcccctggactctctttcagccaggtcccagtggcccctggtgacagcctaacccccttcctgggtggtatttctcctcttcaacggtgggggatggtgagggagtgaggcagccaacagccctgggccgcagctgctggggacggcgtggggggcacgtccagcctttggggtgatggggatatggcccagctgctgagccctacctttgggttgattctgcattccagaaagcagagcctttgggggtggccagggagggcactagaacccagaggctctggaggaggaaggagcaggatctttctgggggccttccgaacagcggctgcctagtgacccgctgcgtgcccacccagaggccagcctggcactgtggccatagagatatattccatgggtccccttgttaaggaattgaagatgcagttgtagagataaggcaaacttgcaaaacaattttggagcaattaggcactaagcagtgtggtattaattacaaaagcaggaggcgttctgggaggggaggggaaggaaggctgtgtgaggagtattgctggacgttagaggtggtggtgagagggtttagggaaggatgagcaggaggcccgacatgctgggagatggagaaacactggtccgggcgacggctgatgtattggggctgggggattttttagggggaacctttgttctgagatgagccaggaatgagcttgtttcaagagggctggtcagtgtcagtcctggctctgttccgcgacacctctggtgggctgtggtctcagcaggacccacgtgctcaagggcaagccttcccgagcttccccatcgtgttgcccccagtccaggaaaatgaagggtgtgggaggtacagaggcatggctcccaaaccagcggcaacacctgagaacttgttggaaatgcaacttcccaggctccagcctacacccgctgaattgggcatggggcttgtgggtcacgagcccagagctgggtgtggggagactcacttgggtcggtcccacctctgcctgacgacttggaccagccccccttcctctccctgggcctcaggtcagactagacgctctgagttcccttctctgaccttgatgactctgctcattccttcggcaaatatttgtcgagcagctgcttcatgtcagacactcatctgggctctggggatgcaatcgtggaaaaacagagtgacacctctgaccctatggagctgacgttctagtctacaaatgaggctgtggtcccacgggtgcacaagtctcagggtcccacagctgccttttgagaatcactgtgtagctgggtgctgtgacatgtgcctggagccccagctactccggaggctggggcgggaggattgcttgagcccaggagtccagaccagtttgggcaacatagtgaaacccccatctctttaaaaaaaatcgcttatacttgagagtcttaaaggctctaagaggtcccatgagaaagaaacccacttaatttttctttatatcctaaacttgttgaacagcagaatttctcctgaatttctacccctgaccccctgccctgccctgccccacccccaggaacatccttgcgttccccagcacacatttcgagaggtgttggctacagacaagctcatgatgggcaggtgaagggggagcagctttcctggatttggagataaaaggtctcttctgtgaaggcaagggtcgctaacccctaaccgcctgggaggaaaggaaggagagaaagacattgtctctcccagtcggggagctggtctccttttctgggctgggcagtctggtgggagtgtgtgagaggaatgctgtg

SEQ ID NO: 479 - DNA, 2447 bp, Homo sapiens
gataaacagacaaaagggagggctagcagttcagggagtctcctggaccccacagttcaaggaggccaggaagacctcctagagcaccttgccctggcagccaaggcagtccctattttctttgatccacccagacagccacacacccccaccccccaaagggctgaggagcagctactgtctgcatagtcctggacgtcgtggaagtccacacgtcgacgcctccggtcttcttccagcaggtcactcttggtgccacataagtagatttggcagccctgaggcagaagacaagggtcacctccacaggccaacaaaaccccagcccctagtgttctagtgaggtctgttcacctacctcctctaggctgcgcagttccttcacccagaactttgctcgctcaaagctgctgctgtctgtgaggtcttggtgtgcggcatgcaggagacaaccaagtggtcaagggctgttctctggctagcctggcacccatcttttcttgtgagacagcccaaaccccccccccccttaccatagcagacgatggcagccttggcaccccgatagtagattctactcatggcctcatagcgctcagagcctgctgtgtcctaaagagtaaggcctgagtcaaacttaaggccacgttctccagaccccgctattttccagataaggaaacgggtctatgagaaatgggtctgtgaggccacaaatcaaccagtaataggcaggacctacacctcctcaggaatgagtctcccaagaatagatggccgggggacttacccaaatacctaatgtcacagtccggtctccgaccgacatcaccttggccacgaaggcggccccgatggtctgcaacgagagggaagagatcggggccataggtgcagattaccggccccccactcccccgcccaccgtgcctggcccctccggatgcactcacgttctgataaggccccaccagaaagcggtcgtgcacgtagcgctccaccaggctagtcttgcccacgtactccttgcccagcatcaccaccttgacgtccacgcgctgcccgctcatgctcccggggccgcttcagccacgtcagggtcctgagcggggacgggaggcaaaccccgatctccgctcggcccaggcagcgcccaagcctcagaccccgaccccaaacggcgccaacctacgactccagacagcgcgtcgggctcgagctctggccgtggccttgcacttcggcagcgccccgtgtgcccccgctgttcggccccgggcgccgattatccttcgaagaccccaagcctcggggcggcctgggagcgcgcgggacagcgtcctcaacagcgcagcacgccgccgtgcagctcgctactccgtcattcgctcgcctgcccggcttaagctccgttctggctgggaatcccaaccgaacctggggtctcccgcaacccggctcctacccgcagcgccgcgactcccgcgggagggggctagagggcgagggggcggggccgcaaggtcacgtggcgcgggcgccggaagcggtggctactgtgtggctgcgccggaagtggcgcgcggccggacaactcatggcggcggcggcggcggcggcagctgcttgggcgcggtgcggtggtgactgagctacgagcctggcggcgggtgtgcgccgagccccggcccggcccggccctcgcgtgcctcccaggctccgcacccctgatgctgcgcgggtgctgagcccgcttcggccgggacgatggtgaagtatttcctgggccagagcgtgctccggagttcctgggaccaagtgttcgccgccttctggcagcggtacccgaatccctataggtacgtggtatttggaagagcaaaaccgcgccatctcgctatctggagatcgaattatgggtaacccccaagtactgggaccaggaaggactcgatatcgaatcctaggtagaccttatcggggaagcggccaggccaggcctgcaaggtcctgaagggaggttgggcctgggtggtggtttacttgagaccttagtgtaagattcttttctcagtgtggtgagacaagaagaggcggcagtatgggagttgggagggatcttggagttggaaatcctatttctctgcccgtggcgctttcctggggtgcaataaatcatgaggtccattcctgctagaaggcaggaatccaggtcagtcagatggcgggagtgggaatttgccctgggatgggcccttaactctggtttgaaccatagcacataccaccctgcaaggttacgggaaggcgtggcctctctaggcccggagcctccaaatgggaatcccctcgggcagtctcttaggggcaagcttctgagggtcaccttcaccctgacacctgcagcaaacatgtcttgacggaagacatagtacaccgggaggtga

SEQ ID NO: 480 - DNA, 2419 bp, Homo sapiens
gaagaaaacaagagccacctgaaaataaatacaggctcttttcgagcatctgctgaaatactgttacagcaatttgaagttgatgtggtaggaaaggaaggtgacttttcttgcaaaagtctttctaaacattcacactgtcctaagagatgagctttcttgttttattccggtatattccacaaggtggcacttttagagaaaaacaaatctgatgaagactaaagaggtacttctaaaagagatttcattctaactttatttttctgcgcatatttaactctttcctagcacttgttttttgggatgattaatagtctctataatgttctgtaacttcaatattttacttgttacctaggttctgaacaattgtctgcaaataaattgttcttaaggatggataatacacccattttgatcatttaagtaaagaaagcctagtcattcattcagtcaagaaaaaatttttgaagtacccagttaccttacttttctagattaaaacaggcttagttactaaaaaggcagtcctcatctgtgaacaggatagtttcgttagaagtataaaactcctttagtggccccagttaaaacacacataccctctctgctgctttcaaattccctagcatggtggcctttcaacattgattaaattttaaaatcctaatttaaagatcaggtgagcaaaatgagtagcacatcagtaattcagtagacaaaacttttgtctgaaaaattgctgtattgaaacagagccctaaaataccaaaagaccaggtaattttaacatttgtggaatcacaaatgtaaattcataagaagctctaattaaaaaaaaaaagtctgaagtatatgagcataacaacttaggagtgtgtctacatacttaacttttgaagttttttggcaactttatatactttttttaaatttacaagtctacttaaagacttcttataccccaaatgattaagttaattttagaggtcacctttctcacagcagtgtcacttgaaatttagtagggaaggatattgcagtatttttcagtttccttagcacagcaccacagaaagcagcttattccttttgagtggcagacactcgacggtgcctgcccaactttcctcctgagtggcaagcagatgagtctcagtaattcatactgaaccaaaatgccacatacactaggggcagtcagaaactggctgagaaatcccccgcctcattcgcccctctgctcccaggaactagagtccagttaaagcccctatgcgaaaggccgaattccaccccagggtttgttataacagtggccagtctgaaccccatttgctcgtgctcaaaacttgattcccacttgaaagccttccgggcgcgctgcctcgttgccccgcccctttggcaggagagaggcagtgggcgaggccgggctggggccccgcctcccactcacctgccggtgcctgaaattatgtgcggccccgcgggctgctttccgaggtcagagtgccctgctgctgtctcagaggcatctgttctgcaaatcttaggaagaaaaatgtccctagtagcaaacgggtgtcttctgtgcataaataagtacaacacaattctccgaaagttcgggtaaaaagagatgcggtagcagctgccctgtgtgaagctgtctaccccgcatctctcaggcgctaagctcagtttttgtttttgtttttgtttttttaaagaaaagatgtataattgcaggaatttttttttatttttttattttccatcattctatatatgtgatggtgaaagatatgcctggaaaagttttgttttgaaaagtttattttctgcttcgtcttcagttggcaaaagctctcaattctttagcttccagtttcttttctctctttttctttgttaggtaattaaaggtatgtaaacaaattatctcatgtagcaggggattttcatgttgagaggaatcttccgtgtgagttgtttggtcacacaaataaccctttctcaattttaggagtttggattgtcaaatgtaggtttttctcaaagggggcatataactacatattgactgccaagaactatgactgtagcactaatcagcacacatagagccacacaattatttaatttctaactctctgtggtccctagaaaaattccgttgatgtgcttaggttaaagttctgaagatacccgttgtacccttacttgaaagtttctaatcttaagttttatgaaatgcaataatatgtatcagctagcaatatttctgtgatcaccaacaactctcagtttgatcttaaagtctgaataataaaacaaatcccagcagtaatacatttcttaaacctcacagtgcatgatatatcttttcattctgatcctgtgtttgcaaaaa

SEQ ID NO: 481 - DNA, 2300 bp, Homo sapiens
tggtcatcaggatgtgaggcggtgacggacacttcagtgctctgacgcactgtggccccggggaagcgtggtgtctgcagcctcctgggccttcccttctgcctggcttcctcctcctccacccgtccacctgtgtgtctgggtcaggctggcttctgcatctctgtggacagacctctccccgtgctgcagctgttttccttgggttgagcactgaaaagagcccctttgggttaggaggcaggtggacttccactcacatggaggaggagcctcctctgcccggaggagacggtgctgggagaaaatgtagctgcaggtggagattttctgataaccaagagtggatgttgtctgtttactgagtggaggttggggccggtgccagggttgtccatctcccctctgtcctgcatggcatggtggcagagataccaccatacttcagaggcagcagcaccctcgccgggtgccggatctcccagggtccacctgtgctgccctgccctggggtatttggagctgagttccaattaagccaagaaaaacagattgttttacttagaatttagaaattctcctttttttttttttgagatggagtctcgctctgtcacccaggctggagtgcaatggtgtgatcttggctcactgcaaccctgcctcctgggttcaagcgattctcctgcctcagcctcccgagtagctggaattacgggtatgtgccaccgcacctggctaatttttttggtatttttagtagagatggagtttcgccatgttggccaggctggtctcaaacttctgaccttatgtgatccgcccgcctcagcctcccaaagtgctgggattacaggcatgagccattgcgcccggcctagaaattctcttcataaaacgtgtttgagattggcacaggaagtttcaaacagaatcaggattcaccataagaagcagataaatacatttgaggcacccagggtgagtgatctcagcggaattcccctttaagcttcctagtagcgcgtgcaaaaaggaaaacgtgtggatctaagactgtgcacaaacaaaagctgttcttctgggaggaaccaatccctcagcaatcacacttgactccctcgaaggaaagctggaaggggagagggcgtcaggatgcaggtcccggtgtctctgtgcagctcatcctccttcagaggccgctctgcttctgtccatccctccaattgccagtggtgtcagcatttggggccgtgatcagatggaggaagactggcaagcagtcacccccgacaggactctctggctcagcctccccaggaatatgctgctccccaggcacagcggaagacctgctgcgtttcatcttccggctgcctgtttaaagcaagggaggccatgcccccagcggggtcccttgtgcctggacccaaggcaagaatagctcaggcttgttcctttttcctcaagttcctctcgggcgggcacggtgtgtcgcctggacctgcatgtaaacatcagggcggagcaggaatcggcctccaggagggtaattgcctggcgtactctgtcccaggtagtgggtgaaatgaaagtaaaaagccagctggtccctcatgcagattttaggggacaaagttcagcatagaaaggtcctgttacaaggagagggttgtggcgagcccagggcagcgcgcgtcctccccggcagctgatcctcgccatgggggacggaaaggctgtccggatttccgtggcggaaatgaaaagctactacctgtattctgagtggtgctcctggctgctgtccgtggctgagggtgagtctcctcgtcccctgtgagtccctcgcaggtggtgtgctcggagcagtcgaggcggcctctgggtgaggcagcatggaggtgccctctgtggatgccccgtgctccacagggcagtctgtgtcccctgtggaatttgcagtagctcagggagtggggatgagaagcaaatgagcttttcaccctaaagttatcatctgatcctaatttatgtcacagttaccaaaagcaaataacctccttttgtctggcaagcctgagcctcacaaactgtgcaaacagctgggggctcagcctgcaccaggctgccccgcgtcttgagagctctgatgtcccggggccatggctgcaggtgcaggacagagacaaggccgtgaccgaacactttgctggtccccttgaccatgggacacccggtgacgtgcctgaggatcggccccggcacaccgaagcccggtttatgcagagcttcccacg

SEQ ID NO: 482 - DNA, 2300 bp, Homo sapiens
actacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatggtgagtcccatgggccgctcctcttttcccgggcttgtgggggtccctgagaggcagtttgcaggggtcttgtcacccctgcggtctcttctggttggacaaatctaagattctagaaaagacagagacagaagctggttcagagcctggggagatggaatccaaacccaggctctgaggttggtgagtggcagctcctctccagcctggtccagcattttcacctcgtttccacacacagcatccaaggcgggcacttcttgcagcagagggaaaggaatgaggctccgagccaggccctgctgcaggggtggtttgaattgagggaaaaaaagtaatcatatgtgagagtttgtatgcgtgcgtgcgtgcgcgcgcatgtgtgttgttggtcttggacttggcagagctagagcgcctccccctggggcaggagcaaggcagtgcttggcctccacctgcctccaggccagggatccaggaagcgggatctgcatccggttgacccgctcttcctagaggtggtcctggtgacagccattcctgagcagcagaaagctaagaggcattcctcacgtgacctggccttgcccacctcttctggacgcgggagatcaggctgggatcacaaggttctgcttgggagccaggcgcctgcttgctaggagtaggaccatctgcccaggcttaggtgggggcctgtgtgaggagccacgtggctaacaggtgaactcagaggctgcttgttgcctcagtgtgaccaacagtggacctcaaacacagcctggaatttgcaggacacctgacaagaaggtgggtggaggggggcgtctgctgggccgggcagctcctttaggtggggacgagggcagaggcgctgccttcactgcctgtcctggtggtggggactgtggtgcagcctccggccctgccctctttgtgcacagctgggggaggttggagggtgggggaggggtgttaaggtgcacacagccctaggtgccctcagagaaggccaggagctgcccagggtccccagggaacctggctttctcctccggttcctgcagctaggctcctgttacaagccgtcagctcacatcacctctccaccaaggtgcctccttgctgctggggcaggaggcctcacgcacaggcggatgcactcacgttccctctctcacctcccacagccctgctggtttaccgtgtcttcaggaacgaagctaaacgcaccaccaaggtcctgcacgggctgctgcacatctttgcgctcgtcatcgccctggttggtgagttcccgggcgcggccttccccgccacctgcctgcctcttcaggtatggcaaacagccgcttcacctgctctgttccctccccagagctgtgatgggcccgcccccaccccaaacatcccctgcagggccactaggtgctggcagccctcgagctgggactaaagcccagaagtcccgctagctggttcccctgggtcatcttacaccttccttttccacatccaaccctgtcctcatatgacctgtctctggcccaggcttggtggcggtgttcgactaccacaggaagaagggctacgctgacctgtacagcctacacagctggtgcgggatccttgtctttgtcctgtactttgtgcaggtgagtccttccaacaccccgggcctggggccacctaccagggaggtgggaggaggaggggagctgggctgaaatgtacctcatggaagggcctgatttctggggtgtgtgcaggtgagagagctgccttcccaggcctgtgcgggtgcaaagctaggattggcggccaagggtgcccagctcccaggcgccccatggctgactcagcacttttggccacaagcccagctttctgagtgtgccaaggcctcaagcgttgggggaccggtcccttgtccctaagcgcttagtgctcctcccaccactgtgctgaggaggaaggaaaccaggcagggctgaggggctcacagtcgccacgtgggcacgtgggtgtgggcctggccgacctcggctgctggggtgtccggccgccctgtcccggaaccgtctcctttcaaatcctagtggctggtgggcttcagcttcttcctgttccccggagct

SEQ ID NO: 483 - DNA, 2299 bp, Homo sapiens
aggaacaacagcatacccaagagggttgccaggcagagttatctaactcagggtccatgtacaaaggcaggggtcaggttgaaggagacagcagcggccacaagtccccctcaaagccagccagcagcaggaagccaccagcccctcgggcttgcagggatgagggggagagcacagtgaccagaggctggccagaacccgggggacaggagaagcctggctgacgggacctgggccttctctagagggccatagccactgccaccaccacccagccactggcaggagagcctgggcctgctctagagggccatagccactgccaccaccacccagccactggcagcagagcttgggcctgctctagagggtcctagccactgctaccaccacccagctggctggcaggagagcctgggcctgctctagaggaccatagctactgccaccaacactcagccggctggcaggagagcctaggcctgtactagaggaccatagctactgccaccaacacttagccagctggcatgagagcctgggcctgctctagagggccatagccgctgccaccacccaccgcccagctgactggcatgagagcttgggcctgctctagagggccatagccactgccaccaccgcccagcgggctgggcctgctctagagggccatagccactgccaccacctcccagctgactggcaggagagctggcctgaacttgcctcttccactctctcatctcctgcctgtgggagctggaccagcctcccaggacatggagcaggacggagaggggatctggggcaaacagaggccatacagccctgggcctagccgctgcctcctgctactgcagaggctgctaaaagctgcacttccccgactcgtttgcagctaaagttccaagctgagggggtcactcaaggtcctgagggtaaagcacctagcccagggctcagcccacactgaatgccccataaatgaaggcccgtccaacagggtctcctccccagggaggctgtcccctgtgtcaacaagagccaaactctgtaaaatatttgaagacatttattctgagccaaatatgagggaccatggcctgtgacacagcccccaggagaccctgagaacatgtgcccaaggtggtcagtgcacagcttgatggtacccattttagggagacatgagacatcaatcaaatatattgaagatatacattggtttagtccagaaaggtgggcagctggaactgggggcttccaggttataggtggatttaaacatcttctggttggcaatcgcttgcaagagttatcaatagaaaggaatgtctgggttatacggggttgtggagaccaaggctttatcatcagatgaagcctccaggtagcaggcttccgagacaatagatggtaaatgtttctcatcagactgaaggcctgtgttgatgttaacgctggctgttccagagttctgaagggaggagggataatgaggctatccaaccctttgctgtcatggcctgaaccagtttttcaggttaacttcggaaagcccttgccaagaggagggttccactcagatggctggggggccttagaatgttacttttggtttataccggaacagcccctgcccctgtcctttgcagcacctgctaatgatctgtcagtgacgctgtgaccaaggctcatcaccctgcgggccgtgggccccagagggcggcacagcttctataggagcacagggcccagggaggtgccctcatccttggctggaaggccgaggcctggaggagtctggagaaagggtctcccttgtctggccttgcactgtgaggtgggggaggtgggagaggcataatctgggtcttgaggacgtttcagccctcagcccggggtggctgagatatggccctgggtaggctctgtcctccagaggtggaaagaaggacaaagggagagggaggtgcaggtcgctcagggaggagactcggacctgcccagccccggggccctcactggctccaggaaacccgctggtgttgactgtgggcagtccagcctctccccatttgaggccatataaagtcacctgaggccctctccaccacagcccaccagtgaccacgaaggctgtgctgcttgccctgttgatggcaggcttggccctgcagccaggtgaggccttggctggcccccagcagggaagggagcaggggtgagccggggaggccagagggatacctgcagggcacacggagaggaggggaaggaaggaggaagggagagg

SEQ ID NO: 484 - DNA, 2299 bp, Homo sapiens
tctttcatttgtctgttgacccacatgaatgggatccttgtgaccctgggttctgcttgtcagctgtccaagtctgggccgttgttgacctaccaacaatcagtgagggatgtgtttgcttaccaattgagaaataatgtttttcacgttagactctatttgaggggtggggttgctggctgcctgataatcattcctgctttctttgaatgaaatttttgaggttgtaaaagaaggaatttggagtttgcaaagcctaatcataacatgaggcccttgatctaagggctctccaatgggcagtggcaggtgggatcgctggaaggaggaatctaaggacaggaaaccagtgaggaagtaaatgtaacagagaaaatccacatctgggattagacaacagcagtgagagtggagaggaagagatgagtctgagaaacagtgaacaaggaatccacagaacttggtgactaagtggagggacagagaaaagaggagggggaagtcaaaatggctagatggcttctagtctgtgacagaggcagaggaaatgctctgctattcatagaaatggggaagttaggaggtagtgcataaggctgtacagttttagacataggacattggaggagatggaaagtcatcttcaggtggttagaaacccagggccacttttggttggtgttcaggaagggaagtgcagagaggtggaaatctcagccacaggtcaaacacttccctggccccagattaaagaccaatccaattaagcatgagagcacacgagccacacaagtcgcacaagtcagtaacgaaaaggactcccaggtgatcttaagtcacataattaacatattttcagggccctacttgtatgtggccctgaaaacgttgagactaatcagctggaatatatccatttttttttctccttctttttaaaaccttattatagagaattttaaaaatatacaagagtagaaataattctagaacgaactcccatgttttcattacccagcctcaacaacgatcaaatcatagccaaccttgttccatcccaacccttacccacttctccctgcgttattttgaagctaattccagacataaatatttcagtctgaatttctaaaaataaggactctatcctttaaaaataagcacaatgccattatcatgccttaaaaaattaactatggtttcttatatcaaatatcaagtcaggttcaaatttccactaaagttttaagtttccattaaaagcagttgatttgaatcaggattcaaattaggacatcaggttgggattggttggcaggttttaaagtctcttttactctttgggtttctcccctaccctctggagagagctccccacaccgtggctttgctgactgcattccttgggtggactttcacttgtgcctctgtcctcgacatgtcctgtaagctggaagccgggatcagattcagatccatttttattttaagtgttatgcaaaaagacacccagtgaaggtgttagaatgagccatggcagtggatggggttcgcaggacccctgcggaagggggacgtttaaggggcaagcggaaaaggagacacctggaatgggggaggaggagcagcggggcgaggcgggggcggtgccgcgtggtctgcgagcccggatattccctggggagcgcacctgcgacttcacctccagtccctccccggctggggcagcggggcgcgggcgctcgggagaggtggcgctgcctactcggcctcatcttgctgagaatgcgacggggcgacagcttcctgtcttttccagtggcttttggcatccccagaggaaaaaacggggagacccgctttggcctcaggaagcgcagaaacactgtcctggctgcgcgcgcaagggcgagaacctaggggacccgcctaaagcgccgttggggctgagcaccgaactcgcacagctccgggcagcgacccgcgatgcggcatccttccgtccggtcggagccctcctagccctcagcgcgtctattcctagcttcggtccccgcagccatataagcaatgacaccctcgccgactcgcctgccagcttggccgcctccctgcagagggctgacgcttctccagaagttgtaagaaaaggagggaaagcaggccaacctcgaggatctccccagccttggcgttcaggtgctgaggagatcgtcgaggttggcctgcttcccctcactcctcgggccttgctcttcccccaggtgcccactgccctccctgctgtgtaccactttct

SEQ ID NO: 485 - DNA, 2295 bp, Homo sapiens
caccacagctggctaattttgtatttttataaaaatactagagaaggggtttcaccattttggccaggctggtctcgaactcctgacctcaggtgatccacccaccttggcctcccaaagtgctgggattacaggcctgagccaccgtgcccagctattatctgattctttatagaaaatgtttgtcagctctgtcctttttccatttccttctcattcctctttttccaggaaggagttgagcttcagcggaagaagtttataaaacctgcctgaatgccctaaaaactccccattctcttcatgtgctcctaaatccaaaatgtctttcttcagaaggctgaatcagatgtgaaggctctcttcgacactctagaccagtgctgcccaatagaacgttgtgcagtgatgggaatgttctagaattgctgctgttcagtgtggtagccactagccacatgagggtattgtgcatttgaaaggtggccagtgtgactgaggaactgaattttcaatttcatttaattttaattaacttaaatagccacatctgtctagaagctagtttattagacaacattacttgttcagagaacctgaacaagtgtcagactaattcaagagggaagtaagagaaattttggtggtcagcaatctgagttcctacagagaaccctgatttttatactgactagtttttaagtttgatttgcttattttgattctaatcagcttagcaaacatttattgagtacctactatgttccagacattcgcccaacatttacatattaatggtagcataggttcctgatgtcaagagctctgagtctagaagtgagataacaaattaggcacttattctccaaagcaggagtagtgtttcctcaagtgccacagcttttcttgttcttctctctcttttttgtttttttttgtagagccggggtctttatctcatgctcaggctggagcgcagtggctccttctaggctcactgcatgcaatctcaacatctggggctcaagctgtcctcccactcaggctcccaagaagctgggaccacaggtgcgtaccaccacacccggctaattttgtttatgttttgtagagacaagatttcacatgttgtcaagactggcctcaaactcctgggctcaagcaatgttcctgccttggccttccaaagtgctgggattataggcacaaaccactgcacccagcctagtcccacaactttcttctcagtggctgtactgtctcttcacaatggcggtcttaccccttgcttgaaccttcactttctcaattctggaaacttctacattgctcagtgcttcttccacatcttgtagattccttatgcttggcgttggaaacttcttcctctaacagtggagatttttcttcagagaaccactccacctgcctgttactggctgatacatctctgaccaaaacaactgtatacaggactaaacctcagttcttcagggtcagggtaggaagtcagaggtaagagatccataaatctgtactgcccccaagccacaagctgtctctttggattagcatagagtagcaaatggccatggggcatgtccgttgggtcacctgagtcttgtggaactggattagtgacataactgtgttaggccctgctgcagacagtgatctctctggaaggacatgaggtggtgtgagaagtcacacaactcattgtgagaccacaggggcagataacgcctcatctgccttcatcacaatgcttgaaccttaatcctttgatgatagctttgccacataacttttttaaatctctggacatttttccaaactctgttgaatttcattttgctgacttcatctcatcctgtgtgttccaggtactggtgtctggtaattctattatagcaaactttctcttgagggttttggggaaaagaatgagacattcttcatattgactctgtttagagggagatagggcaggagtccaggagtgcaaatggatagacagacacaagagaatgctttgcctttgagcagatcccagagcgtcatgggcatccgttggggatggagcttgaccagaagcctggtaaagacttatcccctccctaacccctacccagggtcactgcagagtgaaattctggcccatggtctgtctcccacgtggtcagcatggcctctgtggcagactgctctggctttgcaggtgcaagatttcccgtgaggccatgctggagagcatcaccagaaacaattaaaaacaccctcagcctattgtca

SEQ ID NO: 486 - DNA, 2295 bp, Homo sapiens
tctattaaaaatcaaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaatcaaaaaaattagctgggcatggcagcgcgagcctgtagtcccaactactcggaaggctgaggtgggaggatcccttgagatggggaaatcaaggctgcagtgagccatgatagttccactgcactccagcctgggtgacagaaggagaacctgtctcaaaaacaaacaaaataaaacaaacaggctgggcacggtggctcacgcctgtaatcctagcactttgggaagctgaggcaggcagatcacctgaggtcaggagtttgagaccagcctggccaacatggtgaaaccccgtttctactaaaaatacaaaaattagcagggcatggcggcggacagctgtaatcccagctactcgggaggctgaggcaggagaatcgcttgaacccgggaggcggaggttgcagtgagccgagatcgcgcccctgcactccaacctggtgacagagcgagactccgtcgaaagaaggaaaggaaagggaaagggaaaggaaagggaaagggaaaggaaaggaagagagagagagagagaaagaaaagaaaagaaaaaagaaaagaaagaaagaaagaaagaaagaaagaaagaaagaaagaaagaaagaaaacaaacaaaaacaaatagggattaataaataggcagaagcaggcataatccggggcaggggaagcctcggggccacgcccgagaggcatttgtattttactttcagcagttcagagcccatgatagccaggttacccacttgtggacttccttgaccacttaattgagtcaatctaaccctcaccttctctctcctctcactccatttagcgggtcacgtagccactagggcttccttagcctatcaggccacctggggactgagtcattcagtcagtcacctatctggtggtcacatctgcccctgggctcatccttttactgggccacctcggcccatcgggacctgtcagtccttgacctccctcaggcccctaggctggccaggtcgcctcagtgccacgcctccctggcccgcgattcagcctgcacgttacgctttgttcccagaagcaggttttcgaaacgcggttccctctcggctccagctgttttcctgccagcgctgggagacccggcagccgcagcgcccccagcggcgcgcagcggcccaggaagagagtgcctaccgccggcgcctcttcagcctcctcctggaacgcgggagcgggcgcgaccagcgcccaccctgatcgtcgcgacggtgctcctgattggctgcgctgtgtgacgtaacgggagggccccggcggccgccgggagccggggcccagcgcgtgcgcagacggagcgcgctgagcggagggggaggtggctgccgcttctcccgcgtccgccattttgttgctgtggctattgggaacaagctgggcaaaagcaccccggaggcgcgacgctccttcgagttcggtgcctcgtgtgacggcgggggtcggtgaagacccgtcgagctgcggcgccggcgcgttccaggccgggagtcactggaggcacccctgggacgccgagcagcccgagaaccccggggtggcctccgctgcggctcgggtttgcctgccccgaccccccggctctgccgtgcattcccgggcggctctctccgtgtggcggccccggagcaggcgggcggcgtcggaggatgctgcgggcccggagccgagaggaaagtgctggcccagccctctgagcgctcctcgaggtgtgcgagaggcccttcctcggccccaaagccgtctgccgggctaaggcgtgcagagcaggcgaggacagccgccgcccctaccgccgcagagtccccggtccaacaccatgtcctccgccaggttcgactcctcggaccgctccgcctggtatatggggccggtgtctcgccaggaggcgcagacccggctccagggccagcgccacggtatgttcctcgtccgcgat

SEQ ID NO: 487 - DNA, 2293 bp, Homo sapiens
gctccagatcctgaacaactacctccagtttgaggtgtcccacggcccctccgatgtggagtccgtgatgctgtccgggttgcgggtgaccgacggggagtggcaccacctgctgatcgagctgaagaatgttaaggaggacagtgagatgaagcacctggtcaccatgaccttggactatgggatggaccaggtgagctggcacctgcacctcctctggggatagacccttcctccggcccagggaaaaacagaatgaccccttgacgtgccaggacccaccagagaccttgtggatttggggaggcactttctgggtccccgcaggtgggcttctgttctgccctgtactgaggtcactggcatcttcctcacctccttcatccggatgccccgcccccggcagtcagcagctgacttcctccagctgcatttctcatcatgatgctgttggtgccttcagcagtggtttcttttagcaaagccatcttgagcaacacctgcaggctcagcaccatgtctttagggtactgaagtagcaatgctggggcccgtgccctcagagcatggatggggagcaaaactgggagagcagtgagacccaggtcctggacaggcctgtgagacaccagggagccacacatgtcccaggcaggcaggtggtggtatcccagacaatgttcggaacacttaaccaaactaggtttccacagtttgcaggcaggtaacccaagatgttgtctgtgaaatgcccacacacttaaggggcgacctgggatctccaagagctcttggagccaaggctcatcttacaacacagacctgggagtaaataggtgtgttccaggcacctgcctttctgggactggatctcagccgagaccctcttgggttcccacagtgttaatgagtgagcggatttccgttcactgcagtcttcctgactcgccaagctctctgtcacagcgtggctggtttagtgttgtgcccttgacggaggcgggacagttgcccacgttgaccccactggccgcctcagctaggctggggcatggacacccatcctctggcctggtcccctcgccctggtcatcacagccagcctcgctgtccagctgggcccagctctctctttggaggcccagatgtcctcaggctctgcggagtttgttgaagtgactgtttagacttccagtgtatccttcccatctgagagacgtttctaggatggtggatgcagcccccagatccccggcccctctctccgcacagaacaaggcagatatcgggggcatgcttcccgggctgacggtaaggagcgtggtggtcggaggcgcctctgaagacaaggtctccgtgcgccgtggattccgaggctgcatgcaggtgcgtgggggttgtggggggcggggggaggcctgcccctcacaggcagctccgaggctggcagcaccataggtggttccgttggtcaacctgttagctttcaacgagtgaagaatttgtctgacaggcatccccactttaacagctcctgtttcctcttcagacccattctcccctgcggttccccttggcatccgggccgtccctggcccccacagctccccaccgccatgccagccacctgcccctctgcctttgtgaagtgtcctgaatcgagccccttgccgccacccccacccagtccaaccacagacgtcacccaagtgggccccgtgcctgtcccctggagccaggggttccagctacggccgagggagctgctctgagtcgttcagctctcagccccctcggcagggacatccactcctcacgcccccaccgcgcaccccaggagctcaggctggcgtgccctctgagctcctcacccagccctccactgcactccggccagcaggccgtggggcaagaggaacaaccctgcccgccccagctctgtagataaatgaggcatcacagatgaatgcctcgcaagggaccagagaggtctcagggttcccttaacccctacatacctttccgggctcctgtagccccagtgccgtttacttaatgcagggagtgaggatgggggggacgcccaccaacgtcgccaccctgaacatgaacaacgcactcaaggtcagggtgaaggacggctgtgatgtggacgacccctgtacctcgagcccctgtccccccaatagccgctgccacgacgcctgggaggactacagctgcgtctgtgacaaaggtgggaccgccctcccggggcccttcagtgacagggaggtctcttatggctgaaaca

SEQ ID NO: 488 - DNA, 2283 bp, Homo sapiens
atatgtggctcgatcaccttttgaacccaggtctgcctgcctccaaagcttgtactcataactagattctcaactgatgttgggccaaggttcctaggttctctccttgaccttccttctgaagtaataatgctatgataagctcatcggaggctgaggcccaggcacatgtttgcctgaactatccatgttatatgattccttcctcagacagagtgagctactcacgatcccaggtgtaccctgaggccagccaaggtgtatccatgacctcatgcctctgttccagcctgccctttaacagctcatcccacctgcctgccctccccgcctatctgcagacagtagtctaggatttcagctgccctgggggctcattttccctctcagcttcctgctttagctgtctcctgcctcccactcacctattactccagcactctcacctggtcttcttttctgtctcatcactgcctcttgacatctttatctcatagtagttagttaggggttcttggtaatgccctaaatccacatggtgggaaggggggagtgggggaagagagtgcgctgtggggctgtgcctacttctggagggtaagactcgggccctccaggaacaaaggattcaggctggtggcagctatagccaagcagactgctggccagggattgcaaaggagtattttgtttgcttaagaaaataaacaacactgagtatgagatggagggagggggtgttggtgccagagagattgggaagagtctgccaagggtgtgttctactcactctcctcttttctttcatctccactgagctggaggcagttatcctgtcccccacgtcacattcctactcccgtttcccatgcctggacccaggttgggcaaactcttcctgtaaagaaccagacaggaactattttaggctctgtgtgccatatggtctcagtcacaactactcatctctgcctctgtagcacgaaagcaattagcaacaatatgtcaacaaacatatgtgaccccatgaaaactttatttattatggatacggaaacctgaaaataatgtctttcttttgattttttccccaatcattaaaaaacgtaaaaactactcttaggtcgcaaggttaagccattctcagcttagcagtggcaggctggatttggcttgtgacctacagttggccaatccctgattcccaaaatgtattcctcagggatgtgggcaaatacttatgggaaatgctggattaaacagagttaagaagcatcagacatttccaggacgggctagcacatgccagggctctctaactgacctcattaggattcatctgtttcatggaggatcttgcaagacaagaattcctcaaacctagagtctgaggactgtgctttgggaaacactgctctgcttgatgccctcactgggcacatggtagaatctagagctgagtgccttgctagctggagatagggtcagagctcttgactgccctggcagtcttgacacatcacgctgtctgtgtcccctgagtggttcagagccacacaggccaagactagcccaccagagcaccaggcctcccagctttctgggcttgtccatgcgtacatttccttattcttcctggtttccagaacctaaggagaggcacattttggttgagtgattataaccctagggaccatgggtagctgcatgtcaggaaacactcctcaacttcctggccctgatggattaaaggagaggtacttacaggttatttcttcgctgtggactactgtcccagcatgaatagggcatcattattgaattattttgacaggaaggagactggtgtatgctgcacagtaataatgtatttacatgtgtacagagtttaccaagcacctctgtgttgtttttgcctctgtttattacacttgcccttggggggaggtgggacaaattttttaaaaatttatacatgcagagactgcagcgcagagaagctaagagacttgcccctgcccacacagccagtggtagagcctgaactcaaacccaggtctcatctcacctcaggggctgctttccccatcgctgtattgtccttaaagtgatgggtgactaggcaatgaagtaattctctaggaaagcatgaccaatttccctttctccacctccctctttttcctccacccctcccccatcagcccccatatatatgcccaaatctccacaaagccttgcttgcctgcaaacctttacttctgaaatgacttccacggctgg

SEQ ID NO: 489 - DNA, 2282 bp, Homo sapiens
tgatgtttgttttcacgatggtcttcagatgcccacgtgggcactgctgagaaagccacttggtaaaactgatgccggaaatggggctttttgggatccctgctcagctgcttctgagtcccagcatgccctgggttacctatggccctctttcccatgggacctgacctatgatcggcccccgctcctaggcgtggtgaccaagatgaagatgcagaggaccattgtcatccgccgagactatctgcactacatccgcaagtacaaccgcttcgagaagcgccacaagaacatgtctgtacacctgtccccctgcttcaggtgagcgcagtggcccatcaggttgctcaggccacgctctctcagccttcagattccagatcggaccaatttaaggccaactgagggagggaaagactgaggtggcatctctgggaagccccagaatctcaggatttgtatatcatatgttcttcagaatcaaagcgttctacagggtgaatatctctacctgaaatgcttggaaccagattttggaatgttctcgcatacatagtgagatgttttggggatgtgacataggtctaaacaagaagctcatttgtttcatatacaccttattcacatagcctgaaagtagtcttacgcagtgcgttttataattctgtgtgaaacaaagtttgcgtacattgaaccattggaaagcaaaggtgtcacgctggtattgaagaagtttcagattctagccaggcaccgtggctcaagccagtaatcccagcactgtaggaggctgaggcaggaggatcccttgagcccaggagtttgagaccagcctgggcaacatggcaaaaccctctctctacaaaaaatacaagtttgccaggtgtggtagcatgtgcctgtagtctcaggtcttcaggcggctggggtgggaggattgcttgagcccagaaagtggaggctgcagtgagccgagatggcagcactgctctccggcctgggcgacagagtaagaccctgtctctcccacacacacacaaattcagattttgcagcgtttcagaatttttggattagggtgctgaacctgtaataggcaggtgcgtttgaaccaaaaggttaggatgtcataccagatgggaacctcagaaatgttggaattaaacgtttgttcattccctcagcatgttttagttagagcttatcacgtaccaggtgtggtgtgagatgtttggggttcagtggtgagccaggaacaaagtcctgctccctcagagggcaccttcaagcagtgtgggtgccagatgacagccaagtataaccagaatggggatgtgggcagctgatattggtggccctctgggcggggaggatcttgggagcaaggtgaggagtcctgtgggtggagaggagggtggcccaaactgatgctgagcgataagggacctgtggttgtcagtgctgcaggatccccctgctgctctgctggggaagggtggtgaggctgctgacaacttgggggcctccagtttgcttgtgaaatggagctcgtccaccccagcggtcctcggaggggtggtggcctgctctgtgtacagcgttgagcttggtgcttggcacaaaacttgtacgaaaggaggggacaggttgaattggcgagtagagcttggttggggtttggtggagccgaagcagagagcctttagcctggtgaaggggagggagggcctcctggggtctgctggggtggcccctcctgaggacatggccctacctgcctccacagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattcccaggccagacttgggatcttccgcgcctttaccagagcattggtgggggtgggggtgtgcctcggggaattgggcagagctgctgtcagagaggctgcctgcccatgtctgtgggtgaggacagtggagcctgaactgagatgcctgccttcccctgggtctccttctttggtccttgtcaccttttcggtgtctgaataaggctgattacctggcgttgcgctgtccccccgccccctccggtctctggggaggaagtgagtgacggcggaggcccctgggtcctccaggccctggtctgtctctttcctgaccacctc

SEQ ID NO: 490 - DNA, 2270 bp, Homo sapiens
atctgaacagggaagttctgcaacaggaggggattctgatcctggagccacggagctttcaacagacacttcctggacgtgccaagcaggtcaggctgacaaacgagtgggcactaaaaggcacaagaagctctcacatgtgtacaggcctccaggactacaaagcacttgcaaaggtgacctcatctgagtaaactttgaaagtgctcttcagtgttgcttctgtgaggcctacttcactttttaccaagagaactgctcccaagtctggctgatcctgacctcaggactgtaagacatgaaggtggcacacagggaaggagtaagtcaagctaataaatacatgtctgaacatgcatttatattacaagacatacggggaaaaacaggagcaactctagccataaaataacccgtatatgacaagttaaattgagaaagaattacctactttcacgaagtgcgctgaggtttattgggctctgcgcttccttaagagtattagaaaagaacacacaaaatgctgaaatatgggatttcattatctcagtttactttaatttgcttgtttacacacacgatctgtgtgtacataacagtggcaagagccattctctaaatacaatctggtacccagactatgacagatgcacgtggaaaatgaggcgtcagtgaattaatctcaacatagaaaggcaaaataagcatggcagtattctatgatcacagatgcccccagagcctgggggtaaccgacacttttcaacataatacaggacaattttaacaaaagacccagactccaaatggcacccaaaatatattcgtttctctgccttctctagaggagtcagaaagttctaaaggcttactcaagaaaaaggaggcagggagactatggcctgctaagcacagatgctgagcactttacatgcaccatttctcttcatctccacctgacagacgatgaaaacgaggtttgccatgatcacacagctatcaggagtggtgccaagatatgaacccacatctcatgtttgcttgagcccaaatcctttcacttatgtcaggctgtttcacataggaatagaaagcatgctcccaaggaagaggcaagggggctaagcatggacaagtggcggaagcctcatcgatacagaaggctctgcaattgacactttccacatacagttaatttagtgctgagcccgcatcagacccacgtgggataaatatctggagatttaagtgtcacaaatgaacttctggggtcaccctgtgcctattcccttttggtgctgaacatgacactttggagagccttttttttttttgagacagagtctcactctgtcgctcaggctggagtgcagtggcgtgatcctagctcactgcaacctctgcctcctgggttcaagcgattctcctgccccagcctcccgagtagctgggattacaggcgtgtaccaccacacctggctaatttttgtatttttagtcgagacggggttttatcatgttggctaggctggcccaacctcaagtgatcctcccatctcagcctcccaaagtgctaggattacaggtgtgagccaccatgcctagcctaggagagctttcaatcccttcaacaagcccctgccatctactccatggccactcccaccactggtttatgggcataggcaacagagggtcacatcttaccaacgcctccaaagcaccatggtgccacctcccatatctcatcacctgtgtttctgctccttttgggtgcaacaaatcatgactcattgtgatggataaaattaacctccaacttgatgggatatgaaatatttaaaatatatccttatagtaaaagattttacaccgaagattcatcctcaaccacttaagcttcagtgaagccagtcaggtgtagtgcttctcagttaatgctactattggacttgattggagagaggggcatcaaggcggccttaagggtgattaccccaacagcaaggggctcagtttgaaaggcttaaggagacagtctgggagagaagaggggatatcttatcacagggcgtggaactgtgcctttgtggatggaggtgacaggatttctaacccttcccagcattgtcacagcaaaggccacagaatgacaaagctggaaactgaaaagtgctgcaaaggggagagaaaaaggaaactgatttcaagtccagctgaacaggcccaggtatggtttggtttagtttggttggtgatgcaagtaacag

SEQ ID NO: 491 - DNA, 2246 bp, Homo sapiens
ctccctgcttccatcactaactccgcagggacactgtctccctgaatgtgggccccacttagtccgcaaggcagatggggggattagactaggcccagcccaaacaatacagcagaaagggccctccagctccatgcagtgcccccacaagctccctcctctaggacgccgatggggagagccaggcaggacgtggaccctgaagacatggcctgctcctctgcctcccctctggtggtctcctttccagagcagcttcctcccttgtgcccacgtgtaccagtggcttagccctcttccagtgcagaacacccagaccccagagcagggaaaggaggaggcagaggcctctgagcaggcagcagcccaggagtctgtgccccaccctcccagtatccctggaaggaagaaccggatgggatctctggagggtgattagagctgggctggtccctgtgctggttcccagactcccactggccagtacttttgcctcctgccaggaagttggtgagggggaggcagcagtatgggtgagtcagtgatgacaggagcccaagggacaaaggtcatgggtggagaattgagagacattgtttacagcagtccacctcctccaggaggccttccaatgctaatcatccctgtggtcctaaccaatctctgacccaccctttccctcttctggtaggaattatagcctctcactgacaactgtgcatctgtctgccttgtgacagtgagctcctggggtgcaagagagactgtggtttgattggggccctacaatgcctgtgactatcagcagtgataatcatttagctatacttcctactttcaaaaactttttgacatctattttaattaacatgtgggaaagtgcttagaacagtacttggcacatggtacgtgcaatgagtgttaggtttattattaatattttctgctcagactcacattattgtgagagacagggcagattttgccagtgaagaactagggatccaaacacattgtggtggggggaccagacccttgctctgccttcctactcagtatggaatcttcctgactggtggggcgggccggacacgacttgggaccccaggagagtcaaaacggcaaacacttactcggactaagagtgggcagcatctttgggcacagactgtgagaaaggaggtttcagaacccatgggcttctccagccaggtctcctggggccagtgggggttgggtgggagccgggaaggggcctggattagcccaaactctcttcagacctccagacctgcccccacaaggcggggcgggccaaaggaccgagtgaaggctccagctggactctagggagttacaaactggccacggggattagcgaagctgaaaagaacatttgcctaggaagggaaaacgggaagtgagaggctgaagataactctcctgaagtctctcgggacccacagcagaccaatgggggccggggaaggtggtgaagtcggggcatcccgacaggtcccccgccccagcctgcccctcctcccgcggcccacagctgaggcaccgccccgcccctcaccctacactgcctaccattggctagcgccagggccccgccccgcataggcggcctgccattggctgaagtctttcctgtttgcgtgcttttgggggtgggggaggcgtccctccctggaccccggcgacttcctctctcggtttgtctgggtcatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggtctctgaggtgtgagggaggcaggaggagtggacacggaggggcctagaggaggcccctagaggggcggaggggccgatggaaagggaaaggtggcctgtcctcccctcccgacaccaggtctagctgcggggtggcagaggcaaagcggtggtgaggaaggctgggaggtgaggggcaggagactgaagccaacctcgtactgaagagcagctgtcattgcaggggaggagccccagccccgcgacgaggaggaagcggagctggagctgctgaggcagtttgacctggc

SEQ ID NO: 492 - DNA, 2218 bp, Homo sapiens
gtctcgtcagctaaagatggagccggctgctatgggcctcttctctccttggccgaccatctcttgcaggtcggggcgggcaagccagcagaccctcggtggcaccagccacaggcagcaaagcccggggcaaggagaggctgactggcagggcccgaaggtaacaggtggcaggggacaaaatcaagacgggcatgtgggtgtcccaatttcctggaccagtacaggcccaggtgccagctccatccctggggcccctgcctcctggctgactgctgcctggcaggttaatgagatgctgggagaggccattagcagaggctgcagcgagagcctggtgcccggggaggctggtggtaattacagcagctcccttcccctgggaaatgaggtatgcctttcccaggcattgcaggcggggacatgcctggagtccccacagaactcaaggtgctgcaagtttggccataaacagcagctggggacccaggatgggcccagagtgcgtggtattcagaggaaatagttggatttagggaacaaggtcaggcttggtgggggaagcatcctggagccacattctggctctgatcccagtctgagacccttgggctttggcttctgccaggagtttctttggcaaggagatggaggcccagaggaggtggaggcccctcctctctggtcctgccatggctgctcctctctgctgagggctatggggctctagggagagtctgggtcacccctgggatttctccactgctcagtgtgaggcctaaaccatggggtcccagctcagccttcctcactggctctcaactccaccccacccctctattcaggcagggggacatggctctggagtgaagtggggtggggcgtgccatgagctgtgtttctacaggtgggatatgaaggaagacaaggaggagctggaaggtcaggaggtaggtacttgggtataggatggggcaggctggggacgcgagccctggattcatcagccaccggggctattctcttgtttcagggaagccaaagcaccagagagactcccagtgaggaggagcaagcccagaagcagagcgggatggagcagggccgactggggagcgcccctgcagccagcccagccctggcatccccagaggggccgaagggggagtcagtggcttccacagccagctcagtcccctgctctccacaggagcctgacttggctcctcttgacctctccctaggaggggctggcatccctgggcccagggagagcgggtgtgtgctcggtctgaggcctggggcccaggagagccctgtgtcttggccagagggctctaagcagcagcccctggggtggagcaatcaccaggctgagctggaagtacagacttgccctgagccacagagaggagcagggctcccagagcccggagaagacaggtctggcaagtctggggcccagcagggcctggccccgagaagccggcccacgagaggaggcagccaaaggtcgagaggcacagcaggtgtgaggcgcaggacagggcgccctggcccggcaggaagatgctgaacacagctcctgggagctggggagtccccggggagaggaaaagggaatcactctgttaaaggccctccgcgtgatggccatgtggttgccggtggcttgcgccattgtcactgagcagtgtggcaaactctccagcatggcgaccttgtgagggcaaggagtggcctccctgcacctcacacgctcatctctgtgcacatgtgtgttttcacgcacgggcacagcccctggtgtattcctgtactagtatctggcatctgaggctggtgcaccctgacctgggcctactgctgcccaggccacaagccttctccactatgatgagagaacaaggcttggtggcacccagcacctggctctcctggctccccgtcacccccccagggcctggcctccctctccagctgcaggctttcacctcttgcctgggctggattcccccagtcccagattcccaggatgcccaaccaggggaatcccagtaaccatgcgccagcctcctgcctctcctgagtggtggctgaggcctggaggaggagaggccacacagctggcagggtctggcctgggcaaagaagagtagagctcacgtcttcttggtgaaaaggaggatctctggaaagtcctcctctctgaaatggg

SEQ ID NO: 493 - DNA, 2193 bp, Homo sapiens
gagaaccccactctcaatcctttgtagaccaggtcattcccgccaggctctgtgctaacggaggagagtaggttattagtcccatttaagagccagagaaattaaggcagtggagagtagcagggctactggtttaaaaacactggctctgtgcctgaatcccagccttgtcatttgctagctgtgggaccgcaggcaagtgccttgatttctctatgtctgtggataatgatggtatctacctcaaagctatgtaaagaattaaggaaacaatagcccaacaccacacctgcaggaaggaagcaagtttattattactcaataaacattggtggatcctgatgacattctctcagtcagctttagcagtcttaagagactgcagaggatggagaacccaaggttagagccagatttcttctctacccagttcctcggggccaaaaccctgacaccatgcttaactcctcttttatacgccatagtccgtcagcaaaccttgtcttcagtatgcgtccaggagtccaaccattcctgccacctccaccgtattactttcatccagactgccatcagctgtcacctagattattgcaaaagcctccttgctggctttggggcttccatcctctctctctcgccaatccccagtcaactcccaacaggcagcaaagcttaggttacttctcagttcaaaacccttctaggtgtgctagaattaactgatttatttactcaatgattatttattattgagtgtctactatgtgccaggtactgttgtaggcattgcagataaaatggagaacaaaacagacaaaaatttctgcattcatgaagcttccgttctcatggagggagatggttaacaaacaagtgtatgagtaaaacatatggtaggttaggtgtcatgtggaaaaatagtttagggaaggcggggggccttggattttaagtagggtggtcaaggaggtctaacacacaagataagggttaaataaaaggccaaacgtaggagaggtgggagccaaagagctacccagaagaagagcattctagataaaggctcagtaagtgcaacggtggaagtattcctggtgagtctgggacaatagtggaaagtcaaagtgtgtgggaggggagatatagagccccatgcccccctcccacacacttcagaggggaaaagggggcaggattgagtcctgtacattccccacgttttttttttctctggagattggaagccattggagggtctaagcagaggagtgatgagttaagctgctgtgtggaagtccgtaaggaacaggggtgagtcagagaccctgaatggagccgttgcaattatccagatgagatagagtgccttggatcaggaagggaggtagcaacagaagcggccaataaagttcaaagtcctcagccccagtcctcccgatgggggtctcacctacccctctcacctcaccttgttcctccctgcatccccaccccaccggtcactgctaggcacatagaagcatctactaagcatgtggtgaatcaatgaaccccttaatgaatggtccacccctagatcatcagcatcctttttaacgctaggcatatagtctgaactcaacacatgtttacagatggaatgctgcacagtcctgccaagtccaggcggttattcctctccacagccgaaggaaactaaggctcgggtggggaagtgtccccctggggtctctccgcttaggctgcaggctgggcatcctttttcaaactcttttagcacagcgaagtcgagggcactgggtggagggtgcttgcttgccctcagggtgagtcacagtgacctcagaggagtttccccaaaacgtccccgccctgtgatggggaaaagccggaatctctcggtcccaggtggtcatgtggcccaggccggacaagcgtcccgaaagccccgggagagactaagaagcaatcctcccacgcgctttctcccaccctcgggccactgagacggagggacagagggccgccctcgcgcggccgaggccccgcctcccgctcgcccgcccgcgcctccagcggaagccggaagcaaaagcgggtcctgctagccccgcggctccgaactcggtggtcctggaagctccgcaggatgggggagaagatggcggaagaggagtgagtgggcttttt

SEQ ID NO: 494 - DNA, 2189 bp, Homo sapiens
taaaaacaggaagtgcatgagcactggtgaggggcattgtgactgcgttgaacacttgcaactttgaggtgaatgaatgtattggctcctggttgcaatatacaatcacacgttgtgctactttgtattgtcaggagatgtcctggactcccacagaaactcagggctatggaatgaaggtaattttagaatacaacaagagtcacagatacatagtctgggaaagcaaaacttaggagctctgagagttgtacaactgtaatgcatttagacacatttatatatcaaggggccaaagtaacagtttttacacataagattcctgattggtcgggcgcggtggctcatgcctgtaatcgcagcactttgggaggccgaggcgggaggatcacgaggtcaggagatcgagaccatcctggctaacacggtgaaacccgtctctacaaaaaaattagccgggcgtggtggcgggcatctgtagtctcagctactcgggaggctgaagcagaagaatggcgtgaacccgggacgcagagcttgcagtgagccgagatcgcgccactgcactccagcctgggcggcagagagagactccgtctcaaaaaaaaaaaaaaaaaaaaaaaaaaaaaaaaaaaaaaaaaggttcctgataattcaggggttaccaagattctactactcactgcagctaataaaaaaaaaaaagaaagaaagaaactggtctctgtcctatttcatatgctcaggtacaacttttccagagaagaagaggaggggggcggggaggagcaggaggaggaggaaagaaggaggagaaggagaaggagaaggagaaggagaggaagaggaagaggaagaggaagaggaagaagaagaagaagaagaagaagaagaagaagaagaagaagaagaagaagaagaagaagaagaagaagaagaagaagaagaagaagaagaagaagaagaagaaaaggaagaagaagaaactgtctctacaccttcattctcaggacaagttcattgtctggcaccaagctccttggggtgaattttcttccaaaagagtccggggagtccaggtatggaatgggaggcagaaagttcaatcaagggactgggatttcggaatgaataatgaagggagatggactgggtccatgccgaaggtttctccctggtttctcagcccccgggcgaagactcagggagacattgagacacaccctgcacaggagggggagggggagggggagggcaaagtcccagggccccaggagtggctctcaagggctcaggccccgaggcggtgtctggggttgggaggctcagtattgagaattccccatctccccagagtttctctttctctcccaacccgtgtcaggtccttcttcctggatactcataacgcggccccatttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggtgagtgcggggtccagagagaaacggcctctgtggggaggagtgaggggcccgcccggtgggggcgcaggactcagggagccgcctccggaggagggtctggcgggtctcagcccctcctcgcccccaggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctggtgagtgaacccggccgggggcgcaggtcacgaccaccccccatccgccacggaccgcccgggtccctcagagtctccggatccgaaatctaccccgaggcagcgggacccgcccagaccctccacccgggagagtcccaggcgcctttacccaggttcattttcagtttaggccaaaatccc

SEQ ID NO: 495 - DNA, 2130 bp, Homo sapiens
aggttctctgtgttcttgccaacactgtaacatacttaagagggcccagggccctctgacctcccagtcatccttttttaaaatttggactcagaaaaagagacacgggttatgatgtttcttaattcttttataatgatgaaaaggcaaagtcttgttgccaatttaggtacaaagatgcttcagcactcctgggaattagtcaattttgtatttcttcagtatttttgaaagaacttattgcaattattgatgatggcaactttaaatggtgcaatatcatgtttccaaacaatgagagaccttggatctgtcaccccaaaacccagctggtgattctagcaccaaatctcagaccccagtctcatggcaggcaagcatgatccctgattagcctccaccctgtgccttggcaggatcatgcccagaaatggaggggctccccagcctccttaatggcctctccaccttgggctgagcctgcttctccatggctaggtgcccactgcatgctcactcttggcagagctggctccctggggcattgcctatctgctccaggaaatgctttttagtaccaagtagtctaagcagagtcaagaccagcttttcagaataagcagatttcagagtcacatattggtcagactcacctgccaagaaaggtgttcaggtgacctattatttccctcactgttagtaccttttttcttcacttagttaccctttttttttttggtgggggttacagagtcttactctattgcccaggctgcagtgcagtgacatgatcatggctcactgccaccttcatctcccaggctcaaatggtcctcccactttagcctcccaagtagctgggaccataggcatacaccaccatgctgggctaatttttgtattttttgtagagatgggggtttccctatgttgcccaggctagtcttgaactcctgggctcaagcgatcctcccatcttggcctcccaaagtgctgggattacaggcatgagccactgtgccctgcctagttactcttgggctaagttcacatccatacacacaggatattctttctgaggcccccaatgtgtcccacaggcaccatgctgtatgtgacactcccctagagatggatgtttagtttgcttccaactgattaatggcatgcagtggtgcctggaaacatttgtacctggggtgctgtgtgtcatgggaatgtatttacgagatgtattcttagaagcagtattctagcttttgaattttaaaatctgacatttatggcgattgttaaaatgaggttaccatttcctactgaatactatcaacaccaaaaaagaagaaggaggagatggagaaaaaaaagacaaaaaaaaaaaaaagtggtagggcatcttagccatagggcatctttctcattggcaaataagaacatggaaccagccttgggtggtggccattcccctctgaggtccctgtctgttttctgggagctgtattgtgggtctcagcagggcagggagataccccatgggcagcttgcctgagactctgggcagcctctcttttctctgtcagctgtccctaggctgctgctgggggtggtcgggtcatcttttcaactctcagctcactgctgagccaaggtgaaagcaaatccacctgccctaactggctcctaggcaccttcaaggtcatctgctgaagaagatagcagtctcacaggtcaaggcgatcttcaagtaaagaccctctgctctgtgtcctgccctctagaaggcactgagaccagagctgggacagggctcagggggctgcgactcctaggggcttgcagactagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggggcaaagccctgaataaaggggcgcagggcaggcgcaagtggcagagccttcgtttgccaagtcgcctccagaccgcagacatgaaacttgtctt

SEQ ID NO: 496 - DNA, 2128 bp, Homo sapiens
ggacactcattcttccaatttgcagtgaggacagggtcccagggatggcttgcaacctggaggtttgggacattctcaacttcagtgtccttaaaggctgcttttaataaagtacaaaagggagtttgtgggccttgctctaatttttggagtttttgtctgatgtctggggaagcctgacttataaaatgtatggccagaagggattggccctcagggctttcaggatctaaatctgtatatttatgcatggcctccattagtctagcttggaaaagggaagggtccttggtcctgagtgatctctcataatttagaaaaattaacaggttttatttcattccttccaacaaacatgttataatcttctcttcccctgtctctgtttgggctggcattggcagcgtggtattgccaattgggttctgtgttggggacagcttctgccctggctctattattaggattgccaacatgagtttcgtctgcccaaactcgagctaaagaccgtgattttttcttcgtgggaacagcaaatagttaataccacaaatgtgtcttgccaggttaaatcaaaggcaataaagcccgaaattcttgaatgaacttagagggatcctggctaaatgaacccaacttggattgaatttgccaaagttcagacaatggaaaagggacatgaactcaaattgttcccaaatctccgtttgccaccttgtggagaggcataacacttgggggattttctgaggactttgtactagtggcatatgtaactcctgtgcaagtatgtgagggtaataaagtatctggatggtaggggacaggggttgattggggcatggagcagatggcaaggggtgcacaatgagttttgacatgcgtgcattacggagatgcatagaaattctagttacttttaaatttggagggaagaagtctggtaccagatgctggctttaggtaacagggaagtctagttacctctaaattcctcaggtaaggagtttctgcctaaggatggtcggcttcatggccaccaggtgatctttgctttcaattctattggcttgatttcatctgtggcagtttctggggggaatcaaaattataggaacaaaataaaactaacagtaaaactttcatgctgactggggaatgcttaacgtttaaaaataggtgctgaagggtccaaagcaaacaacacaagccggaaaagaaatgtttaaaagttagctatatttatacaaggaaaaccaaaagaaatacttaaatgagacttttaaaattcgaggctctccactgagacttgttccctggcgccagctccgggagttccgcagagcctcgccccctgccagggcgcccggggcgaaggaccgcacggcgcatgcgcgcctcctccagcagtccctttccccttcttccccaagatccagcgcgtgctcggttgcccttctccgttccttgcaggcccttgggtcaggacccaccacctgccggaccatcattttccgagtccctccggcctagtcggagtgctcgctcgcgcctcctaaagctctcagccgagcgcgccgagacccctcagggcggccggtaagaaggcggaggggcgggggctcaaagcgcgcggcgaaggtgcagcagttaccagggtgctgacgtcagctagaggcagggcaccgcggaaggttgaatccacgccctggctgtgcgcaggcgccgtagggggaaggcctggcacgctccagccaaccagggcgtcacctgcagctcgtccccctgcccgggcttgcctcgagcgccctgccgccgccggagcggggagggtgttgggggcaggtggagccgggagggcccagctgagaattcagggttgggggctcagagggcactgcggctaggagcccgtcaaagcctgtcgcccaccggggcgagggcaggtgggagcgcctggccgtgcgtcgcgcgctggttggccagctgacgccccagtgcgcatgcgcgtccgaacagccctgcgggcggagcgactgtcctcccttctggtgtactgggtgggaggtggaactagtcggacaaagccctcgcgtcggacccttgccagaactgtaaggagcaagag

SEQ ID NO: 497 - DNA, 2035 bp, Homo sapiens
ctggctgtgtatgcgttaaattgaggaggagggcccatccagacaggtgctgctgaacctcaggacagcagctggtccatccaggagacctcccaggcctcagttcccatctagggagggccctaggtctggagggacaccaaaggcatgagtgtggtgtgtggtgcggtgtcatgttagctatataatagtaataatgattattattactgtcccctgccccaccctcatcagccacagtctgccaaacttggcctcagttataaagctaaaggaatcagccagagagagggggagtcaatcacaacaaagtcaccagtctgagcccccatcccacttctacccctgcggcctagactggccatttcagcaaactgcctagtgattctgcaagggaattttcacagccttggcgggtcggactcagatgggcattcttatctggatgctttggacttggctaagtggcccagagataaacccttaagaactagtgcctgtgcttacgccacctccaattctagctactatgtgttcttttggttctaaaggggcagttggctcaggtgaaaaccaggaatgtcccttggaaggcaggagcaaacagcctcaggacgaactttgaaactatgtaggtcctctgagggcagccccaggggccccatggtagcaaaaggtaggcctagccaaaggctgggcaaagcaggagcagggagagctccatccccctggccatcgctccaggtatcctgggaggcctctgcccagcacactaagtgtctgcatctggcaaaagagggcttgctcctgccccatggagctctctcctatttctgcttctcaaaaaaaaacaggtgaccagatgccttcttaatgtcaatattgctcatgttctctcctacaaaagaggccacatagaaagaaagtctacccagctgtacccataagcaggagtgggaccaaatggctacttgttctcaggaaattcagagccttaaagagttagttaggagaggccagaatgccgctgtgtcgtttgtttgctttgtttttaaggatctacaggaggtagttttccataaactaggaagctaagttaactatgcaaacacaagcagggtgggcaatgtgaactggccgttttaatgtatttgtacccgcacgtccttgcacaaaagatccaaggctgcgcggagtaattgctattagaatagtgggcatggtccctaccgccgcaggttcggaccttcaaagtgacaatttatggatgctccctggcgctccagcgcaggggaagcccactctgaagacgccctccccaccccctcctctccttccttccgactcaggagagctcgacacgccggatagctgcggccagccgtggccatcctggccccccgcctccgccttccccactcccgcgtgcagccgggacacgggaaaggaaagctttggaagtcaagcgccggccaaaagatgacctgcccgcgtgtctcctcgccccctcccccagccgtgtcacatggcggccccaaccaggcgggcagtgcgccccgccgcggagacccagggccgcgtcgcctgggcagtgggtgatgaaacttcccaggcgcattaccgcagagggcgcgggcggggcgcggggcgggggtgggggatcgagagctggtaccggggctcacctgttctccaggaggagggtggggacggggggaggggcgagtgcgcgccaacgccgggtgcgtgccctggggcgcttgggcgcggcgctcgtgtccccgccctcccccagccctgcgagccccccgagctgcgccgtggggtgacgggaccgagagcagttcctgtccccggccccggcgcgggggagacgtgagcgtgcacacgtacacacacagcaggggaagaggcgctccaagcggcgcccaactttctccttccctccacgggccgggtgagaaagtagccgggggctatcccgacccggcggttcttggggagggggccgaacaagaaaagggaggagatggag

SEQ ID NO: 498 - DNA, 2032 bp, Homo sapiens
atggaatctgggaacttcatgggggcaggacagggaaggggctatggcttgagggagggactctcccactaggcacatccagcctcacccctgcctagatcaggcccatttggaaaaggggatctacatttgcagaatcatctccttgggcctgccaggattgcagaaataacattaactctttcacgcagccagagtttctgtttatcaaatgactaaatgaatgaatacccttgccggccctccagtggatgcctgtaagagttaatggattgttcagagtcctcatttagagccagggagtggccccagcaccatgagaggctgccttcaggatcctgcaggcaggcagagctccctgtccctttcgctacattccctgactccaaggcatccagccaagggtatggtccttcagaaacttctcggaggcctctgtggggccttgaccacttggttccattagcctctgcggggccttgaccacttggttccattagcctctgcggggccttgaccacttggttccatcagcctctgctccctgttccctggccactaagcacggggcctgtcagcaagggctcgcggaaggcctggcaggcagcaggctgtggtgggggaggcctgtgcccccttcccatcctgtgagcagggccgccttgccctggatttaggcgacttctctgaaggcaggatagtcggtccaggcaccccctcaggtttgggcctccagctagggtttggctcttccccatcctcatgtggccttcggcccatcgccctcagaatgctttgtttgtgctcagctgggtctcagagacccagtgtttgcgctgtcaatgttgattttttattttttcttttctttttgaaatcttgtttgcttttgcaggtcttgactcaggaaaacttagccacagttctgacaggagttatggttccagcaggggcagttactcaacctcttcttatccccatcagtattgcaggtcaagtggctggtcagcaggggctggccgtgtggacaattcctacagcaactgtggctgccctcccaggactgaccgctgcttctcctacggggggagtgttcaagccacctttagccggtctccaaggtaacggcaactcttcccaggactgcaccaggccccccaccctctactacacccccgcacgtgtgcttgccatgtcggactcagaacccacggcccacccagggcaaccgccctggagtctggatccggtgtcttgggcatccggccgcagagctgctgcaccacctcgggactgtaggccgtgacgccacgctggccccgcaggcctgccgtacttcggccagctgtctgagactgcccctctccccccacgccagaactcaccccatgaccggcctcctgggaaggactacaagaagattcaacgtctggttcttgaacctacacatctcctggccccagggaggggggataagagatgctggcgtgcgccagcccttcaaggatcaagggaatcgtggctgcctgccccactgagcccactgccccaaccccctctccttcttgtgccagatcccttgggattggagccgctgtgagcagtggctaggcatttgagcacctctgtctctgccttgctccatagcagctgctgtgctgaacaccgctcttccggcaccggtacaagctgccgcaccagtacaggcctcctcgacggcccaaccccggccaccagcccagccccagacgctgttccagacccagccgctgctgcagaccacacctgccatcctcccgcagcccactgctgccaccgctgctgcccctacccccaagccagtggacacccccccacagatcaccgtccagcctgcaggcttcgcatttagcccaggaatcgtaagctgctgccctcacccagggctgaccagggatggacggaatcatgggccaagggtggaactgacccttcccacagtggaggacgagccccccccgaaaacagcccttttccaacacatcagcagaga

SEQ ID NO: 499 - DNA, 2026 bp, Homo sapiens
ttgatccgagaaattagagcagcgaaaaccaccgtcactatgagcaccaccctgggcctggtgcccccgtcctgttttcaataaacttaagctgaccacagaggacaccaggcctcggcccctccctgggtcctgcggtcaggcccctcctggagaccctggcccaggagtggagaccccggtgcaggagtggcagccctggaggaggggctgggtcctgggatggagcgaagaggaacatggccgcccccattctggcccaggctcccctcccagaggggctgcagaaatgtactgactaggtcacccaagaaaagatagtacctttgttaggctagcatgcattttcctcagggcctaatttctcactgaagaagaaaagatttctcctgttgtccatttcttcatgcagctcttcaacagctgtttctcgaatgccaatcaaagccactgttctagggtctggggccacctcaaggcactaggagatgaggacttctgctcccatgcgccctcccgtctgctgcagggaggagtgcaatgaataaataaccaacataatgtgtcagtcacttgttttatccaccaggaggtaataagagctatgaaagagaaagctccgagcaggggaggggagtgaggcatggtacaggagagcaggaggctgtcctctaaaatacaggagtccaggggaccaactgggaaggtgtgggagggggagggagggagccccatagacacaggggagtgaaccacgttcactttgtcagtttttgatggcagctcgtatatactatttttttctccctcctgcccccagcccctcccagaaggagacttaatctgtcgctcaggctggagtgcagtagggtgatctcgactcactgcaacctccgcctcccaggttcaagtgattctcctgacttaacctccagagtagctaggattacaggcacccgccaccatgcctggctaatttttgtattttttttttttgtagagacggggtttcgccatgttggccaggctagtctcaaactcctgactttaagtgatccgcctgctttggcctcccaaagtgttgggattacaggcgtgagccactgcgccaggcctacaatttcattattaaaacaattccactgtaaaagaattagcttaggcctagacggaatgggcttcatgagctccttcccttccccctgcaaggtcacggtggccaccccgtgagccactgttgtcacggccaagcctttttccggccatctctcactatgaatcacttctgcagtgagtacagtatttaccctggcgggagggcctctcagatatgagtaggacctggattaaggtcaggttggaggagactcccatgggaaagagggactttctgaatctcagatccctcagccaagatgacctcaccacatgtcgtctctgtctatcagcaaatccttccatgtagcttgaccatgtctaggaaacacctttgataaaaatcagtggagattattgtctcagaggatccccgggcctccttaggcaaatgttatctaacgctctttaagcaaacagagcctgccctataaaatccggggctcgggcggcctctcatccctgactcggggtcgcctttggagcagagaggaggcaatggccaccatggagaacaaggtgatctgcgccctggtcctggtgtccatgctggccctcggcaccctggccgaggcccagacaggtaaggcgtgcttcttcctgctctgtggggccacagccagctctggcagcctccgccaggagccactgttttacatacatatttttgagcacctgttttgtgccaggtgctgttctaggcccttaaaagtatatccaatttacaggatcggcaaaagcaggtggagagtaactcagggtggcagggcccccggagaccttcgagaagtgcgacgaggagggggctgccttcagtcggggctgttttcctgtgttaggaagactatacaatcctcccaagtgtcatgtt

SEQ ID NO: 500 - DNA, 2020 bp, Homo sapiens
aggctggcatctaagcactacacaccagatcgtccgtgctgtggcttggggccagtttgggtgggtggttctagggccaggctgagctgattgctcgcttgttttccaggcccggcgggacgggtgtctgcactgttttccaggacccctcctgagggctgcaaaaagcttccaggcctccatgttgatggcagagcaggcaaggcagctcacccttcaccctgctgacttctgtgcacatttggggccacgttttcaacagctccggcactggagccaagataaagtcagcctaaggtttccacctctgtgggtatcctgcctccctgggcctggccctcagggcctgcctcaaaccctcacccacccagccctgcactcatggggacctaggcaccctcctgggtgggaggtggtgcgcacggggttgggacggggtcaggacagggttgtgtgtgaacagccgccctggtggattcatcccaggctgtaaatgaggggtaggtgtagaaaggcccacactgggaagggaaatgtttcccccctccttcttctcctaggggcctgaactcacctcctcagcccctgagactcacccagaacctcatcaggagaccagctaacagaacgatgagaacagttggaggatcttctaaagcctttctcttgcctcatagtttatttccttgcagaatccagcccctcagatgcagctgatgtcttagccaccacacacagcaaccttttttgtcttcacagttgtctctgaagcagcttccaactaaataaaagcagctttgtaaaggacacatcattgaggctctcgtgacctgtgccaggtgggaggaagtgacctctgctctatttcccagccctgatacccagcctggcatcaggcggggggggctgttgcctggttacccatttgcatttgtaatttatcagcgttctccaaatcataaaggtttgggttttagttatgcatgtctggcccctggaagaaaggctgaatgagatccctcagggaggtaaagctttggtccctgaatcatctcttctggacaaagaggcagccctcttttttggggggtgagaacagctggtggagatcctccctaccatgtgggcaagtaggcagcccaggactggcccctccaattcactcagctcacagcatccccaggtggcagcaacatccctatcttacaggtgagctaactgaggctccagctcaggtgtttcttctctggggcccttgagccaccctgctcatggttcccaagcgccagtggaggctggtcaccaggccccagggtgggatgtggggtgtgggccggggtgtacacttgccatgagctcccagtggctgggttgctgctggctccacatttgggcctacacttgggatccactcctctcaaccctgtaggatgggagagggacaggtgagggtctcagagtggaggcactcccccacctactggcagcatgtccagcttggccaggcatccccggagctgccgagccccccttccatcctcctccccatgttcctctctgttcccagcctcagtgccctggacttatgcccctggccctggccttactggtcagcggggaaggacgctcctagaacacaccacaccacactctgcagagacttgggtttgcagacagctctcggccttctgacacccgttttttcagctggactcctcatgcaaggcccggagcccttggaagccacccatccagtgcctctgccaccccatcaaaaagggtggtcatttctgtgatctaggcctggatcccacccaagataatccatgaccctgtacagtactgagtgtcagggaatctatagcaagtgcattgccttcacctgcaaaatggctgcagtgacagtcccacctcactccgagtcggggcacggattctgtgagatgtgggaggggaggccccagcacagagcaagggctgaggagctgggggtggtcacttgctgaaggctcactcagag

SEQ ID NO: 501 - DNA, 1993 bp, Homo sapiens
aagtaaaaccaaagacaggcagcctggctccaggcctgaaaccaggcctgggcctgcctgacctaaacccagtagttaaaaatcaactcataacttagaaaccgatgttattcagagattccagacattgtacagaagaacactgtaaaaccccctgccctgttctgtttctctctgaccagcagtgcatgcagcacctgtcacatacccactgcttgcttaaatcaatcacgaccatttcatgtgaaatctttagtgttgtgagcccttaaaaaggacaaaaattgcgcacttgaggagcttggattttaaggcagtagcttgccgatgctcccagctgaataaagcccttccttctacaacttggtgtctgagaagttttgtctgtggctcatcctgctacacatgcacagagaggcaactggaggctgaggagtttcctttgtctggttgctgtggcttgctctctggggtggaggggtaggtccacaagggacacagacctgagccccacccaggttttggcaccagatataaggttcttgaattggtttgatccctgagagcatgccaacagacaacacgaggcagtgcggagcagcgtgctgttttaatgagtgcctgggtgcaggtgggctgaggcctaaaatggcatcagccccaagtgaggatgggacagtggttttatagttctctgtaaagagtaagtgtcccaatctaacgtgactgctatgtagtatctggatggcctcttgatcttcaagggttcatgtctccagccagggtaggtgtcttctggccggctctcttcctgcttctgctatcttgctgacacacgctgctgatgcaagcagccttgcatcttgggactgggcctgagaagggaggagttactcatcccttcaagctttcaggccccagaagaatctttgaaccccctgctccgctggccaccctcctaaaggatcactgtggtgccaggcaggaatgagctgcttgggtatccagagagctcccagtacctttctgctacttcctctacccctatattttgcttggcttggttctctaatttgactcagcttcacataaagtcaggaacttctcctgcaaacagaacttcagcttctccagtggggatgtgtattctggagagggggatcaccctttcccacttccattgttggggcactcacagtgtttgggatgtctcccaggtcctgcaggagcagtacgcttcctgcagagggtgtgtggatcctctcagaattgctggtctgtccttgcagttgacctgcagctaaaattcacaatgcaagcctctgcatgctgctctgtctggagctgcaatctagtcctgcatcccatctgccatgatcactggaaaaccctcatttattttttaaagggtccagaaaatgctaatctatagagatagaaattagattagtggttgcctagggtaggatggatgcaaaatttcagagtggggggttagaggctattgtatagaatcttttggagataatactgattattgtagtgaaagtaaaattctgtgaatatactaggaaacattgaactgtacacactaattggtgagtcatatggtatatgaattatgtgtcaacaaagttttagaagacattacttgcaccacgatattaaaaaatggcgtttgagttgtataattacttcttctctctatgtcaagggcaccgaacaggcaggagcctctcacctgccactgttcttaacagtattataaaataattacataagacaggttacttacgtattctaggtcataaaaattattgcttgactagagtaattgtaaatataaaagaacaccaaacacactaaaataaatatgaggtcaactcaaattttagcagttatattttaacttgattgatttttcctcagatataagtatgagaaatgacagaaagaaacaacaactggaaaagaagcactgcataagaccagg

SEQ ID NO: 502 - DNA, 1953 bp, Homo sapiens
gggtttctgctcatatctgctgtctccaagaagctgagggcagtggcctcacttcgaggaagtggtgacactgcgggccctcctggttacaaggaccgggcactgttggaccacgtggctccatcatgatgactccagttagatgtcaccccgcccctgagctcaggtcttgctgaataaggtcaccgcccagggggcagtcgatgaacacgcgcgcgagggctctgcgagtggcctcgtgactttgtccctaactccgggtgtcccctccttcccatcagcgtccggcgcctggtcctggtcccggtccccgaggcccccgggattcttcccgagcgttttccgagttggcgcggggggtggaggcggggccatggagcgcgtcccggggaccgttgcatccggaggcggccgtcgtgcggctccttcccgcctcgagagtgaggtggccgggccttgacgagaaggcccacgcctgccgcgggggtggctcgcgatggcagtcggggttcgagtcccgcctggggggctgctcctgctggagaaaacgcctccctgagggcggcggcaaacgcgcagcgaggccccgtgccgcgccagaagccaccctgagaaaggggcaccgggacaccgaggggttcccactttctcctcagcctgtgacgcccgcgtcctcgggtgggttcgaggggcgcctgggcacggccagccgaggctctcgagagccccagtgtcgttttccacctcaggcctcctttcctgaggcagagcccgggacctcgcgctctcgcctcaggctccggcccacgctcccgcccggccgccaggcgcgcaacggaaagcgcccccgccccgccccgctccgcccactgcgtgacgcgcacccggccgagccaatcagagctcgtggcgcgcgccccacacgccggccccctccgcccctcagcttaagaaagggcgcgcggacccggcaggccagagtgccgagcagcgcggtgggtgcggctgtgagacggcaggagacttctgccccgcggtgcacgcgaccctcgagacgacagcgcggctactgccagcagcgaaggcgcctcccgcggagcgccccgacggcgcccgctcgcccatgccgagctgagcgcggcagcggcggcgggatgctggcgctgctggccgccagcgtggcgctcgccgtggccgctggggcccaggacagcccggcgcccggtagccgcttcgtgtgcacggcactgcccccagaggcggtgcacgccggctgcccgctgcccgcgatgcccatgcagggcggcgcgcagagtcccgaggaggagctgagggccgcggtgctgcagctgcgcgagaccgtcgtgcagcagaaggagacgctgggcgcgcagcgcgaggccatccgcgagctcacgggcaagctagcgcgctgcgaggggctggcgggcggcaaggcgcgcggcgcgggggccacgggcaaggacactatgggcgacctgccgcgggaccccggccacgtcgtggagcagctcagccgctcgctgcagaccctcaaggaccgcctggagagcctcgaggtagcggcccgcggggagcgcgggggacctggaatggggacgctcccgagtcgggggcggaagactcgggaggatggggaaagggggcctggccctggggagggtgtgatcgtccgtgggggtgagctggacttgagggtgaaaggcggggatctagatcctgctcgggaactcccctgcgtggtatcccttcccacaccgctgctcttgctggaaggaaacgtttaaattccacccccgcgcgtcgggactgccagcgggatccgccgagcacttcccgaggtccgggctagcgaacccagacggccaagccgcgggcgccaaatacccggggacgcggtagcctctatcctcttgcaaatctccaaatctc

SEQ ID NO: 503 - DNA, 1799 bp, Homo sapiens
agtgttgtctctcagacccttggctttttcaggactgcctgacctttctttgtccttatttggcttcaagtcaagtcagctcaaccctgattgagcaccggcaatgagtcatgtctgtgaaggcgacacagcccctgtccttgaggagcttcgagtccagtgactgtcacttcagtggaagttgggctggacacagtcacatgtgtatgccagacatgaggctttgttctcattacaataattgccctgcattattctagcaattaagcttctccacgtgtgtggatgcatgttcccaattttttctggcctctaccgaacacaatgttaatatttgagagcagtcctaaaaaattaaataattatacaaactgaattaggatagcataatattaccaatcagagtaatgtggctttgtaatccagtgtgatgtcatatgaatctacaaattaggaagcatgtcagaggaggaaaccacatcctttattgctttgccttaaatagcttaaaactaatcttttccatgagccaacagctatctctcatgtttaataatgctcctccctgcccagatgaagctaactaaatgatgttgccccctgcacctgcaaatgcctggtgccagggcagggacacagggaatggcagaaggggagaccagatgttggctgaggcattgatttatgggcatgaccttccatgtgccccgaggatggctgagaccagggtttgatgaatgcagtgctctgtgtgagaagttctaaggtgacaagcaaagattctatcctctggaggggcaagccctattattaggttggtgcaaaagtaatcgcagtttatgcagttgtaatggcaaaaacagaaattacttttgcaccaacctaataccagacagaggaggtgcaagtgcatgccaccagggcaggtgcaggtgatgggggcagagaaaactcagatgtctccaatctgtgcagagtagggaaacagaaaaagctaagtgaggaaagtgagattgctatcacacagatgcatgtcttaggttttctgattccattcctcatgaatttcattaagtaatcaaagtgctaagcatgaaatgtgggtatgctgtcaccaggtggcagcagcatccactctccaaaatgcattttgttcaaacctagtatgtgctgggtattctgagcacatagcagagactaaggcaaagagtccctggcactgtggagcttagaggctaatgaggtggcaggtgcttacactttagaaaccgttgtgaggaatagctagtggtagttaaatgatacagtgatagttaacagagaggaaagcttttctctcactccaagctatatttttattatcactattaatataaatagaaaataaatattaaaatagttattaaataagcaaaagataatgttgcatttagttatacgattaagtagaggttttcaaatattttttagctttgtgcaaccgaaattatatgaggaagcaaaaaccacaaatacagaaaataagaacttttctgtttgaacagaaacgaggacactggggaggcccttccaatgcaggccagacttttaggggctcgacagaacacagctggagaaacatccacaccacacgcggtttcacctgccacacggcagcccgggtgcccggatcactgtgtgtggagactcaggctcaccggcaaacctcttccggttccggtcagggtgctgcctccctatccactgggagtccttttgcgtttcagatgctcccaggctctcccgcagtttaaagactt

SEQ ID NO: 504 - DNA, 1793 bp, Homo sapiens
ctgtgcctgacacaagggacacacgggacatgcagaaccagatcagccaccgctgccgggcggactcaccgtctgcagaccctcaggccctgggagtttctcggcccgacctttgccctccgtcctgttcctgtttgctgcagcagccaggggaggagcagccaccagctcaagccccagggcacgtctgcaccgccgcccaccatctgcagcccaccccggggcaggacgctcctgcctccacagccccgggggtgagtgcccaaacccaggagaatccaagctgtcctcgctgcctcttgctgcgccgtcccctccagggctggccagagggtgacaaccctgccaggccgggagcctgaggccctcaagccactcagcattgctgcctcaagggcctgggagggaaggggtgggccctgggaggtgggtgtgggactccaacttgggtggttctgcctctagtttggactgggccttgggtgactgagggtggcctggcaggagagagctgtctgggggcagaggccaaggtgggcatgttggtaccggccccagcctgagcagacacacctgacagctggcccaggtggcgttctcttctcagcgggcacaaagggcatcccagggcaggcctggcagcaagtccttaccagccaaggtcactcctcaagtcctactcacccaggtgccctgaagtcctgggagcagcgaggggggcataggagccagaggcagtgggggtgggggcgagcaggcgatgcgggtgcctttatcgggtgcagcactgacctaggcacactcttctcatcgccagtcctccacagaaccttctggagtggatgtcagtatctccattttacaaatgagagaaactgaagctctgagaggaagtgacttgcccaggggtcacacatgagagccacacctgggattccaatcagctccccagggctccagagcccttctctacttctgaccctgctgagcatgggcctatagacggtgggagccagactgaagacttgagtcctggaaaggggaagtcagtcaccaggggcatatcaggggcagggtggggcaggggcggagttggccgtgtaccccatgccagggacctcccagtcacttgccccctgcctagggctctgccaaagctggacaggctaagccagaggcaaggcaggggtgccagccctttgcccagggccagagggaggccaggaggaggtgcctgggctggttggcaccttctccctatccacgctctccctccagtcccaagtgacctttcccccagatcccagggtccaggcccgccctcggctggcaggtgtgggcacagaggcagctgggattggtcgcagctggcggaggcgcgtcccaggctccggcagaccgctggaacagctgagcagagcaggtggactgctgagatagaccagggacaccaggcagccacaggcctgtcagaccaggacccttaccctctagacatggcctcggtcccctgcaaaccccagccccgtagccctgcgaggttacagacagcctaaacgccaccaccacagggcctgtgccgtgcccctgacccgggcacagaaggccactggcccggaggccatggagacggtgcccccagcagtggacctggtgctgggtgcttctgcctgctgcctggcctgtgtcttcaccaaccccctggaggtggtgaagacgcggctgcagctgcagggggagctgcaggcccggggcacctacccacggccctaccatggcttcatagcctctgt

SEQ ID NO: 505 - DNA, 1787 bp, Homo sapiens
cctcccaaaagctgggattacaggtgtgagccaccttgcccagcctagcgacctcttcccaaaagcccctcttgaaacagggacagtcagactccaatgaggcccaaggttaagggatggtaactctgctgcaaacccccggcatttggagctttaattcctgatgtaagtctcagacttcagagccacactgcacatctcacaacagccgctggtccagtgtgctggagttctaatgtgggtgctgtacacagagaccctgctggcaggaagcgaggacactgagctgccatctgttttcattaagccttgctgagtagggaaggtagaaattatctgtgttgggtttgaagcactgcaaacatttgtttctgagtggaagggccagagcagacccaaggactggctaggcagggtctcctgggcaagaaatagtgcccctctggatgtgtgaggcagcgtctggatgtgtggggaaggtgctactggccaacgtatgtcgcctgggaaaatggccactgcccacccagaccctcgggattccacacccagactgtaccccacctcagcctctgcctggtccatgaccggtacccagaaaactagacatcttccagagtgatgtttttgccctaacatccccttcaaggtatcatgaagatgcccaatattccatttcctccatcaaatctaaatccttctgcttggttgctaagggtccccacactcagacccgactgagcggctcccagcccacacaggggacctcctgtgacaccattctaagcctgtgtgtgccccaaatctccagaagccctcactcctgccctctgctgcacctggccacgtctggccttcaccctagtataaagacaccttgcagaggagtcacagatgagctatttagcagtgcctccgtttccttatctattgaatgggggaaataaatgcacccacctcacggggttgctgcgtttaatcagaacgttcgtgctcagcatttcctgggtaatgctgcgctctggaattggccccgcccagccccagcaacagcgagccaggtctgactccagatcacattcacctcttccctcttccctctttgaatctttacacatactgtttgaattgcatgattaccatgaaacattgtccaggtaggtgtctttctccccgtttaggctgcagcgtgcagacctcctacactgtcacccctctgcatttcctcggttccttcgcggcatctggccccacacagccttgggtctggactcagtagttttattttcattaatccactgaaatgctgtcacaaactcctgaacactttctttcatgaggggcttcagggggaagactgaagagaagttatctttctaatacagcgctctgacaggccgacagaaaatctgatcactagagcattggcctgcagacgctcaccaatgtcatatatttaaggaacaaaaaaagaaaaggctttgttaaaatgacctctgagaggcagctgagttttcagtggacgggagaatgccatctgggtgggggctagcttccaccgaaccctgactgtcgctgttccttccaggaaagccctggaagcccatagcgtggctagccctgcctggagtttccacgagcttcaagaatccaggctccccctctgagggcccccaaagctgtggtcaaaggttaatgggctccaagggcagctcccagggttgggaggtatataagaacccgtcagatcagccggacaccagaagacaagcagagagactcctcca

SEQ ID NO: 506 - DNA, 1783 bp, Homo sapiens
atggctggtaccacctcttacctgttcctgagggcagggtaacctcccatgggaagagctgggtctctctctctctacactttgtctagcacaacaaacaggttgaaccagtaacatctcccagaagagcatgaaaggttgccacgtggcctgagcctgcagaggcattctccgcagggccacacggtggttctgcgcacagttaagttgttcagttttcatctctcaccatcttcccctcctcatcacctccacctggggctgcgtggattctgttcagcgacccagcctcactgtggtggcagaggccagaaacatacccacaccatacagtgtgatgtgtgtgagaagggatggccaggggacagagcaaggtgaaatgtctgtccaaagtgcatgagagcagtctgcagcaaggatggcaggaggcatgacagtaaggtcatcccgctcactgcagtaggtctcctctttaaccatacacacacgcacacaattttctgtatgtttccttagcacccagaagttattcactttcaaaatgatcagtctttttactgaagcttactggctttccaactagtcctaaattgtgaggctttactgaagtacttgagcatgtgaagtgaactgaggaggaaaatggctttgccggcagagtttgagatgcaacgagtacaagccatttgcctatgaagaggctgtttcctccctctctcagggaggacaagtagccagtctgtggtgacatctgttgtctagatgcacagcttttcgatgcctaaaaaagatgctttgggtgcaggggtggaaagacttggttgtgccttagttttcttatcttagtcattcctgttaaccttagaaaaaaggtgaaaaacttactgaaagataagaaacaataagacacaattgtacattattagggatcctatgcttggtagaattttcgcaatgtaaataaattacatctcaagttctgatccttttcagcagaaattctttcctctcccaagtctagtcactgagaagcaaagtgccgttgccttttatttcttcaatgcttctttttggtgcctgaatgcacaccaaggaagagctcctctccagagcttcactgcatcatagacttgtgcaggggccagccagagtgtttctcaaaatcttttaagtctctgaattataaacagagctaaatgggaccttggagatcatcttgtccagccccctcctagagaaggagactgaagctcagagtggttaagtgacttgcccaaggtcaacaggatgctgtgttattattattatgattatttttgcatcaggacttgtgggatctgtagtaactattctcttggccaattataatcacatcactggcattgttttacgagaaatagccccgctaggcccagtcagcaataagtctttggagctgtctcagcctgcagttgctttatataaaccatcccttttatgggagttgaagcactgtatgaaaagggtttttgtctcatgttgaccttgtttagtcacattaacgcacacatcagttccaggccccattccattctctgaacatcttctgacacactgacagtgctgagcagagcaaggttgggttcgctcctctggcagaacctcggctctcaggaggtccttgttccagggaacagctgcttctctggggctgggctctactccctgcagcccctcgcactacccagctggaaccagggacaacgcctgagtccaaccctcgtgtctattttccagaaaacgg

SEQ ID NO: 507 - DNA, 1781 bp, Homo sapiens
ccaatggtataatctgcctcagcctcctgagttgctgggattacatgcatgtgccaccacacccggctaattttgtatttttagtagagatggggtttctccttgttggtcaggctggtctcgaacttccgacctcagttaatctgcctgtctcggcctcccaaagtgctgggaatacaggcatgagccaccgcactcggccccaaaactcttcttaaaggtggtcttgcaggtatgttatagttaaaatgaagtaggttgtcttgctttgttcttaagtggctttccagaagtctaactggtctaaaggcagtcttatccccctcactggtgtatagttcaattcagacttgaatgcgaggtatgggtttacatctcatctctgccacttataatcagtgtatccctcaacaattaaattccttagtctccatttccttcctccttcaggggaagttaatattccacaaagttagaagttacaggagaggaaaagtagtaaacgccccaaaatgaggcagttacttctattatatcttcaaaggatacatggctcaaggcagatcaggtagttgggagatttcttaaaaacagcataatagctaacatgaacattttcattattcagagaaatttgacatagctttttaacgtatgtttctgagaaaagttactagttatattgtcttcctccaagaattagtctttgggtacagatgaggcttgaaaaaatgacattccctcttagactaggtagtgtgaagggaaaaaaaaaatgacattcctcttcccccaaagcagagtgaggtccgtatgggatataggtgtaaagaaaattttgggccgggcatggtggctcaagtttgtaatcccagcactttgggaggccgaggtgggtggatcacttgaggtcaggagttcaagactagcctgaccaacatggtgaaaccccatctctactaaaaataaagaaattagccagctatggtggcacatacctgtaatcccagctacttgggaggctgaggcaggagaatctggaagcaggaaggtctcagtaggctgggatcatgccactgcgctccagcctgggcaacacagcaagactctgtctcaaagaaaattttgtggaacacctattttctcactgacatgaaaaatgtttcaaagatgaataatgtccatcaagctatggcaatggaagtgaggatgataaaggattgcacagttgttcacaacctcactgttagtatcctgctgagatagttggtctcctcatcactgtagcatcttttatgtacagcagagggcagaagctccttggcatgtatgtgagggaaccacatatatggaaggctgttattcctgagaaaggaggatgtgcagacactcacagaacaaagcctttgtaaaggaaaggcggccgatgagatggagtgcttccttcacctgtggtgggtctgtatccatgaaatcgcccactcacaatcgctttttgtagctactggaagcactaggcgtctgacctgccatcatccttgttatgatgtcataatcatattctgtccgtgtttattgcagttctctggtttgtctggagtgtttgcaagtcagtcatcatagtggcagcttccgcctgctacaggatatttatatatggaagcataccatggcaggagtgctggaaaggtggtgtcagctaacagttgcttcagccagataaggacggtaacttcagtccaataaaaacctcatcagttaccaactaaatcagggcatgg

SEQ ID NO: 508 - DNA, 1781 bp, Homo sapiens
tcttgccttgctcttgctactctgctctgggtggtcattgtgaaaagcccgcaccaaccatgccagtggcagccagacgaggacacagcctggctctgggtcccagcaggaaaggcaatcccagaaaggcagggtcagggactggagtcctgtgggtgctttttaagcaaagattatcaccaggcaggctaaacttagcaaccggcttttagctagaagggcagggggctggtgtcaggttatgctgggccagcaaagaggcccgggatccccctcccatgcacctgctgatgggccaaggccaccccaccccacccccttccttacaagtgttcagcaccctcccatcccacactcacaaacctggccctctgccctcctaccagaagaatggatcccctgtgggagggggcaggggacctgttcccaccgtgtgcccaagacctcttttcccactttttccctcttcttgactcaccctgccctcaatatcccccggcgcagccagtgaaagggagtccctggctcctggctcgcctgcacgtcccagggcggggagggacttccgccctcacgtcccgctcttcgccccaggctggatggaatgaaaggcacactgtctctctccctaggcagcacagcccacaggtttccaggagtgcctttgtgggaggcctctgggcccccaccagccatcctgtcctccgcctggggccccagcccggagagagccgctggtgcacacagggccgggattgtctgccctaattatcaggtccaggctacagggctgcaggacatcgtgaccttccgtgcagaaacctccccctccccctcaagccgcctcccgagcctccttcctctccaggcccccagtgcccagtgcccagtgcccagcccaggcctcggtcccagagatgccaggagccaggagatggggagggggaagtgggggctgggaaggaaccacgggcccccgcccgaggcccatgggcccctcctaggcctttgcctgagcagtccggtgtcactaccgcagagcctcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccaggtgaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtc

SEQ ID NO: 509 - DNA, 1772 bp, Homo sapiens
gaataatactctgttgtgggccgggcgtggtggctcacgcctgcaatcctagcactttgggaggctgaggtgagtggctcacttgaggtcaggagtttaaggccagcctgaccaacatggtgaaaccttggccttactaaaaatataaaaatgagcagggagtggtggcaggcgcctgcaatcccagctacttgggaggctgagacaggagaattgcttgaacccaggaagcggaggttgcagtgagccgagatcacgccactgcactccagcctgggtgaaagagtgagactctgtctcaaaaaacaaaacaaaaacaaaagaaacctctattgtgtggctataccacatcttgatccctcctctgtcagtggacacttcagttgcttccacctttgggctatagtgaatagtgctgctgtgaacatgggtgtttaccagctaatacgttttgggtgttgccatgtctttatggcaacgttgaggatgtctttatttatttatttatgtacttatttttgagacggcgtttcgctctgtcacccaggctggagtgctgtggcactatctaggctcactgcaatctccgcctcctgggttcaagagattctcctgcctcagcctcccgagtagccgggattacaggcatgtgccaccacacccggctaatttttgtatttttggtagagatggggtttcaccatgttggccaggctggtctcgaactcctgatttcaggtgatcttcccgcctcagcctcctgaagtgctgggattataggcatgagccaccgcaccgggcctgaggatgtcttaatagggagaaggggaagcattgagctgaatgaggtttggacggtctggaaaagcacatctcgttttccccttgcctcctccttttttcctttcttctctcatttctccaccaccttcccccccgccctaccaagtagggagcttttgctctggtgtaacccattctaagcaccctaaatcctatctgggtaaggggtagtgagaagtctgtggctccattgtgcaggtgggaaaagtggctctaaaggtcatagcaactttcccagagccaccctgcattccaggaacagtcagcactcggcccgggtctgtattcacttccgaagcctctttccatgagaaaattcctggatatacacttctatctgcccagctaccaggggccgggaagagtcctgtggggcagcccttgggcctctcctggaaggaacagtttactttgggaggaggccagggctgggcggggacccccaagcactcagcctagggggaagtgattgtgtttatttatgtggcaggttggcagggcccaggcctgggggatgggggaagttggagaataaaagaaaatgtgaatatctggctggaatggccagggggaggaaagtccctccccagtccctatttataggctttgtgtcctgcaggtgagagacctgccaggagcagagcaggggccaggtcaccccggggtataccgtcccccagcgcaaaactgggttaatgcctcagggagatttccgtaacctaagtccaagggaaagtctggcatgggtgttccctcctctccctccccaccctacagtggcacctgagcctcaggttctctcggccctcccccagggtggtgatcatgaactcgatcctggagcgcatgtgtgccgacgtgctgcagcagacagccacgcagatcaagtttccctccaccggggtggacacaatgccctactggaacct

SEQ ID NO: 510 - DNA, 1772 bp, Homo sapiens
gctgttctcactggactccttgttcctttttctttcatttgtttgtttttggagatggagtctcgctctgtcacccaggctggagtgcagtggcacgatcttggctcactgcaacctctgcctcctgggttcaagcgattctgctgcctcagcctcctgagtagctgggactataggcgcatgccaccatgcccggctaatttttgtatttttagtagagacagggtttcactatgttggccaggctggtcccaaactcctgaccttgtgatccacccgcctgcacctcccaaagtgctgtgattacaggcgtgagccactgcccggctccttgttcctttgaactgtctcgctcaggacaggacggtagtccttctgcatcctgcaagacttggacaggatttctttccatttaacactgtctcctaaagtgctgctttccttggggaactttgctgttcttgctagtccagaacaagtggcacaactgcccttgacctccacatgaccttctcagggcagcccagactctaaatgtctgtgacctgcaccagcagcagcaaggccatgccggccgtggtccagcccggctgctctcccccactctgcagtgtttttccacacccatgctgcaggtgctggttgcgttcctgctccatccttcagtgcggaagtggcattttgcggttttctgttgtcatgaagcaagtgcgccacacttgcctgtcttatgtgcgtgtgtatatgagcatgcccatctcagtctccctgagcgcctcttttccacccgtctcaggcctctgtgttagctgttccctctctctgaaacaccaaactccctgatctcagcctgtctctccagtctcgacgtaacagcatcttcccagcgaggcctgctctgaccacacggcccgggaaagcagcccaggccccctctcacttcaccctgtgcccattcttgaccctgtgtattgtgtctctcccttgcctggtttgtgtcaggaaggcagaggccctgcctgtcctgctcactgccgcaccccaggcccagcatgctgcctggcatgggcaggcattgacttgatattagctgggcaatgaatgacagtgactgaaaatgtaatagcaagtcagggcctagcacaggaaaataagtgattgctatgtaagtgaagggttgctaagtaggatttgggtcataacatactgttaaggataatttttttgttctctacatgtaaaaatatgtatttttaaaaattggatgtcatgggctgggtgtggtggctcatgcctgtaatcccagcactttgggaggccgaggcgggtggatctcctgaggtcgggagttcgagaccagcctgaccaacatggagaaaccccgtctctactaaaaacacaaaattatccaggcatggtggcacatgactgtaatcccagctactagggaggctgaggcaggagaaacacttgaacctgggaggcggaggttgaggtgagccgagatcgcgccattgcactccagcctgggcaacaagagtgaaactcggtctcaaaaaaaaaaaatttgatgttatggaatgagggagacaaaaaatgctctacaactattaactgatgcttttctggttttgttctccagacaccattcgcttttcacccaagatgatttgatgtcttataaaactctgatgaaccatgatggctacacagacattaagtatagacagctatcaagatgggcaacaggtgagcttgaacttgattctgca

SEQ ID NO: 511 - DNA, 1766 bp, Homo sapiens
ctgctgatctgggtgtactgctagttttttggcctggatgccccaggcctctctgatcataatccagatgaaaaagaaggcctgtgtcagaagtatttcagttgttttctgctgatttacttctgattcccttaggctgctctgggcagtggctaagtgccctcagtatcagcttgccggctcagcactttcagaagccttcacttgctcaccaatgaggaagttgaatgccaccaggagaaccgccggcctggggcggagctcctcgtgaagtcctgggttgggattacagggcaggctgactttccctatgacaaaaaggcttttgtccccgggaataaatacggaagtttcagaagagcagcctccctggtccgtgtgtagtaaggtgcgcagcctcggctgcttctgggcatagactccacagatttttcacagttgccctggaacacatcatcgcacaaaccggaaggagggcactgtgacccgaaagagaccaagtgtgtttgctgtgcggctgacagcctgactcccgggtcctgttgctctctgtcctgtaaattaagagcagatggagtggataaactgagagcgcaggagaaggtaacacaagtcagaacttccaccaagggcattactgagacatggagaacgttgataattctctggatggcagtgatgtgtcagaaccagcaaaaccagaagccggacttgaagtggctcagtcgatcctgagtaagttctctatgaaatccctatttgggtttacgagtaaattagaatctgtgaatccagaagaggaagatgctgtgctgaaagcattccatagtttagacgtgaatcccacatctcagcaggatgattccagcaatggcttggatccacaggaagcagggtctcgggtttcacctgacctcggaaatgatgagaaaattgcaagcgtggagacagaatcagagggaagtcagagaaaagaagcagggacatctctccttgctcaagagctgcttccactgtctactttgaaagggacaaaagacgatgtcatttgtgttcgtgggaccctggtgcacaccaccagtgattctgactctgatgatggtggccaggagccagaggagggaagcagcaccaatggcccaaagtcccctagtggtgttttatctgagccatctcaggagtccaaagaaaacccaggaggtttcagggaaaatactgtcactggggaaatgaatggtgcagagctctgtgcagaagatcctcaaaggattccacctgagatgagcagcaaactggaagctggcaacggtggtcttcagacagagcgtcgccccagccaggaccaggtgggagaagaagggtcccaagacctacctgcagtaacaaaccagaattcgagtgttggtatcactgagagtgcctcttctaaaaaagaagtctctggagagaagtcattccaacttccagcttttttcagtgggcttcgtgtgctgaagaagggggctaccgctgagggaggagagaccatcacggaaattaaaccaaaggatggggacttagctttgctcaaattgacgcagcctgtgcagaagtccttagtgcaggcagggctgcagacagtgaagagtgagaagaaagcaactgatccgaaggccactcccactctcctggagcagctctctctgctgctcaacattgacatgcccaaaactgaaccgaagggagcagaccctgagtcgcccaggagagaagagatgggctgcaat

SEQ ID NO: 512 - DNA, 1691 bp, Homo sapiens
ctcagcttctcaggactctggacattcaggtggcgctgaccggcctggaggtgtggaccgagcgggaccgcagccgcgtcacgcaggacgccaacgccacgctctgggccttcctgcagtggcgccgggggctgtgggcgcagcggccccacgactccgcgcagctgctcacgtgggtgcctctgacccggacgcgggtcccgggtggggcggcctcacctcccggccccgcctggtcacgccgcgctccgcccccaggggccgcgccttccagggcgccacagtgggcctggcgcccgtcgagggcatgtgccgcgccgagagctcgggaggcgtgagcacggtgagccccgcgggcgggggcgagggagagacaggaggctctacggccgcagtgaccgccctcccacggccccccaggaccactcggagctccccatcggcgccgcagccaccatggcccatgagatcggccacagcctcggcctcagccacgaccccgacggctgctgcgtggaggctgcggccgagtccggaggctgcgtcatggctgcggccaccgggtacgcgggtggggggtcggggctgcggcggggcggctagtcctggggacttcctccgctgcgtttctttggtcgtccctcagtttcctcttctgtaaaatggggataatgatcatagtgtccgcttcagggtggtttatgaggcttaaagggaagaagctcaggcaaagtggattctcaacggtatgaagattattttccgagtaacctggcgaggttactcctacaccgggaggagcaccgtcgggtcgcgattccaccttgggtcccgggctgctcactattggggccgcatcgtcccctgtcccgcttgttgtgtgactttgcgcgggttacttcccctctctgggctctgcgcgtctggcggctgtagccaagcccaggggtggggatcagagaagcgcgggggttgggggactgtccctccatgcccaatgccctccccgtgccggtaggcacccgtttccgcgcgtgttcagcgcctgcagccgccgccagctgcgcgccttcttccgcaaggggggcggcgcttgcctctccaatgccccggaccccggactcccggtgccgccggcgctctgcgggaacggcttcgtggaagcgggcgaggagtgtgactgcggccctggccaggttaagtcggctcgcccggcccccacttgccctctccgctcaggtctggggcgctgcgccctcacctgggcccttcttgcctttctggtcccaggagtgccgcgacctctgctgctttgctcacaactgctcgctgcgcccgggggcccagtgcgcccacggggactgctgcgtgcgctgcctggtgagggcatggaaggttcagggtgagggtttcggggagcttgggagccggcctgttggccttagttaattggtgccctcaggttcccccgttgggtgctgggcttgggtaggcctggctcccccagctccgagccgcgctctcggcatggacctctcactgcacgtggcctctctctgccttccccaccacccgtcacctgcgcagctgaagccggctggagcgctgtgccgccaggccatgggtgactgtgacctccctgagttttgcacgggcacctcctcccactgtcccccagacgtttacctact

SEQ ID NO: 513 - DNA, 1686 bp, Homo sapiens
aggagtgagacagaaaaccagcagggccccggggaccgagccctggagaagcgccagttcccgcccagatgagggccgacacctcggaaggaccggcctggggggtcgccctccccaggccctctgcctcccatcgtggcatggactgcacctttggtgtccttccctcccatggcctctgagtccctgaacactggctcatacctgctccacccagatacagcacagaggagagacccgggcagcctctaagggcagtgccttgagggccagtgcctggtgcacctgccgcacagggcacaggacacaaagggctgggtgatccattcaggctctctcagggcccgcgtcgagctcggcctgggtcccaggaaggctgccaggcaccaggtgctgcctgagtccgaaggaggccctgactccaggtcgcccacggcaggagtgggccccacggagcttctgtggacccttgacccgccaccctcaggtggaagccatcaggctgcgctggataagccagcctctccccacctctgccattcaagtcggtgccagtgctgactggagagatcccagagataactgtgaaatgcctgtcactgttctcagcttcgtttatgtaggctgcagagccaagacagcaaatactgcacatccgggagcctccccaaggccggccctgggccttcccccaggaagagccccacggccagctccttcctgttcccctggcggcccctcgcttcttccttctggatgggggcccagggggcccaggagagtataaaggcgatgtggagggtgcccggcacaaccagacgcccagtcacaggcgaggtaaggtgcttggctccatgggtggggcccggcaaggtcacactggcccttgctttggagtcaggaggcctctcttcttcccacagagccctgggatgcaccggccagaggccatgctgctgctgctcacgcttgccctcctggggggccccacctgggcagggagtaagtcagtggggtctgccctcaatctcccctgcctccctccaggagagccagggactcacccggcccttgtcccagactaactctggtcacagaaccatcctgtctgcctggaggggtggggtcccctgttctggcagaggtcacccccatatcaccgcatggggattttcttccctttgggtctctcttttcttcagagatgtatggccctggaggaggcaagtatttcagcaccactgaagactacgaccatgaaatcacagggctgcgggtgtctgtaggtcttctcctggtgaaaaggtgagtagggctatggtcatgggcccagcgccatgtcccctcccatcccacagtttcaggaactcagggcagggggtaagcacccgtggccacttttgccacacatgcctggctactgtcgatgcttcctggctcccgctgatgcttcctggctggagcggagacggtcagaccgtcctccctaccttctcccttcaacccaagctcaactcaaccaaaaatggcccctctgtccccatgcctgataggaaagtcaggggaaagtctgtccgattactgtcaaagaagacaggaggtaagggtcagagtggaccactgactgaatatgagtcgcagaagtgttagaggcagaagtccagggccatttccttaatatcgaag

SEQ ID NO: 514 - DNA, 1577 bp, Homo sapiens
ctgagctttggagagaagagcactccagcagggaggactaccagagcaaagtccgggcggcccaccagagcaaaggccgggagggccaaaggtccgtgcgccttaaagtgtgggaaagtagtgaagatggggagacaggaaggcaggggccagatttacctttgcaggctagagtagagttttgatttttttttttttttttttttggagaccgagtctcgctctgtcgcccaggttggagtgcagtggcacaatctcggctcactgcaacctccgcctacccggttcaagcgattctactgcctccgcctcccgagtagctgggacgacaggtgcgtgccaccacgcccagctaattttttgtatttttagtacagacttggttccaccatgttggccaggatggtctcgatttcttgaccttgtgatccgcccacctcggccatccaaatgctggtattacaggtgtgagccatcacacccggccaagtttttattttattccaagtgtgatagagagagacatgatctgacttatatgttttgaaagatggctctgggactgttatgtggctactgggctgtccggaggggaaactgagacccgtttggaggagagggaagttggtggcctggatagagtggtggcagcagttctggagaaagtggatggatctgggttatgtggtgagtcagagtggccaggaacaaatgacaggcagatgaattagggtgacccttagatttctggctgcatgcaacactcgggtagttactggggaaccgagcagacgctcagacacttccgagccttgagaaatccgttctcccgccaggcttcggtgtgagttaaagtcgggcagccggaaagcgacaggctcagacccgcagccggtggcctcgtagcgccgggacgccgggacgcctggataccgggagagcgctgggactctccgagcccggcgcgggggtttccgcatcttacgggcggggccggaagaggaagtcgcgctgctgtggcggccgctgtagcagcggcggtccagtcgtagcccggccgcccgcgcctgtccggtccggtccggccacggaggcagcgcagcggcgggactccgagcctaccccgccgagtgagctgcgccgcaccgtgccgtcccacccggcacccaccagtccgatggggccgcagcggcggctgtcccctgccggggccgccctactctggggcttcctgctccagctggtaagggggcgggaaggcgcgcaggcctcccaggggctgggcggggccggggccaaggccggggctcccttcccctactcctcgcccggcctcccctctgcccgcacctccgcggcctgctctcgcactcctctttcctcccctcctctttccattactcatctctttccttccaccctcctcttttccaccctctttcccccaactttcccgccccccactcggttcccgcccattgaagtctggcgaaatacctaccgcaaaaagatcagaggagccccttaggttgcgttgaccttgatgcttctcgatagttgctcactgtcccagcata

SEQ ID NO: 515 - DNA, 1567 bp, Homo sapiens
ggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaagtaagtatggcttgctggggtcggggccgggccgggccagtcacggtgctgatggttctgtcttccttccttctctcctccctccctcccttacttcctcttaacaccctgagctggacccgtctggcgcctgtgtcctccgtgccagggagagcgtggttgggggcctgcgttacggactttcactcaggcaaggccagttgtcgcagcggggcgtgcgtttgcatgggctcttggactccagttaaaatgccctggtagcgaaaccctcctgagaagggagcggcccccaatcccctaagactagccccttggctcccccagctgtccaaggagcagaggcgcccagtggaatcagcctgtgtttgtttgggccccgagagtttgtgtgcggccgccaacacgttttctgcgcagtgtgtggccgttaccggggccaggcgaaatgtgatttgtttatcctgtcagaggggaaccctgggctgccaaaaataactgtttgcaccggcttatcagtcagcaggagggaaacgtagcctttcctcatttgccagggatgtgacgctggaagcatccctggcccccggggctggaagccctgcccgagggggactgtgcctccctcccgaattgcatccggaagaccttacttttccaactgacttcttcaggcacggggctgccgctgggcatcccggacgcctctgcatctgtgcgcggagaagctcctacctagggcagcactggccggcctgagcctctcccagctggtgggggtggccgggggtgtccctgccttatcgcagccagacacgctgcacctgccgccgcctggcgggccctgcccaggccctgctcctttcccagccttcttaactttcaaaactttgcctcctgtttc

SEQ ID NO: 516 - DNA, 1500 bp, Homo sapiens
gcaaagcaacaacaatagcaacaaaaagttgactgggcgcggtggcctgtgatcccaacacttcgggaggctgaggcgggcagatcacttgaggtcacgagttcgagaccagcctgaccatcatggtgaaaccccgactctactaaaaatacaaaaattagccgggcgtggtggcgcatgcctgtaatcccagctactcgggatgaggcacgagaatcccttgaaccctggaggcggaggctgcagtgagctgagatcgcgccactgcactccagcccgggcgacagagcgaggctccgtcttttaaaaaaataaaagaataagtaaataagtttaaaaggtcttttacttcagtccagttggtaactaaaaaataataatacattttttttacatccttcttccataatattgtgtagcctcttacatctacggaatcaaaagggatccttcccaaggttcattctagcaaaggaaaacgtttctttccaccatacaccctgcgacacgtgtcttaatccactcctgctcaactggctcccagtggatccctagggatttttttttttggagccaacgtgggtcagaaaaaggaagagggtgggtcagccacaggttttcagcggactgggctggcggtcgcaaattccccttacttccccacgtaggtaaaagctaacgctgcggcgaggcagccgcggtcggggcgtctccgctgaaggcgcccgggcctcctgcacgttggctgcccgggtgcgggggtgcgggctgcggtaggcgcggaggtgcagcggtaggacctccgcgcacaggcccgcctgggcggacacagcccgagttggacacgggagcagccgggcagcgcgtcttgacggaccggcgagcacttgggccggttcacatccgtatcccacttcaaggagacgtcttcgctgcatcctccggttccgggtggaggctgaccctgggccattccgtctccggtctctggtatttctgctgggtcacttcatcccgggggcctctgaggaggcggaactactgtgtcaggagtcgtggttttcaaggagaagtcgtggtcggattgacagaggtaggggaagtaggcggaacttccggctggctcttccatcagctgccttccccgggcgtctccccgcaacctcctcaacttccctagtcagtgacgcggcgccggccagaaatccgaccggaccgggctcgggggagcgtgagttgcaggtgtgtgcctatctttgcgtctctgtttgagaggacaaactgtggggctgggaccgcgaggtgactgtgactgaggaagagtggtaagtgacagcgagggcagtgggagccaggggctgggaggctactgtgaccgagggccagtgacagcgaggggactgtgacccaggagcagtgaatgcgaaacacggtgacctcggagagcgcgaggccggggctgcgacggcacttggaccgaggaagtatgaggcagtgact

SEQ ID NO: 517 - DNA, 1500 bp, Homo sapiens
acactcagcacacagtagatgcccgaagtgctggctgcttttggccaaacaatcaaaggcaagggacggccttcctgcagccttggagacagacagcctggctccagatcctgctcacgccccgtactgacccggtggcttgggtgggtcccttaacctctctgtgacatggacatgatggtcgcagcagctctggagagcagtgagatgacaggggtggccacacttcacataactgctggtcccgggcatgtactcagtggtagcatcacttgttattctccttccctaaatgtccgtaaacgtcccttgctggctgggtggaaccgttcccaaggaaagagtgtacaggcattcccaagtccccaggagctggagtcttggggactgaccaagcacctaagggtgcagtggcttctcaagcaacatcctggggctgccccagagaggccctgggcgggggagggcagtgcccagatttatccaccaatcgcacaggctgctggcactgagcacgttcttatctgcccagcccagcatgggggggtggccaggccggccggggcgggacgctgcctggggctggacgcggaggagccccaagccctgctgggtgggtgacagccgctgaggctctgagtgaccctgcaggctggtggccagccggccgcccatcttccacaccatgtcggacggcgagggcccctccgccggtgagtggcagcgctatatttacccgctgtggctccggttgcagagccaaggccgccagtcgccgagggcactggggcccccgcaggctgcaggcagctgtgagctggacccccttcctccttgcccgacgcctggggggcctgtgccgctggaaggggggagcttgactttcaaagctgggttccgccacaccccctgactgcccagtgtagccagtgcaggaagctgtgcctgattcaagctctcctggggctggcagccggggccagagctgacccaggacagaggggcaggggctgcgacgggacccatgggtgggctcaggatgccgtgggccactggaaccgcatgcagacgagtgtgtgtgaacacttaacggcgggggagagcacacagcttccgtctgattccccaagtctgagacctctgggcgttctgagtccctggtccggcagcaccaggcaggccctctgtgtgccctcatatcctctaggttgaaaatggccagcgacacaggcaggcagaagggcgatcagattctggggtctgcccactgccctttgctctgcctgaggccagaggctgtggtggggactggccacctatgtgcctggctggctgcccccggctcctgccagttacagagccagccttggcggaatgggggctggggacggccaaatccagggggactctggagtcaggctgtccaggttcaaattccagttatttcacctccaggctgggtggtcttgggcaggtagcttaacttctctgagcctccgt

SEQ ID NO: 518 - DNA, 1500 bp, Homo sapiens
tagctaagctcaaccccaaatggagcccccacttcagactgatccaatcctaggcctccactgagcccccataccactctgagcaccaaccttcagtccttaccctgggcagacccctgtcccttaggtggagtccttgactgcagacagagtccccagccttggcctccatgaagtcctcctccctgccctgacctgcatgttttctttgtccccagccccaggccagccagcctgcgacccccggccccgagagtacctgatcaagctccctgaggactgtggtcagccaggtagtggccctgcctacctggatgtgggcctctgtcccgacacccgctgccccagcctggcaggctccagcccccgctgcggggacgccagctcccgctgctgctctgtgcgccgtctggagagaagggagattcactgccctggctacgtcctcccagtgaaggtggtggcagagtgtggctgccagaagtgtctgccccctcgggggctggtccggggccgtgttgtggctgctgactccggggagccgctacgcttcgccaggattctgctgggccaggagcccatcggcttcaccgcctaccagggcgactttaccattgaggtgccgccctccacccagcggctggtggtgacttttgtggaccccagcggtgagttcatggacgctgtccgggtcttgccttttgatcctcgaggtgccggcgtgtaccacgaggtcaaggccatgcggaagaaagccccggtcattttacataccagccagagcaacacgatccccctgggcgagctggaagatgaggcgcccctgggcgagctggtcctgccttctggcgctttccgcagagccgacggcaaaccctactcggggcctgtggaggcccgggtgacgttcgtggacccccgagacctcacctcggcggcgtctgcccccagtgacctgcgcttcgtggacagcgacggcgagctggctccactgcgcacctacggcatgttctccgtggacctccgtgcgcccggctccgcggagcagctgcaggtggggccggtggccgtgcgggtggccgccagccagatccacatgccaggccacgtggaggccctcaagctgtggtcgctgaaccccgagaccggcttgtgggaggaggagagcggcttccggcgcgaggggtcctcgggcccccgggtgcgccgggaggagcgcgtcttcctggtgggcaacgtggagatccgggagcggcgcctgttcaatctggacgtgcctgagcgccgccgctgcttcgtgaaggtgcgcgcctacgccaacgacaagttcacccccagcgagcaggtggagggcgtggtggtcacgctggtcaatctggagcccgcccccggcttctccgccaacccccgtgcctggggccgctttgacagcgcggtcaccggccccaatggcgcctgcctccccgccttctgcgacgccgacaggccagacgcctacac

SEQ ID NO: 519 - DNA, 1500 bp, Homo sapiens
ggacaatacccaggctttcttgggcagaggtccctgtggctttccgcagtgcattctgtccctggttaatcgagaatggagaatggtgatgacttttaccaggcatactgcaaacatattgttaacaaggcacatcccacacattcctaaatccattaaaccttgattcaatacagcacatgtttctgtgagcacagggttggggctaaagttacagcttaacgcatctcaaagcagaaacaatttttcttagtacagatcaaaatggagtttcttatatcttccttttctacatagacacagtaacaatctgatctctctttcttttccccacaagcgtctgcaggcttccaaagagaggggctaggagatgcaccaacacagaagcacaaatacaccagcacacacagatacacacaattggttcacatattgctaggttacagtttgctatgcgacaaaggcagtggaccagatttgattgaattgaacaattccttcttttcatcagcttctcaattttttttttgagacagagtattgctctgtcacccaggctagtgtgcagtggcataatcctggctcactgcagcctccacctcccaggttcaagtgactctcttgcctcagcctcccgagtagctggaattaaaggtgcccaccaccacgcccggctaatttttgtatttttagtagagacggggttttgccatgttggccaggctggtctcgaactcctaacctcaagtgatctgcccaccttagcttcccaaagtgctgggattacaggtgtgagccactgcacccagccagcctcccaattttgaacacacactaccaccacctccacaacacacaaatgtaaatgcactttcatatatgaaactgtataaatacaaggaagctccacacgtgcaaggatatacacataagcacccccagattcaaccacagaaacacacgcctgcacatttgcataaatacaaacaccactttacatataaaaatcatataagcacatacacggatgcaagcaagcatggagaaatgcacggaagcataaacaaacagacaaagctaagtaaaaaagtgtgcatgctcacctgtgcttacaaaaatacacatactcatacacaaacacccacacgttcacatgcttaggtggactttgatatctctaccactgtatccctgccaacatctagagagtggataagggataggcattaggtcgctgggttgcctaagcaggaagtctgggttccctaacacctttttctaagctaatgctccttgacgataatgagaaaggaggcggggaatggatgaagtttcataactgagtgaagaggcaggttcaggataaaaggcccagttagaggctgcagtggggtgcagggcagtcagactggaaccatggagctcagcgtcctcctcttccttgcactcctcacaggcctcttgctactcctggttcagcgtcaccctaactcccatggc

SEQ ID NO: 520 - DNA, 1499 bp, Homo sapiens
caggctatgtctccaccatgtaacttcagacaagttcctcagcgtctctgtgtcctggttccctcatttgtaacatcaggatattgataaggatcatagtaatagggatgtccttatggggcctcatgaaaatgaagagttctctgtgatgtgcctggaaccacagagggcagcaagtgggagccacagaaagtcatctctttatcatagttgtcattggtaactatgacggttatcaagggcaggggtctcccaccttctgcatccaggccttgtcattccttataaaattttctcctttcaaggactttcaatgccctgaaaacggaatgctcctccctgctccccatcagctgctgcagagccctgaaccccttgaacttgccttgcttagttctttcaggggctgccttggatgccacctcacttccctcttcttggctctgtggctgtcagaggggctgggcactgggttacttcatcagttcctgggtgttgatcggcaggaaacagtggtttcctgttcatatcctgcctgagcctgggccgggtggaggtgtcctgcatggagtcttgtgaaatcgcgtggactgcaacacccagcagcgcggtgagtccaccctgaaatccacagtgacccacgcggcatgtgctgggaattgaacgcttggggaaagagctgggctccagcggatcagccccgaccaagtcgttcccacagctcaggaccggacgctacaagcccactttgtagcagtttggcggacggcaaacttttgcaacacagtgcaaaaaccatttaacacctttaagggaattggaaatgggtttttcatgtgtggtggtgctgaaaattgagaataatgacagaattattaaaaacagccttctcggccttagactcttaattgcctctggtctgtaaaactgacaaataagcactgtagaagccacagatgaaatatgtcgtcttgggagccctggagaattgtctctgaattcttttgtttatggattgtagaaactgctttgggggtagttggatgtagaagcagaaggacagagtggggagctgggagcaggaggcctgggtttgtctcctgagtctgtttccactggggcctgaggctcccgtgtgagggaacatgaatgggccaggcacatgggccctgtggggtgacagagctgtgggctccatggtggctctgtgggcagctagcttggggatggctgagataaagacaagtagttttccttcctgcaggacttctcagagcctttagtgtggttataatgatagaaaacagtattaagtccataccctgaaccagaaacaatgctaaaagctttgcacttggcctttttttttctttttcttttatcaacatgtgtgaggacggaagcttaggcttacagatatggactcattgagagtgagtggacgtgtctgatctttaacccagttctgtctgaccaaaaagcctgtgctctaaccactg

SEQ ID NO: 521 - DNA, 1498 bp, Homo sapiens
cggaaatttaaaaattggactgctttctatcagggcagtctgaattaaagagctgatgtccagtctcctagtggagatagaatactgggctaatgcctgtcactagcacttacagaggtgtgaatttggtaaatcatttcatctctgaagtggtttcaacatttgtgaaaagaggcaaactatttgcctaacaaaatgttgagttcaaggttattcatagctcctaccaaataagcgatgcatttgctactttgtgttaatggaaaaggacttaaaaattatgatatacttaaacccggtgctaccaaatgtgcttaaatacgcattcaaattgtattcttttaatgaattttaatattctcaactagtatcaatgctttgtcattattaagtgttgacttcaatatttccctcccctcaccgcaactcctagcacacatgcactcgaaatgttctcaaatgatatgtattgagcgcatgtgactaacaacacagccacctaagccctgacttgccggacacgaacggacgattaattggaataattgtaacagggtttctataaacagtgcttcctggaggcttgccccgcgtctagcgctgcaccgtcaggagttaaccactcctacgacacccgccgccacacggtgagaagcccgggaaagacgcgccacgctcccatgtgatagtttcacttgtctttttggttagttctgctaccctagttcatgtccccgcgagaggaaacgtattccccctcacattagacagaagagcctcgattcaccgtggaggctgacggagggccactccagcaactgagcagctcggacttggcacaggcagggtccagcctacccgcggccggcgcggcgcctcagcaacaccccctcccccggaagtttgtgcgtctcagatgtaaggtctgggagtcaccttgacccccctggagcggtggggaaagttagccctgagcccgagggggcgtgagtgaaaccaaagagcactttcgcgagtcagttacgccgtcacggttttttggtttcaaggtagctgaagacctagagagtttaagggtggccagagcaggtggcaggactccgcccaccaccacgcttcccttccttcagcccgcacgcttcactcccctcatggggtctcgcctctcaggcgcgcgcgaagagttgtcgcgcggtgcgtcctgggaattgtagtcccgacgcggagagtcgcctcaggagaaatgactctggcctacataccccacagtgccttgcggcgcaggccgctcccggatgtgtgcctggcgccggaagagaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgac

SEQ ID NO: 522 - DNA, 1498 bp, Homo sapiens
ctcataactgcacagcgtttttgtgggatttcgtgggcatgatctcatccgagccttccaacagcccttgggaggcaggcagggcaggtgtgggaggcgactcggccccaggcgcacatgggtaggtaatcagtgggaaagtgtccctagctgcttcccttccttccccaggataagtgactgtcaccaaaaggcccccccgagatcagcaagcttggcctgtggccttttgctttttcacacccacagaaggggtgaagctggggctctttgcaggcaacagcagccgcacccgcccgagtcctgagctccacgtcagcagggcaaggggacggatggtgttgtctttctctggccatgcatctcagtttgcatcctgctgtgcaggatgaattggagggcagaggtgagtaggagagagcagttaggaagctcatcaaagcatggtaggaaaggaggagagtccgagctggggcggtaccagtggggacagaaaggattaaccctgagaaggtgcccggggtggggcctgctggattcagtgactgatgggatttggtcggtggggaggaggaggaggcctgggcttctggccagagtgactaggaggatgttgatctggggagtgcctgtgtggctgagggacacgtccaagctgcagtcggctctgtggttgtggacacctggcagagccatgccttctctagtctgggtcatccaaacacacgtggggtgcaggggccaggtggagccctcttgtcgtttttgttatctaacggtaattacggagtccagaaagagaattggaaatgccggcagtttaattaaagctgaatggcaggagaggggcatttggaggctccctccctgccttcactccccgtcctgccgcccaggcaggatgtcagatgaggagacgttgagctcatcaaacacccaatgagaagtcttacaacatcagaagctgtctgccaatgcgcctgcgacagcttatagaaactgctgccgcctcgaatcaacctctctccccaggcattgcacgtcagtaggtaaccaggtaaaggacgccgggggtgggcagccagctggagggggcgtgatttcctcccccaacaaaatcggcttccctgggttctgagcccatgatatcatgtttttaaacccgattttccatctacactgggagctttgaagttcgctcggtgtggggaatcacgtgctcagtgaaagacccaagcggagagactggggagctggttcccctgggcctgacactgcggagctgaatgtcaaagcagggccctcagagaccaaagcggagggtaattatcacttctccacaactagattgcaggagtcagccagcaattgatttttttttctacttcagatatttcattgtttaattggtagtgacacagatggctggctcgcatcagggcgtcacagtccgactcgcgaaagccaggctgtggggactgctgcctctcctgacatc

SEQ ID NO: 523 - DNA, 1496 bp, Homo sapiens
ctcccccactgtatgaatgagtcaaaggacaggtccagagaggatggccagctgaaaagaagaaaacctgaggtcatactctacagctgtcaaccctcagtaacccagacctgcctccggccacaaaagctgccttatggctctctagccacatgtatctgaggagctctctatctcggggggaggggagagggggaggtgcagaatcacaacaggaggtgtctcaccatcagccgggcgtggttgatgttccaggtgaaggtagtcatggtctgattctgtgggtccacaatagagtcctccaggacgtacaccgagtgagcaacattggcaggaaatagtcgctcggcccagcgtggcatcctgttggtcttggtcaggagtcgccgggacagcagtttctggtcaggggtcacctcccggtgtactatgtcttccgtcaagacatgtttgctgcaggtgtcagggtgaaggtgaccctcagaagcttgcccctaagagactgcccgaggggattcccatttggaggctccgggcctagagaggccacgccttcccgtaaccttgcagggtggtatgtgctatggttcaaaccagagttaagggcccatcccagggcaaattcccactcccgccatctgactgacctggattcctgccttctagcaggaatggacctcatgatttattgcaccccaggaaagcgccacgggcagagaaataggatttccaactccaagatccctcccaactcccatactgccgcctcttcttgtctcaccacactgagaaaagaatcttacactaaggtctcaagtaaaccaccacccaggcccaacctcccttcaggaccttgcaggcctggcctggccgcttccccgataaggtctacctaggattcgatatcgagtccttcctggtcccagtacttgggggttacccataattcgatctccagatagcgagatggcgcggttttgctcttccaaataccacgtacctatagggattcgggtaccgctgccagaaggcggcgaacacttggtcccaggaactccggagcacgctctggcccaggaaatacttcaccatcgtcccggccgaagcgggctcagcacccgcgcagcatcaggggtgcggagcctgggaggcacgcgagggccgggccgggccggggctcggcgcacacccgccgccaggctcgtagctcagtcaccaccgcaccgcgcccaagcagctgccgccgccgccgccgccgccatgagttgtccggccgcgcgccacttccggcgcagccacacagtagccaccgcttccggcgcccgcgccacgtgaccttgcggccccgccccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcac

SEQ ID NO: 524 - DNA, 1496 bp, Homo sapiens
atacataccacaggcacggaaagcgccaggaggggaaagaacaggatgtttaccagcaccttccacaggcagccacggtcatgggggtcaggacagggtccccagaggaagtgacgattcggctgagctagaaagacatttccacaggaacttacagtaagggctgcaaggacagcctgtcctcccccgcccaccacctcactaaactttcactgtggcaatcggcattccctaagcctgccaggaagcttccagtaaccacttcctgactcctagcatgacacacttcgggccttccaaggttgacgatctaaggcccttacacagcgccagacacgcgcaggcagggaggcaggatgtgcctctccagacaggaatgtggacgccacctgggctcttcccctcagcctccacaggggaagaatattcttgtggggtttttcccttccaaatgtctcagggcgattccagtgttcccgctagttcctccctcccaggctagaacacaaatccttcccactccctgcctggcaaacaccttctgaccctcaggcccaaggcaatggcccacctcctcccaggctggatggggtctcctcctctctgttcccccagcccctgagcttcctgaggaccaagcttgtggcttcttctccttactcttcctccttggtgtctctatgttagagggccgttagcatctgctggggcctggtcgcattcaccctgctctgccactcactggctgtgtgactctggacaaattaacttctctggacctgcagtttctcctctctacaatgagaatactggagagtccttatcttatgggttgctacagaattaagtgacatctcacacacaacacacttcctacagtccctgttacacgctaaaagtactcaacatgcaacggatacgtcatcagtaaccaccccacgggtttactgtgatgctgcacaattattaagccttggctgctacagagttgtaacctgtctgcacttccaaccggtttgggaatgcaagcagcattcccaagtcccgctttcacccgcgcgctaacggctcaggttcgagtacaggacaggagggaggggagctgtgcacacggcggaggcgcacggcgtgggcacccagcacccggtacactgtgtcctcccgctgcacccagccccttccgcgccgaggcgtccccgaggcgcaagtgggccgccttcagggaactgaccgcccgcggcccgtgtgcagagccgggtgcgcccggcccagtgcgcgcggccgggtgtttcgcctggagccgcaagtgactcagcgcggggcgtgtgcaggcagcgcccggccggggcggggcttttgcactcgtcccggctctttctagctataaacactgcttgccgcgctgcactccaccacgcctcctccaagtcccagcgaacccgcgtgcaacctgtcccgactctagccgcctcttcagctcgccatggatcccaact

SEQ ID NO: 525 - DNA, 1495 bp, Homo sapiens
tgctctctcctctttctctccaaatgacctggggttggaagttccgggtcctgcccattcccagtgggacctgggagagcaaaggcggggtagctttgtgggcctctctctgagccccttcccttcccgcagccacggctgtcatccctttggccgcctgggtcacacattgctcaggaagaagctgctgtcaggtccttggaggccacatgaccttctcaaaagtaaagccaggaggacagagcgaccctccctggggctgggtcaccctgccctcttctaccccccatccaacgtggcaccgagtctgccactcagtcattccgtctgccaacagttcttacagcccagctctgtgctctgctctctgctggctccaggaggggtcctcactcgctgaccacactgacctcaggaccaagggaacaaaacacagcaggggcaatccatccggtccacggagaagtgctaaaccccaaagggtaaatgagattcccacaggaggagcagggaggagacaacaggcagggtggagggaacagcatgaggaacagcatttgagcccagcgtgtgtggcctccatgtgctgaatgcgtactggataccaagcttgctctacggaggccctgtgaaggtggctgtggatcacagatatcctcagctctctccagagctcaacacagtaccagatgctccagaaatgtttgctgaactgaatttgactggaaaggaaaacagagccccaggcctgcgcggtggctcacgtctataatcccagcactgtgggaggccgaggcagacggatcacttgaggtcaggagttcaagaccagcctggccaacatggtaaaaccccgtctctactacaaatacaaaacatagccaggtgtggtaggcaagtgcctgtaatcccagctacttgggatgctgaggcaggagaattgcttgaacctgggaagtggaggttgcagtgagccgagatcgcaccactgcaatccagcctgggtgacatagcgagactctgactcaaaaaaaaaaaaaaaaaagaaaagaaaacagaatcctgagctggttatgattctatcattaccaccacttaggaaggacctggatccatgaaaagaccttacccactttagctctgaccccttcagtctttggaggtgaatatgagtctccctgacattcagtggaggaaactggggtgcggataggggtgttgctaccagctaggtcctccctaatgcatttgcccattccaggtcccagctgcagggcagccatgagcctggtggcctgtgagtgcctgcccagccccggcctggagcctgagccttgctcacgagcacggtcccaagctcacgtgtacctggagcagattcgcaacagggtggctctgggagtgcctgacatgacaaaacgtgactatctggtggatgcggccacgcagatccggctggccctggagcgcgatgttagtgaggactatgaggcgg

SEQ ID NO: 526 - DNA, 1494 bp, Homo sapiens
tatttattgctcatcacctgccaggtattgtgatggaagctagtgcggaagatcccccaatgaccaggatcgcccgacccctgttcccagggtgagcccctagcgcggagcggggacagggtggaccgagtagggcgcagtgctggtctcgcgaggctccctgccccacggaggcagtagcaggacccaaccgttcctaaccgtccagggaccaggacagcgtctggaataaaatcttccaaagcaaacttccgcctgcggagacccgctcccttcctcgcccccacagaaacgccccccgccaccaccccctcccccggcgtaggccttcacgctgtcgcctcgacccgtttcctcgaatccccagggaagggtgggcccctggcgcccctatggcccgccgcccccttaccaccgcggtcggagcccgggtctcactctcctgccgctgtttcgggccacaccgtgtgtccgtgcctccgcaaaggaatagaagagtgggtcctcgctctctgcggcgcaccgcttgtcccttgacttcctgtccatctacaaagcctatttcatgttttccagaaagaaaacgttttccgtgtctcttgagtcctcatcgccatatgcggggcgggaccgatctatgcaaaagatcgcaagagaaaactgatggagcatcgcccatcatgaggctgctctcccgatggtcactgagttgtgttgtggcactgtctttgtacaaagacaccaatttttgcgaacggtgccactcatgattcaacgctctcatgcctcggtcccagctgctggagcgcagattttcctccaagggttagaagatagaaaactcctcggtaattggcctagaggtggtctgcgaggacgccgggaagcttgtaattggctgtttaattctcagcaggtgcggtctcagttaacaacatctgcttttcctggatcttattggctgacagggtgggcctgctttggattccatccgggtaattgggcagcggctagcagcagccacgtcgctcaggggcagcccgcggaaggattggttgtgacgggagaaggcgattggtcggactgcgagcagggtgttgattggtgctgtcgggctgcgggggcggggaagtggcggctgaagcgccgccggcggggctcactgtggtggtgtgagtgggaggcggcggcgctggtggctgcagctggggtgaggcgcgaggcggcgcactcgacggctgactggagcagcggtaaaggcgaggatggagaccgaaggtttggggagtgggaaagacagggtcatgggcagccctggccactaggagacggaaatgcgggagcgagggaagggaggggtctggcgtgccccggggcgagggaaggatgtggggcgcagcgggggagtcagagccctgggctgtgagacgccgctcgggggcaacttgacccactgggaactcgtaactgtatctgaggaagatgctccagtca

SEQ ID NO: 527 - DNA, 1489 bp, Homo sapiens
gagggataaaagaaaggtcacggccaggtgcagtggctcacgcctgtaatcccagcactttgggaggccgaggcaggtagatcacaaggtcaggtgatcgagaccatcctggccaacatggtgaaaccccgtctctactaaaagtacaaaacaaaaattagctgggcgtgggggcgcatgcctgtagccccagctactcaggaggctgaggcaggagaatctcttgaacccaggaggcggaggttgcagtgagacgagatcacgccactgcactacacagcctggcaacagagcgagactccactgaaagaaagagagaaagaaagaaagagaaagaaagagggaagggaaggggaagagggaagggaagggggaggggaaagggaagggaaggggaaggaaaggggaaggggaaggggaagaggaaggggaaggggaagggaagagaaagaaagttcacagtgtaaggccaggcgcggtggctcacgcctgtaatcccagcactttcggaggccaaggcaggtggatcacgaggtcaggagatcgagaccatcctggctaacacggtgaaatcccgtctccactaaaaatataaaaaaattagccgggtgtggtggggggcgcctgtagtcccagcttctcgagaggctgaggcaggagaatggcgtgaacccgggaggcggagcttgcagtgagccgaggttgcgccactgcactccagcctgggcaacagagcaagactccgtctccaaaaaaaaaaaaaaaaaaaaaaaaaacttcacagcatggagagcaggcccacttgggacacagaatgggcatgtgtcaagggccctgggaggaggtgctggaaagggacagtggagaaaagggggggacagccgatcagtcccctgggccattctgcttgcctcctcactaagaatagtagcatctcccctcgctcccactgctttctgtggctctcaaaatgctttcgcatgcattttctcactacagcctcagaacaatctttaggagtagtgttatcttccccatttcacagatgagaaagctgagactcagggaggccacataactcgcccaagaacacatagccaattagtggcaggtatggggctccatttaagtatatgaccccgctctggttcagtattcttatccccaccccaaataaagagaatcacacgaccttattgtgataataaatagcaactgtagtcagagggagagaggcccagggaggaacaataatctaactaagacgcttgacattggaaactcctggagggcagggcagagatcatgcaggagatttaacagcacccagcacagctgcccacgcggaggtgcgtctatgctgagctgccacagcaaggctgcagtgcctggcccggagcttggtcacgctgacctccacggcaggaactgagagcagcatctactcccaatcctgcataagaggtcatagaaacaccctacagcccag

SEQ ID NO: 528 - DNA, 1488 bp, Homo sapiens
gaacatatttcagggttgtcccaccagaggagtcagggagctggggtagttactcctacctccttcccattaatagctgagggatgctccacatgtgataactccaggcatttcagcctgccccacctgctcaggcgaaactgggtccccctgcagccagaggaagcccacaggcaggcagtcttgggtgcttgcagaaaaacccctcgttggctgagcccaggaactgctgaggtcagaacagagcaaacagaaactgggagggaaagagtgtaagaaaacggttaaaatcctcaaggtgacaaaggggacagaaggactgtgagctcaccagtgtacctggccgatgaccacatgacacagaggaggtggggctggggtttccagggtcagggctgggctaaggaggaagcagctcccatgggcataccatgtccatgcccctcacggacctgctctgtgttcccttccctgtcctagggatgagctggacaaccaacctgggcgtcagactccaggaaatggcagggtccttagtcctcctgtcaccttctagcttctctctcttcccccattctgccctgcctgaaaccccatgcacttgctccctaggtgagggcagcgtgacatttctaagatgatatctcctctctctccagcccagacccacagcctgaccctgtgacaaaggccccagagccatcactctgcaaataactgtggctgggtgagaggtaccaaagccaacgtgatgatctgagacagacacctgtaatttcacattcagaaaaacccagaccttcaaacagaagtgctatttcaattttctcactcccattcttctttaacctcagactaagaggggaataaaccctctttgatttgtagactgaattctttaaagagacagcttattctttttcaaatttattttttccttttgcttggggcagacaccagggtcccaaaatgggaatttggtaccttggttagatggctcaaactgccaaaagttactatagggaatactgcactaccaatccatttttcctgctaatccaaaagtcaaataagtccatggagggcttttttttcctctagaatttcaggctccctgagggctaatttctcggaaagctgcattaaactaatagcaccataaaaggcccattgtgagatgtaattggtttgcaggacttcctataaaaataataaaaagactgccagaggcagtttccaaaggtcaattatctttgtgttgcttgagttgagtggaggtcagtcccagaattccactttataggcatattaatcaaaactgggcctgcccacccatctgaccccatcagctgtgagggaagtcacaggtcccacccttaagctggttgccaaatggtgttttgggctcttcttttcccaagaagagactagcccattgtcaccaatgcagagctggaagctgaaattgttaaggcagaatgaaaggga

SEQ ID NO: 529 - DNA, 1488 bp, Homo sapiens
acttgaagctgcacacaattgaaaacttatcaattacggcggggcgcggtggctcacgcctgtaatcccagaactttgggaggccgagacaggtggctcacttgaggtcaggagtttgagaccagcctggccaacatggtgaaacctggtatgtcctaaaaatagaaaaattagctgggcgtggtggtggtctcctgtaatcccagctactcaggaggccgaggcaggagattgcttgaacctgggaggcgggggtggttgcagtgagctgagattgtgccactgcaatccagcctgggtgacagagtgagactccgtctcaaaaaaaaaaaaaaagaaagaaaagaaaaaaaggaaaaaaagaaagaaaacttacaaattactgctggacttttccatttactatttttggactgtagtggatacgggtagatgaaacctcagatacgtgggagctaccgtgggtgtattaggctctctgatgttggatgaacagggacctgggttaatcttgccctactctctctaattcaggtaccagccagacgagaatttcagcaagaacgagaagccgaaggaggaagtagttgagatgaattctgtacccaaagcagaatccccagcatgtgttcctgaagcgtccagcactccggcgagtctgtggagccctgtcagcaccatccccaccccgagatggggccgcatcgtctatggatgtgcctttctgcttggtgagcagtggcgtttctccgcggggtgttttgaacctgatagcatgcggcagggggccgagtagggagtgtggggctttggtagttgagaggagttgtgaagatgtggtggcccttcttagtaggcgcacttttggccgggcacagtggattacacatggaatcccagcactttgggaggctgaggcgggacaactgcttgagcctgggcagtcgaggcttcagtgaatcaagaccacaccactgcactgtagtctgggcaatggggcgagatcccatctcaaaaaacaaacaaaaagccatatatatatatacacacacacacacatatatacacacacacacacatacatatacacacacaaatatatatatataaaattaaaagtttaggctgggtgtggtggctcactttagaaggctgaggcaagtggatcacttgaggtgaggagttgagaccagcctggccaacatggtgaaaccccatctctactaaaaatacaaaaaattaggtcaggcacagtggctcacgcctgtaatcccagcactctgggaggccgggtgccgggggggagtggatcacaaggtcaggagttcgagatcagcctggccaacatggtgaaaccccatctctactaaaaatacaaaaattagccgagcacggtggcagacgcctgtaatcccagctactcggggagactgaggcaggagaattatttgaaccggagaggccgagtttccagtgagccaagatcac

SEQ ID NO: 530 - DNA, 1486 bp, Homo sapiens
taaatgctctgcaggctaaggtctagtttagcgagccttgctggttcaactacatcacaaaccagatggtcatggctacctttgttgcaggcatagtgcccagagggaattaagtcctccaaatgacctaaaattaggtagaaaatgtcactctgaccttttttcaatgtgttttaaacttgggcttgctttctttgcttaaaaaaaaacacttttattttttaaaattaggaaatagtcaaatggaacaaaattataaaagtttaaaaggtgaaaacttcctcccactcctctcccccagcttaattccatcctcaaaggcaaccagtgtagcaatgtctgtatatcctccacacggtttatacatatacaagcagatatgcacacagaaacacacattctcctctcgttttttacacaaaatagcagcatagtatgcacactgctctgcgcctggcttttaaaaaaaactcaatatatcttagagatcattccatatcagttactaagatttatttcttcatgtattccaagcacacacgaagcagcccacattatgataatttctctttcctcaatacttggcagttgattttcatctgtgttttccccttgctggtgaatgatttctaccacaggatggtccaatcacattctttgaattgccttccagataaaatatcttaataagcattagtgcttttgcctggaggataagtaaacaattttatgtgattagggctttgcaagcacattggtgtctcactgttaatttaaaccacatcttgaatgaggtcccttaaggtcataaagtgaggactccaagaatttatctgtcttctaaggctatagcatgttttctcttgttccagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccag

SEQ ID NO: 531 - DNA, 1485 bp, Homo sapiens
aagaacgtgccaaaagttcagaggaagaagcctcggcttcgcctttcgggagaccagtccagctttccaccatcacgctgctcatcagggaccatctccgggggtctcctctagaccccaagggaggagcgggtcccgcccgccattcccaggtctcagagtttacttgtccagagatgcaacttccggcctcttcaggccgggcaagatttaaggaaagaaaagaaacataaggacctccgttcttcggtctccgtcccctccccttcccccgcgtgccgtccccacaacgggccaggactgaacccaactctcgaccaactcccggcagcaaaactaagcaccctacttccgttgtccccacctgttcccggcgtccccttcggctactcccggcgtttgcgcaagcggtcccacgtgggctcgggcggggctagcgccgcggcgggggctgggcacgcccctagcgcatagctggcttctgattggctttccggtgctcgcccgagcagggttggggcgagtggaccgcgcctctaaaggcgcttgccagtgcaatctgggcgatcgcttcctggtcctcgcctcctccgctgtctccctggagttcttgcaagtcggccaggatgtctcaggtacagcgcgtgcacagccaggctgcgaaggtgcagcgggcgggaggcccgttgggggctcagccggctgccagaagctctcgggctctttccttccgtgcccctcacttgctcatgggcccatgcctagccctgattcgttggacagagccttgtgagcgggattttccgtttggggatttctaaatctgctgcccaccccgcaactgccggaaagttgcccatggggtggacttcgctgtgtagcgggagaggggtgggagtcgagggtgcttgatggagagatgggggaaggggttgcacggattggaggagcgaggagactcagtccccatcccgaagcacagggcaggacgtcgcggcggagtggggaagcgaggagtccgtggccgagagcttggaggtcaggggaagtacggggccggctgctcagagtgcgggacgaggagaatcgcggcccggggagaggtgacccaggggcccctcccttctctccagtgtagacccttgtctgagaccgagctatgtggggcgacctctggctcctcccgcctgcctctgccaatccgggcactgggacagaggtcggtgttgaacgcgcgggccccagggggagggaggggaccaacgggctccggcgctgacaccgcggcactcatgccctgtcccctttcagctgtttccagcatactgtgccccgtctgtcctcaggccagggcttcgctgcagccccggccactccctagtgcctggcccggtggtggccaggcagttggccgcgctgcttctcccgcagaggggacccccactgggggcgaaggcttggcctgccctcttcactgctgtattt

SEQ ID NO: 532 - DNA, 1482 bp, Homo sapiens
acagaaagcttgctcctcgtagagagaaaatgtgagtcttggccatatttatagctgcactcataaacaagactcaggtttgggagtgagacaggctagagaacaggtgcagcagttgcttttccccaggaaatcctccaaaggtaagatgcattgaactaggttttaggtacctatgcagtgaacatggtggtgatgggaggggctgaggggaataggtcttgtttagacttgctcaatgtgcaactgaaacaagcctactggttgtcagacatgcagggggatcaaagcagggtttccttatgtccctgctcccccataaccagaacacagccttccagcttcctgtgccttccaaagtcagaatttacctgtgcccttgaactgatacaaagaaaaaaaataatcagcaaaactcagaaggaaacagaatcccaggaatatttccagaggtgcctgaacattcacctggaacacagagcagagttcctgcagggctaccctcctgtgctctgccccagtcagagtgcagggaggcgtggggaggtgacacagatggatggcaacagccctgggaaggagaggtgggctgggagccaggcctcatgaccagtaccagctagactccctaggtacaaatagccctgggctctgcagctccacaggctcctggggtggagtccaaatcactcattgtttgtgaaagctgagctcacagcaaaacaagccaccatgaagctgtcggtgtgtctcctgctggtcacgctggccctctgctgctaccagggtgagtacatcagtcatgagtctagctccagcccctgggaagcaccctcttccaagcacgaggtcacctattcaggctggggttaggatctgcacaaaaccaaaattccaaacctttttctgtgcttgttgaacaagcccctcatcaagttcagagctatttcttctactccccagcacctacgaagttttattgaaaatcagtgcaggcaaatattaggaattcttctgcctgagcttcactcctgggtgggatctgtgtcagatgatgtaatgtgaggtctggggtgaatctgggatccgccacttcccagccctttgaccttgggcacaatgctcaccctccctgagcctcctcctatcactggtagttagcgcttctgccaggagaggctatgagaatggagtaagaaagattaatactgtcaaaagagtctagctgtgggctaagcatggcggctcatgcctgtaatcctagcactttggaaggtcaaggagagtgaattgcttgagctcaggagtttgagtccggcctaggcaacgtggcgaaactccagctttaccaaaagaaatatgaaaaatcagctggacgtggtgacatgcaccagtagtctcagctacttagggggctgagatggggatatcgcttgagcccaggaggtagaggctgcagtgagccatgattgagctactgaa

SEQ ID NO: 533 - DNA, 1482 bp, Homo sapiens
tgaagaggaaaaagggcctagaggctgcacagatgaggtcgccaggaggggcgagaaggagaccgagtagcgcccagaccttcgggcggggacgctgtgaccctgtgctgtaagagtggaacccagacaggagccaaggaggaagcgacgtgcttctgtggagctttaggaatgcggcggttagggccactggtttaggggagttggctggaagggcgtggccggaggaagggccgcctccaccaagcgcaggcgccctaccgggcgggagggggaggagcgttactcgcggttgcgccccgccccgcgaacaaatatttgacattccaggcttatcgggaggaggggcccgaggagcaacgttctcccttcccccgcgcctgattcgcttaccgcttccgggggaggagacgcatgggccagtgcccgggtgggcggtccggagatggacagccgcgcaccaaggcccgcctccacctgtagggaaagtaaagtgctactcgctcgaacccgccgggcgaaggaagcacttcccatgctctccctgtcgccgtgtccgggcgcgagtcatttccgtcccgggcgcctgtttctttagctgccaagtggagctacgctgagctctctccccccgggcctcgcccctttcccgggcatgagctctggtgatgcgcccgggtgccccgctctctccattgtccaggggccgggccgcagcaccctccttgtccgaaagcgcgtggtgcggctcccgtctcagtctcgagtcgggctaggcaaccgcgtgactcagttcccgccacgctggagccccctccttcctgctggattattcagtttctcagtcacttattcagtttctcagtcacctccctgggagagtttgggaaagtaaggaacggccgggaaacgcgccataaaggagcctcaccaagctccactgggcaaagggaggaatgggagccccaaatgcggggctgtcaattgggttgtaggtgcgggatggaaaagggaggatctgcagcccgcatgcgcgcacacacgctcaacgctagccccccatcggccagagcgctcgcaatctccaggcagcttctccaccgtccagaaagggacgaaagcaggcaggcccccacacgtggggtaggagtgaggctccaggcccgttctacccctctcagcctcgtctagggtgcagctctctgcgatttggggggttcctttccccagcattgaggcctgcccactcccaacccacaacgaccgcgctctggcacttctcagtgccaggctagcgctcggccctagcatctgcgtggacaagcccttccctgtgatccctggtgaccaccccacagctctaacaacgctgatgttcccgccgccctcccctttcccaggtgacttctggtgatccccctacagggtgatacccggcaactctcaccgcccccttgaccctttgacttccatcaaccccag

SEQ ID NO: 534 - DNA, 1479 bp, Homo sapiens
ccgacaatgtaacataattgccaaagctttggttcgtgacctgaggttatgtttggtatgaaaaggtcacattttatattcagttttctgaagttttggttgcataaccaacctgtggaaggcatgaacacccatgtgcgccctaaccaaaggtttttctgaatcatccttcacatgagaattcctaatgggaccaagtacagtactgtggtccaacataaacacacaagtcaggctgagagaatctcagaaggttgtggaagggtctatctactttgggagcattttgcagaggaagaaactgaggtcctggcaggttgcattctcctgatggcaaaatgcagctcttcctatatgtataccctgaatctccgcccccttcccctcagatgccccctgtcagttcccccagctgctaaatatagctgtctgtggctggctgcgtatgcaaccgcacaccccattctatctgccctatctcggttacagtgtagtcctccccagggtcatcctatgtacacactacgtatttctagccaacgaggagggggaatcaaacagaaagagagacaaacagagatatatcggagtctggcacggggcacataaggcagcacattagagaaagccggcccctggatccgtctttcgcgtttattttaagcccagtcttccctgggccacctttagcagatcctcgtgcgcccccgccccctggccgtgaaactcagcctctatccagcagcgacgacaagtaaagtaaagttcagggaagctgctctttgggatcgctccaaatcgagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgag

SEQ ID NO: 535 - DNA, 1479 bp, Homo sapiens
tcagttacacccccaacaaagttgctttttttaaaaaaaaggcggtgggggggtcgggtgcggtggctcaggcctgtaatcccagcactctgggaggcgggggcgggtggatcacctgaggtcaggagttcgagaccagcctgaccaatatggtgaaaccctgtcactactaaaactacaaaaattagctgaacatagtggcatgcgcctatagtcccagctactcgggaggctgagacaggagaattggttgaacttgggaggcggagattgcagtgagccgagatcgcaccactgcactccagcctgggcaacagagtgagattcagtctcaaaacaaaacaaacaaacaaacaaacaatctgttgccagtttcctaggaatgctctgggcttattctctgcattttcccaccctgcctctcccctcctccccctctcctctccacaaaagggaacacatcacacaggctgtactgctccttactttgtcagtctctggtgtgttttaggcttattccatatcagcacacaggctttgcctcattctttttggtggctgtgtagttctgacctcagtgctctaaagccatgcatttaagtgatttgtcctctgcttgttcagctctgaaatttgtcattacgcaggcttaaccctgtatcagttaggagccgcttttctattccaccctcttattgttaatatgtgagtccaagagattatgagttaattgagggcagggactcacatatccacatctctatcttccaccaaaaaataatgttctgctctgcaaatagcaaatacaaaaagcacagcacaaagttcgcatccagcaggcttcatcccagcagaataagcgagagggactcagcaccagtcagtcccattttggttagtgagaaggtggtgccttagggaagaacactgcatacttcgaaggctgctctagggtctgtaatcacagccctctgtgtttgggttcattcacacggtgtttatcttctgggatttgctccacaacacccttcaggaagggttttgaaggttgtggaaaaatcagtgtgtgcagccaacaaaagggcaacaagccaattgtggttatacagggctgttttaagagtcaagtcatgtttgggatgggggtggggtgcacagtcttgtatcaagcattttctgtagcagagctcaatcagcatctacaaggcagggctgggccactcctgcctctgagcctgtcttcagtagtgggtgcctttgtaacgagccagcctgtccccggacccaggcagagtgacaaaacagctacacattcatgaagaacactggctgtctccataacaaccacggttaacatgactctgtagaactatgggcgtggcccttgggtctcctggcctggctaccaacatgcctgtggcttctcattgggccccgtgagtgctggcagggctgtgaagcaggtgtgactaatgggtc

SEQ ID NO: 536 - DNA, 1462 bp, Homo sapiens
ctttgttgtctcagcactcccttcacagtttacaagaggctttgggggagggctttaccccccgggataatgggaggcgtggagccacggtttgctgcggtctttgctctctgggcagtgaggccttctgttgtttaccttaggctgcctctgaagctcccagatccctgcctagacatgatctcactctctcaaatcatccctgcgaggcagacaggagtctgggtccaacttcccccacttcacaggtgggaaaactgagggattcacacatgtgtgtgccgcaagacacacacacacacacacacacacacacacacacacacacacacagagcaaatatgttgacaagttgctctgcagtcctggggtcctgtgcctgcagttatttggaaggtgagaggtccatgatagggcctggcccagcggcgttcagcaagtgcctcaaaattcatgggccttctagtgatatcccacagcctaacacagggccctgcctccagggagcctgtggtcagtatcagcaggtgagaggagcctaaagagatgcatcctgcgttgctgaagttcctgagtccagttctaaggcagctctacaggcacatttcgccaggcatggtggctcatgcctgcaaccacagcactttggaaggccaaggtgggaggatcactgaggccaggagttcaagaccagcctgggcaatacagcaagaccctcgtttctacaaagaattaaaaattaaaaatttagccaggcgtggtggtgcacacctgcagtcccagctactcaggagtctgaggcaggaggatgactcgaatccaagagatcaagtctgcagtaggagctgtgatcacgccactgcacctccaatctgagcaacacagtgaaaccctgactctaggggataacaaaagtcacatttcatgagggcaggccttgcgtgtggtagcaagagctatggtggagagggaccacccctgagggttggtgggctgcctggggacggtgcccagtgctggacaatccacacagctcctctccaattgttgtggcttcccaacacccctgtaaaagaagaattgctatgatcctgctctacaaataagaaaattgaggcccacagctcacccaggagcacagagcaagccagtcagcagtggctggccatctggctgcaggtcctgagctttgtccacaccaccaagccacagtctccctagcagggaggcgcacaaaactatcagaggcagaggaaaggggtggcctctgccaggtgaggagccagacggcctgcttcgcagatcccttccagctggctttgccttccagtgctgaggtggggtgaaggaggaaaggccgagctgggagaggagcaggcgctcgccacaaccacccccaccctgctctccacgcgccaggtcctgcacgctgggtgggagggtgacgacaaggatggaggag

SEQ ID NO: 537 - DNA, 1461 bp, Homo sapiens
attgtcagcatgtctgtctccctggcaagttggagggcagaaatggcctttgctcagctctgaacccccagtgcctagaacagtgtctggcatatggcaggtgctcaataactggttatggaaggagtatagctgggtaatatggtatccccatatgaacagaaaataaaacccagtagaggcttaggtccaagggaggggcaggaagagagtttcattagtctccaaatgtcctgagtctagcacactgcctggaatatactaaatgccctcataagtgccctttggagtgagtatggagggtgctccagatacgaggcttccatgggcctagaggatggactcaggaggtttgagactgcatttggattgcggccagaactcagggccccatcccaagaagtttgaggcccagccagaccaccatgagagcctgcagaggactggggttcagggtactgggggcctcttttaggagtgcaggctgttcctgtggactctgccagggctcaaagctgcggactggggggtgggctggatcagagtgaacaggagcgggcaggctggagttgggacacattctccagcctcttctgtttgcaggtgcctgaggacaccttcaaaccttctctgctccgttgtagaactttttccagcaagggggagaggaaggacaaaaggctatgccttgggctccaaagtttaggagaggagccatggagatggacagagagaggtgaggagagagagacccaggaggcctctgggaagggaagggaaggttgctgaggaaggaagtctgcacttggggccagccctgcctctggcaccagccccactgggccagggtcccagggatttattgactaatcctcaaatgatacactttccctgatttattctctctcccgcttgcaatctcacaagatcccattgtctctggacactgctggccaagggcctccacctcaggagctgctgcctctcatccacttccggggcgagggtaatggaagctccctaccgccaagcaccacgaccctcccctgccttctccaggcctaagggtcaagctgccaggccaccaggcagtgccaggtacgaggatgacaacacctagccaacccgcggagaaggcggtgagctgggtgacctcctggagctgcaagagtttgtgcctgctgaggccttgctccaccgagtcttggggggaggcagctggcgggtgggggcgtggctgccaaggaagtgggtgtcgggtactgggcgggggacagagctaggtcacagtcgaggttttcactgacccgagtgggcgggggtaaagggaattcgtaaaaagtttctttcttcattaatggccttttttccctatccgagagcctgggcgcgggagggagcgaagacggccgggggcagggcaggccctccgcaagtgacacttaattcccggtctggact

SEQ ID NO: 538 - DNA, 1459 bp, Homo sapiens
ctttgtaattgccaaaggacaggggtcccatttctcccaatttccttgaaggcctcaaggttaagctctcctgaagtgcaggaggggagcagagtgaaatcttagcctcttgatgacccctgtgaaatgggacggggagcaggggccattcccggggaactaaggacaggcctgggccccagggcttataaggcttgctcaaagcctgtttttttgttgtttgcattacatttttagaaacagatttttcctcgttgattgacttttttcctctggtgaccatattcccttccctccctcccacctccccaaccttcatccctcttctccagaattcagcctttcccaccactcctggtggctgatgtgtgactttttcagggaacagctgcagctcgaaaagttgcccgagacacagtgtttcagggttgctgggtgcccgtgaggatggttatgggtgtttttctcacctaggagacgcggtggggtaggggggccaggacagctgcatggttggaggagagatgccatcttttggcaagggggtgcaggaaggcagtcttcctagagctggggctgccccctgccagctggggtgagggggtgtctttcatctctcccagacgcagggctcccactggggtctggctgcccagagtcccatccttccctctgtggccggccttgtgcctcctttgcttggtctccctgacttggaacacttttgaccacaaaaaccctgattttatccctgttggaaaccctctctgattttttttttttttgaaacacggtctctctctctgtcacccaggctggagtgcagtggagccatcatagctcactgcagccttgaacgcttgggctcaagtaatcctcccatctcaccctcctgaatagccgggactacaggtgtgcaccaccatgcctagctaatttttccttttgtgtagagaaagggtctctatgttgctcaagctggtctcaagctcctggcctcaagtggtcctctcatctcagccacccaaagcactgggattatataggttttcatatactgtgcccagcctctgatttaaaaaacagtggagatgagttggcctgtattttctctgtggacctgctgtatggggctgtgggttggcctgcacttttctgcaggtggcctgtctaagctgacttccacctgggacctgtgtgtgtttgagcctgtgctttggttgtgcaattctgagcctgccccaccctcctagctccttcctgaaagtgaaatgctacagtctttgctcaagaacaaaggactcaagctcagccctgcatgttaataattttcaagtgtggccacttcctcttgcctggcctgactcaccctggctgctgcccattgtggctgccatggaaatacaactcgaggagaacccagaccaggacagggaggccatgttctgggtggcagtgg

SEQ ID NO: 539 - DNA, 1456 bp, Homo sapiens
cgtgattccttgatacttttgggatcaagcctgaccctttgatgtggtctccaagcctaggtcagcctgaccatcatcctcttaccgcctgacattgctgcaggtgggtggaaggcctcggctcctctcaactccaagcttcttttccttttaggtattggaaccacattcttccacccacctggggcactttctcaagcaaaactctcagccgccttcaattttgagcttaaactttacttcttttcttcctccccctagagttcctcacacatgagccccttgaactctgagtttgggatcctaaaacttcttaagctttattgttaccccttacctaaccagaatctaagttccatgaaggagggacctcatccatactccccatgccagtgaatacatttcgagtaaaccccaaaagtatttgccaatgataaggtaaaagcagtgggtttcacaaaggacaataccatttgcagaagaagcaccacatagcaataaaaacccaaatggttatccagattatgtaagggccacaatcatgggcaaggtccctatcatgtgtaagagacaatgtgagttattttgtctatatgaaatatgccttttgtttggtagttgtcattttttcaaagaactttttgctaggctatcgaaaaggtgaacgactcaggagaatgggcattatagttgacggttatttagcaactacagtgtgccaggtccaacaaccttatgaagtaggtgcaattattactgccatttggtgaataaggaaactgagatgcctaggaaattaagtaatttgcccagtgctatacagctgatcggttgaaatcgtatctgaagccaggcactgccattcccaggcaggcacccattgtactgtctccctgtggaactgcagatcaccttccaatattgagggtcttccacatttgccggaaaataccatgggctgaagatgtgcaacaggctttacctccctctctcaagaggtggagctggttcatgcctcagaacataaaagggtggggtttgatttctcatctttgtgaattatttctgaagagtttattgtataatcagtgactaagtaattgtggccacgaggagatacaaagatgtttcattatggatggtgtaatatttaacttcacggaaaggacccggggctctgtggcttcccatccgtcttgtgacccggaatcatggtgatctaaaagagccctgtgactctgggaaatttgttatcaaaggatgttagccacaagtcctgttggcaaatggaccccaggtggcctgcagtgccaagctgtttccctgccagcctcccagtctggccctgactctccaatgtaagtgaggggcacaatggaaatgttattttaggcctttccactttaattgcatttcctacaagagcgtctgcgggtttttcttcattttgctggtg

SEQ ID NO: 540 - DNA, 1455 bp, Homo sapiens
cagtggtcctgctctccctactaaatggtggttcaggaggccagggggcggggcggtaccggcggcagaggcccacggacgagctcgcaggagctcatcacacagctgaccgtcacctgcccacctcaccacacctgctaggtgccaaaccccttgtaatggacagggaagggctcaatcacgggtccctactcttagcagcgaacctatctcagcgcacggcctcctgggagatgtagtccagaccgcttcccgggaaccccccccccctccccccccgccccgccacaaccaggcatccctggtcccctcacaacttccccaggagagattgctcggcctggccagctgaagctggagttgctctccaagtgtcggggccaggcggcactccgcggaggagtcggggtgctctccccagtccgagcgaagggagggaactacacttcccaggacgccctgcgcgcgccgagccgggagccggctgcctcgctttgcgtgaccgcggcaggttggtcctggagcagataagcgcagaatatttaggcgaaagcgagaggaaggggggagcgcggggcaggaggagtacctcggccaagaaaattatgcatgcgttagggaagctctgagagaatggctgtggaaggtaagggacgcttggggcatttttaagctccctcttaacccgcgcaccccaaggcacacatccccgatgaagcttggcgatcgtggggaggcgaggaaagggggtggcggagagcgggccccttcctcctccacctcttggcactcacctgcgccgccaaggccagtaggcgctttaattcagttgctttggagagacgtgaagggtaggtgcgtaggactttgaggtaggaggtgtggagacgagtgtccctgatgcgaaacgatatcctggaaatggggggaaagccggaggatccggcatgaggttttggccccgagatgccctttttccctgccccctccctccggagcaggctgggtggccccggggctggggatgcttggttggcccccctcacgtgggagaggtccccagcccaggtgcgtcatccggaagcttggactgggattgggtcgagggcccttcgtcctatgcacccagcagcggcggccgcagatgtacccagagggtagaggtgtccctacacctgtctctgcttatacagccagcgccccgggcttagcaaagtttacagacatgaaatgtaatcagccagggaaaagaagtgcaacaacctcttcgatttgggtgaatccttttctttgaagatcactttcttcttacagtcttgagcttcggctttgcagttttgaccgtaaagtcctgcctcccttgaacttcctggttgaaagcagggtcaggctgttcgtgagggatcctgagtttttcatttcaggttatcttaccttggaacacaaacttccttg

SEQ ID NO: 541 - DNA, 1442 bp, Homo sapiens
aacatggagctctgtattgggaagaatctggggccaagaccagactcaccagaaagtagtgctgtgattgattagcaatgcctgtcatggccatgggaggcaggagtggggacacctgtgccatcccctatttaggagattaatttccccactcctatctgtctagtctgtagcaaacagacctttaacataaagagtcaatgctcttctgcaagggtccaatatgctgtgcccagtagggcaccttatgcactccagaatagtcttgattttcacccagcttttgaagtgaaaaaaaatttttttttttgagacaaagtctcactctatcgccaggctggagtgcagtggtacaatctcggctcactgcacccttctcctcccgggttcaagcgattctcctgcctcagcctcctgagtggctgggactacaggcgcccgccactatgctcagctaatttttgtatttttggtagagacggggtttcaccatgttgaccaagattgtcttgatttcttgacctcgtgatccgccctcctcggcctcccagagtgctgggactacaggcgtgagccactgcaccctgcccagagttaattttctacaaaatagataccatcagctccctgccacctacagcaacacacatagcccttcaacacgtggacccaacttttctccctggcctcatcagcaatactcctgcacgtgcaccttatagtccaggtgtgtggaatttttctcattgtgttcggaattcacagtgccctttcctacattcttgcattctcatgtatgttccctttgcctggaacatctcttcctttcttcttatcctttaagatccagctggcctcttccgctgcgtgcgggatcctagcgcaggggcagcgcaagttccaggcgcccaagccagggaagaggcagcggcggcctctgaaaggaaccggggccgcaggaaagacggtcgttttacagctcccgagaaggcgtgcgtcggtcagcagcaaaagcttaagaagaatctagaagtcaggatctggaagaagatcgaacatgccgtggtgatgaaagccagcaacagcctgcccaagaagctggcactgctgaaggccccgaccaagaagaaaggggtggctgctgccacctcctccaacaagacaccttcctgaggatgctggccccagcacaggccaacactgcagcccccacctccatgatgggaccttacaggtgatcccacaggctgcattgtcaggaagaccaccctgtcccccagcactgggtctcacctagaacttcattgggggcctggcccttgggcagcagatcctagggtgctgagaacccagcaatggccaggaagatacagtcaccaatctcatctgcccctgtcccccttcccaggtcctaccttcacaggttcaacccagagcaataa

SEQ ID NO: 542 - DNA, 1426 bp, Homo sapiens
tggataagaggtgctctaggtcggaaggaaataaatgagactacgatcagttaaagttcggtaaagcaagagacgccttcaacccgacgaccagacggtggctccgcagcacagactctctcggatggtggaattcccaaccggcttcgatgtagccccgcccctacccagaccacgcccaccaatcaccgccctctcccccccaggccccgcctggagcccgcccctcctaaagcatgctccacctgactccgacactgccgggcttagtccgccgggcttagtccgtggagcgcttgcgcatttcttgagttgtcgtggcactgcccaaatctgaatgggggaaagagggaacttcatatttcctacagactccgccacagcgactttgcgtgctctcttagagctggttttgcctttcgtggtcctgagaaccctggcttttggttccccaatgcggcttaagtgtgcaggttttaagttaggcgatcttcgggcagccctagtcccagcaccgggtccttgcgctgagtctcgggaccacagccggggaggcggggtccttctctggggcggtcgcgttggcagcggatgcgggaagccggactctgggcgtcatgtactacaagtttagtggcttcacgcagaagttggcaggagcatgggcttcggaggcctatagcccgcaggtacgagtggcgcctggccagctcggacatgagaagtggcggccctagcctcggcgacaggcagtcgcggcgttggagccaggggaggcttctgcccgcggtcgagttcgtctctgttctccttgcacctcccggggcctctccacaccagcgtacggtggtcactgaggcttctttttgtgtacctgctcacctggcgggggctggcctggcgtggaagtttggtctggctcactgcaggggtcaaggtgacccccggggtcacttgtctaaaagggatggtttgtgggggtccccagtgtgacccgagtcagaggtccggccttctccctcaattcgaagacatctggctttcggcctccttgtcgtttgtcatctgccagagccccataggcagcctcacttgagctcgagattagagagcgcggggctataaaggcgtttagagaaaccatggtgcagggggttggggggctatgatctgggttgggaaatttaacaggttacttaacacgtccagggagggaagttgcatgcagcgaggttacactttcccgattgtaaaatatttgacagatgctcgttgtttgggttgtctgaaaagtattccatttcacgcagattctaccaattggagtttgactctccagcatgtgttgggggtaaacatgagggattttagagccccagacgtgccttttcaaatcatggcgttttccgctttaattgtgtgacct

SEQ ID NO: 543 - DNA, 1420 bp, Homo sapiens
cacctcacatcccctcatttttaaggtgaggacagcatgattgtcttcctggcaggggtgaaggacccaagatgggtatagaaagagcaggctccttagaagtaacctccgcacaagctgtccacagtcaactggaaggcaggagctggggaagcctggcctctccgcacagacatccttcatcctggtggggcagcctgccccgttttattcccacgtgaagcatcagacccagggcagtgggggcggggagcagctgtgagattagcaggcccctgccctctctgcaccttcaagttcagccttctcccctgcccctgcctgtaacactgctagagtgcccctcaatcaggtaaatggtgtttgtggtcagcaaggctgtgtgcaaagcctgcgccgagagctttgtcaagcatgagagaggcaggtcactctgacatgtcaaggagtaatctcccatttacatggctaaaactagcaggaaggcaggagctggagtcagggtgtctgtactcttggagcagcccaggaaaggggtcgttgggtctcaggtggctctccctggtctgcagccagctatgcccaaatgccaaggacctgtggaaccattgcaagtaaaataaagcgttaagagcattaagagcagcacggctcctctccttcccttcggtgcctgctcccgccctattccccgagccttgtgctgcgttcggcggtgctgccgaagctagacttgggaactctgggttcagaggggagcaccattttccccgagcggttctggaagacttttagcagctggttgagaaaacaaaacacaaaaaaacaaaaaacagattgcctgacaatgtctcacttgttggtgcaaatgtgcattttttaaaaaatgtagtcttaatgccaaatcctatttagtctccttttttcttatattttttgtttgtttcttaaaccagagagagaatttgacccaaataaacactgtggagtattggatcccgagacaaagaaaccttgcacaagatccctcacctgcaaggtatttctctttccataaaaaatacttcctgctctcgctggggcctttgtcgaaatgtttgcatgccactctctgcacacggcagggtgtggaacctcgacatgacccccagctgttctttgtaagggaaatgctttcttctcgtccatggtagcagagtgcctgcctcaagctggctggctttttaagaaggagaaaaaaaaaaaaaaaaaaactaggcttcccctgttacttgtgaggccagacagtaaattgtatttataggcactcacaggcggttctaaagcctgctacgttttaatgtatgcaggagcagcggcagcggcggcggcggcggcggcagcgccctgaaaggcagccctggaggggaggatgatatgc

SEQ ID NO: 544 - DNA, 1400 bp, Homo sapiens
ctccgtctggaggtcacattcagtcctgccgcgtctcgctgggtcaggcagcaagaagatcagagctgagcccggctgcgggggacacggctgccctgctgggcctgggtccttggattttgcccggcccgggggtctgtgggctctggccggcattgctcgctgagcgtccgcactgggcacattggtgctggaggagctcggcacgctgcgccccggtgatacctggcccaggggcatcccacacgcaccactgacaacttcccgccacccaccaccctcggggaagggcacctcgcgcgcccacagcggcttggggacggcgtcagaggtggcagcggccgctggaggagccccgggccaccacaggcaggcggacttgtgaggagctgcctcccgcccgcccctctcgagccagcctccgcccgccgcgtccctccctccctcgctccctccctccctccctccctccctccctcaccgtgggacggagaaggatgtgaggctgagctgagccgccagcagacgccaaccagcagcctcgcagagccgaccgcggccgcccagcctgccggcccacttcggcccgctccctggggcatcttcccagccctatgtttccggaaaacttggccgagggggagacgcgaatgagaggatgtgagtgagtggtcctggggaggggatgggggactgcgggtgcagggacagggaccgcaacgtggccatctgggatttgaggctgggcagctggggagtcggagttctgggcccctggagtggatgggggtcccagcccatcctttcccccatgccctctcctctctctccctgctgggctgaagctctcctggaagcaggggtgggacctggatctgtgcctgggaaggtctgtgatgctgtgtgcacagggggtctctccaagtggacgggggcttcaagctgggtctggcggggtggtctccaaggcacggtagggtagaaagtctttctctccgtgcctggcagcctctgcctgggcttcccagaacaggaaccagaggaagccagtgccagcctgcccctaccccgcagccctggccggcactaatgggacacccactctggctcctcacacggcagttaaggaaactgaggccggagagcagaagggctggccaagactgctagcgagctctggccaggcgcctggatgactctgcccagctcctttgggagccgtatgttttcaggaagggctgggtgacccccacccccacctccatcccctctcctctgccctcaacccactcccactgcccccatgatcggagttaattagggtccccagcccccagccaggctcctagctacctccttatttattgactgagtttggaaatgtcaacctccccagtgtt

SEQ ID NO: 545 - DNA, 1371 bp, Homo sapiens
ctggggcagtgaccttaacagcccctccgctgcccaggggaggcttgggatggtcacgggattgggatagtggcgtgacagtctccaggcggcccagggcggacaccgcccggggcagtggccagtccgcccctccggggcccgggagaggctcagccgcgcgtgggtccgcccttcccccggcgcctccagcgacccgcccgcagcgcatctggggcccggctcgggcgatcggccagccctacctcttcggtggccgtgggacagtaggagatgagcacgagcgtggtgaccacgttgacggcgagccccagcagggtgatggagttgggggccatccagagcgggatccactggagcagccaggtccagtagagctgcagcggcggctcgagcagcgagacgcccgccgcgctgtagcggtgctcctccagtcgccgcagctgcgccgcgctcagcggctcgctcagcgccctcagccagcgcggcgcggacccggccccggcgcctgccgccatggccgcctgagggccccgccgccgccaccgagcgcagcccgcgcctggcgctgggggcagggagaggtggagggagaggctggcggccgggtcctgcgactgccgggctggactcaccggtcgggcccgcacggcggaggtcgaggtcaggccggcctgcccggctgccggggccccagccccagaagctgtggggccgcggctgcggctcgcgggtggggcggggcctcggggaggggtccggctgggggcggggcggagggggtcctgctaggggcggggaggcgggtgccgcgctcgcgggtcaccctcggcgcccgccaacggcaacttgttatcggcgatcaaggtccttgactccccaggggccggctgcactgcgcctgaggtctgatgtcttaacccacggcgtcggattacgccctgaggtcgtctcctcgcgggctgcaccacgaccgagccggttcctctcctaggggtcggaacacgactccggtcgcccagtgttagccactgcaggaccacgctgcccgcagagcctgggggttttcgtgtgagaacacagttttgcagggctcgggtcacgggggtgacggccccatctgtcctgcttggtaaaacacacaagcacaattctccctttctgtacggaggaaggcggccctgccatgtattcgctctagagacccatcactgcggattcagagaccaaggttttgaaactgaaaatcagggcttagaaacactaacaaggagaccgaatggctgaaaccccgatacctattttcttcagcgcatttgataccaacaagggtgaatatttttacacatactcttccctggaataaagggc

SEQ ID NO: 546 - DNA, 1352 bp, Homo sapiens
tcaaatatcagcagtttcaggcacttagccctaatatccattaagcccttagaacagtgcctagtacctcataagcatttagtaataatggccaacaggtgctccttaccgtgtcaggtagcgtgttgcccattctgcacgtaaagctcatttaatcttcccaactatcctatgaggcaggagctactattattttcattttgcagatgaggcacagagaggttaagcaatttgtagtaggtcccaaagttgattggcagggctggaatctgaacccaggcagtctggggccagagcccactttcttatcatgtcctgtagtctcttggtagctactaaccatcattatagctattcctgggctgtcttactctggaatcctgagctccaacctacaagggctccagttctgcctcagcaaaggggtgttcttttttacccctcatccccggcctatttgcaggggacccctgatgcaggcagagctgtctcttacctcctccatttttctggcacaggtaggggaacctccagatgttgccgaggcccacagagaagccaatctgggccaggatgtactgcagcttactgttccaggccggccggtcctctgcatccagctcctcctccaccgccttctgcttgccgcctgcctcaccagccacattcagtacactctgcttatagtccacaggctcctcgagggccagcaggtcggccacggactcagtgacatgctcactgctgtgctcacgctgggtcactttgctgttcttcggcattgatgccacctgggccgtgtagccctgctccccagcacacagagaagatggaattcagctgctgtcagctccttctcattcagggacctaggaaaccaggtgagcagtaaaggattatctgaccacaccaggaaggtgaggagcccaacgtggacacaacccaaattaactccccatcacactgtgaggcaggtcaagggcctcatatatgcagcttgccctagctccccatcaggggctgcccggtgaggagctcaaggcctacagactcagtttctccagaggcttgacccgagcattatttgaaaagtaaacctaaaggggcaaaataggcaaagccatactccgaacccaagtagagcattatccgtgaagacatttccctcttccatactgcagagcttagagtgctcaagcccctttggaggcccatacagccttccccttccaggtgttctgcttagccaaaaccacatggcggaagccacggaagccagcgccttccttccttagggccttttcattcaaaatgcagggattgcaccaggaactggttagaaaggggcatct

SEQ ID NO: 547 - DNA, 1346 bp, Homo sapiens
cctccggcttctgatgaaacggcgacccaccacccccttcccagaccctggcccgcagccggatcactccgggcgcgctgccgatcacgtggcgaagcggtgctccccagcgccgtggctgcgcgcccattggtcggcggctggagtcccgggcgcgcccattggctgcggggggcgttcacgtggcagggggcctgggatggaccccggggtcccgagagctggcaggaaagttaaagggggcagcgcggccgcggggagctcgagtcccgggtgactgctggagggaggaggtgaccgcgcagctctcgtgcacggacggacttcgccgcccgcggggggcgcgaacccgagcccgggcccagctcctgccgtcacggcagctgtccctgttcccccagggcgtatgctgccgcgggctggcgcgtctgccctcgggacttatgagctgaacccggtacgtagctccccaagtctcgagtccgagggaagggctggggacaacaaggcgagggcgtgcagcggggacctctttgggttcctgtcacctacattttcaccgtgcgacttgcactggcacaccggggctggaacactctaggtagctggccccagggagctgttgcttcagcgtggagagggcgatccagggaccgcagctgggaagcgcctcccgggcccacgtgctccaccgcgctgctgggcccggctgcgaccgtgacccgggagctgcggctgcggcggctgatccctttaccacctgttgttctggcttcgaaactagcacaagttcccagccccgggtcccgagaggtctggagacttctccaaagttgggtagtggggtttggagcttaaggacaagccgcttcgtctctctccgggccttattttccctataaaacgcgaggaaatacacttggtaggctctcaggccaccgagggcgacgggacctagcacgatccccgtcccgggctggcggaggccaggcggccgcgcgggggtgctggtgtcgcgctgcttgctccggccggggttgcccctttgccggccccgcccgggtgcgataacgggctcctcctcctcgtcgtcttcctcccaccgccgacatctccgggaacccagcccaggccctgcctcccggacacaccgacgctcacgtagtcgcgcttgccacaaccctgcgggctctccgatgcggcgagcgagctggggagggggcttctccgcggcccaaaaggtgggtgcggcgcgaggccaaggaggcttgtagggaggttgggggcggagtgcagccctggtcaaactggacggaggggacagagtcggagagtaacttgtggga

SEQ ID NO: 548 - DNA, 1318 bp, Homo sapiens
cagagattgtgtctttccctgctgaaaaacactttgtcctcaagataaaggccaaatttccagctaagcacacaggttcctcatgatgtcctcagctcccttccgctgcttctccactgttttcccactgcactgtgatacttccaattcttgaaacatattttataccttcccttgctttccttccatctttgtgcatgctagttcttttgacctgggactccctcctccctctgttaggggacagcagaggggacaagcaaggcactagggtcggactgggggattcatatcctacctttgccactgagaggccagtgggtcgcctgctgtgttgctcaatccctaggtgagtcagcgtcttcatctgcaaaatggggatacaaggtaacaacagtgactccctcaaagggcaatggtgaggattaaatgaggtaacacacgcaaagtgctcgccaggcaggcccacagtaatcattgaataaatatgggcagtgtggcccactcctacttgcatttcaggtcttagcttagtcatcacctcctctgaggttggctgtgtgctcccttagtacatggtatctcctcttctaccacagcccggcacctgtcatccccaccacactgcaaactctccgaggccaacagccagtcgactgggttggctgctggtggggacgcataataggcattcaggaaatactgaatgaatgacatggggtgagggtcccagtgatacgagggcgtgcagaggctgtagggggcagtccggggtgggggtaggtcgtgagactgaatgggcaggtggatctcaactctgcgggggacagagagagcatgggcgtccaggctgtccagggctccttcttgccctgggactgaccctgggagggcgcagcgccctgggagaggatggtgctcaactttaaccgggtcggcgccctcgggagaaaatgcagcctgacgggtcgggtgagcgcgctcggccccgccccggcccggcccggccccgcccccggccccacccccgggccttcgcggtgcagctgaggctgcaagtagccggcgccgtcccgcgtcgcccccgcgcagggcgggccccgcacgcttattctgcccgggaggaacgccggcgtccagcccgctaccgaccgccgctgcgggatgctgcgctccacgtccacggtcaccctgctctcgggcggcgccgccaggacgcccggggcgcccagcaggagggtgagtagcgggggcgggagccgccgccgtcccgttcccccatcccggccgccccctctagaggggactagggatggga

SEQ ID NO: 549 - DNA, 1297 bp, Homo sapiens
agctgctgtctggggatcttaggctagggacggcccctgcacctgccatcacctgggctgggacccccacctagggctccccctccccacttggacgcctgcgggcccatgcctatcccactccggtgaggcctcagcctggtggagggggcgcaggcttgggggggagggtggcagagcttcccacagggctgaacctatgcccacaaagccatgacttgcccctgcctgaggctttctgttccccaggaaatcagagaccccctctcctgaaaccgccaggcggccctcacaagtcccttcccctccaggacctgcctggcgccacctccttccagccgccgggtccttcgagaggccccctctcggggctctggccggacttgggacaggctgtgcctgagtttcctcacctgtgcaagggaggatgctggattgtggggagaggggaaacggaccccgcccccaggtgccgcgcgccccgcccctcccaccggccgaggggcccattggctgcggggcgccggggcggggcgcgcggaaaagagcctcgggccaggagcgcaggaaccagaccgtgtcccgcggggctgtcacctccgcctctgctccccgacccggccatgcgcggcctcgggctctggctgctgggcgcgatgatgctgcctggtgagtggttccagggaaccgtcccgggcgcagcgcggggcagggtggctctccccgcaggacgcgacgcggaccccgagcccctggcctgctcgcaccccgcaccctggcccggcttcgggctggtccctgggagcgggccatcaggtgcacagtggtctctgggtggagagccccgggccggggaggccggggaggtcggagggaaccttcaaaggtgaactgtgagagggaagtcccgcctctgagcttgttagtggggtcggggccgggccaagcaggacgcttcacctgctgcgcgaggcgccctgggttcctgggattcacctgtggggctacccacccccactatttagccgaggagggaagggagggcagacaagctgaggcctggagtgcaggggtgtgggctgaggggacccgtctcctgcctgggggaggacatggggctgctgaccctggatcccacccctgctcctggagtgacttgggctggggtgtgctgaggagcttcaggctggaggccgggttgcttcccgccagtttcctgggcagataggggctggctgctcccctgctgcctctccaggttggagatgtggtcatggagacacgtccactattgtgt

SEQ ID NO: 550 - DNA, 1200 bp, Homo sapiens
gttctcttgtctccaaacccagagtcctctttgattcttttgggtttggtttgcttttttccttttcctacatttgacagtatctcgagtggtcacaaatgtaaaaaatgtctagcatattgcctggcatataggaaaaattcagtaagtgataatgattatcagtgctgtgccaagctatggagccagccatatatatatggatgtgtgcatatatatatatgatgtgtgtgtatatatatatgtctttataaattttatgtatttatttctttcaaaaatattaaagtatttgagaaaattgaaaaattaaaaagtaggtttattacgactcatgactttaagtttaaatattttatttctgccccaaacaaaatttattataattttactgtcctggttttaagggaaggaaactcatcaataatattttcatcatatgcttttgagaaacaaagttaaccattaagaatgaaacatgaaaacatgtgaatagtggtacaaatttttccttttgcttcaatatggctcagcatggcactgtcgaattttgtctttatataaaattttgatattttgtttgtcataagctttttaattcattttgatattgcactaaaatatttttatcttgatgactgaggttttttagtgctcccttaaattttgcacctaaaatgagtgcctcaattgttttaccctaacctcagcccattattattttatcttaaaactcagcaaacaccctaacctgctctcttactgaggaggctcgcccaagaataaatgagttccgtcattgcctttcttctctgacttttgggaccatttgcttggtctaggacctgagttgcaggtccaggaaagcgtgtactctcgaatccacccaggagtgcctgactacagtcctcctgcagagggcgctgtggagtcccagacacgagtgttaggtggaatcgggctgattgcccatcacgtcttgcctttccctggcagtaggcttgttatgaaatcattgactttctatttgcctctggggcttaagcgaatctgttaccctcaaataacctatctgatctcagacaaatgccaaacagagctcagtttctctgccctgtgggtggccataaaatccagacaatttccccctaggtgttttcgatggcgcagccacagcttctgtgagattcgatttctccc

SEQ ID NO: 551 - DNA, 1199 bp, Homo sapiens
agggtaggctctttggagcagctgaaggtcacacatcccatgagcgggcagcagggtcagaagtggcccccgtgttgcctaagcaagactctcccctgccctctgccctctgcacctccggcctgcatgtccctgtggcctcttgggggtacatctcccggggctgggtcagaaggcctgggtggttggcctcaggctgtcacacacctagggagatgctcccgtttctgggaaccttggccccgactcctgcaaacttcggtaaatgtgtaactcgaccctgcaccggctcactctgttcagcagtgaaactctgcatcgatcactaagacttcctggaagaggtcccagcgtgagtgtcgcttctggcatctgtccttctggccagcctgtggtctggccaagtgatgtaaccctcctctccagcctgtgcacaggcagcctgggaacagctccatccccacccctcagctataaatagggcatcgtgacccggccgggggaagaagctgccgttgttctgggtactacagcagaaggtaagccgggggccccctcagctccttctcggtcttgtctctctcagatgtaactgagctgtgggctaggaggaaaaggccgggaggaggcacggtgatgactgaaaaacctctcccctctcataagaccagtcatccggacgcgggctttcccccactcggtgcccacctggggtcttacaggaggagctgctcctcctcagcaataggacaagatggtcaggtcttcctgcttccgctgagaaaagttagggtcctcaggaacggagcagactggtacaggaacagagtcatcatggccaagagtccaccgggtcctcttgccatcaggaggaatagcagggcttgtgcaggaattggggctggagggaagggccgggctcggtcagtctccagctgggatccccagagtggtcaccctacccctccctcgagacagactgcctgactgtgtgtcatcaggctggtcaccatctccctgaacctcgatttgctcacctataaaatggaactaataacgatgcctgggctccctgtctcaggggctctggtatagctgaagagaactaatataacatgaaagtgctttctaagctttgggataagctaaaaggcagattccaattttattcgagggcagcgtagattggtgcttcagct

SEQ ID NO: 552 - DNA, 1199 bp, Homo sapiens
taggtcttcatggggaaactgaagatcagaaaggggcagtggcctgcacaaagtcacaggttagagtttggaggacacaggtggaacagcacttgccaggcgctgcagtgtgggtggtgacatcgtcagggcccgctgggctcacagggcctccaggcaaccgggggcctttgggtccccagttacacactgtggtcacatcagccaggctgacctgagggtcactgcaggaccagcctctgctgagggctggctcacctgcatggagggggttgctcccaccccaagcatgagtctgacccacgcaccagctcactctcccctcaggaccaccgacttgcccagtcactgaatggagaccacctgctgtggtcaccttgccaggcccttctctgtagacacaggagaccgatcttgaggagccagaggcagagcccagctgggagccggggtttcactggtcagtcggtcagtctctgcagctgcagcctgagatcagccaagcccctcctgaggctcctacctggctcactttgccctttctccacaggggtctgatctctctgctctgcttttccaaactatttctctttctctctctcgctctctggttctctctctctctctctctctctctctctctctctctctcatcagatggctgactggaggcagggtcccagcccaaggatggggttggggtggaggtggcgaacctgggttggtccccactggatgctggtcctcactctcatggcagacggctttctttgaggccaggactgggtgatggtgtcgctacccccgccgcagtctgacgtcacgctgccgggccccaccagactggagggcgagcgccaaggggacctcatgcaggcaccgggcctcccaggctcccctgccccacagagtgtaagtacccggcatctgggcctgggtttaggccaaggcctgcggctgcccaggcaacaagaagaccagtcaccttaccgcccccagggacctcccagggcctgtcttgtcccctccaccagcaaacaagtcctcagggaccccgagatccagaggggtcactcctcatcccttcagtctgagcctgtcccagggctgtgagccccatcagatttggggtaccccaggtttcatggcagggtgccctcatgaaatcggggccaagggtaggctatttcttctccacc

SEQ ID NO: 553 - DNA, 1198 bp, Homo sapiens
gcatattatccccattgtaccgatgagaaaaattcagagtttcacctgcccaaggtggccaagctaggaagtggcagggctaggatttgaacctaagttttctaactccaagccccatactcctgcctccacagcagctttcgtgtactctcctcagtgtagggaagtaagctttgcctccctatgccgttacatggtagtggtgattaaatgagataataccttaaagagcctggctcggtgagcactcaatatattatgtgaagggtaaactgaggccagggagagtaaatatttcctccaaatcaaacaccaaactgcaggctgtagacacgactttggactagccccagactctccttgttgagacaacagctttggcggcctcgcaagctccgcacccccggatccctccggggcccacacgcagtctagccaggcgccaccacttgggcagcgaaggaaggaaacgcccttcaaagggaccaagggggagtggtcacccggcggggcaggggcggggcgcaggcgcgcggtcgctggaagatgacgtagccggggcgtcaggctctgtgttggttggagcgagcatgtgggtctgcagtaccctgtggcgggtgcgaacccccgcccggcagtggcgggggctgctcccagcttctggctgtcacggacctgccgcctcctcctactccgcatccgccgagcctgcccgggtccgggcgcttgtctatgggcaccacggggatccagccaaggtcgtcgagtaagagacggcgccgaagccggggaaggggactggggtttctggaaggctttaacacgagctgcggactgggaagagagggacagggtccgaggaagggggcagagaatagcaaaccgaagccgaagcccagggcgtttttggtaggtcagaaagaccgtacttgaaggtagctgaagacccgagaggcaattatcagggtattaatggctgatgtttattgatcgaatattgtgtcaggcaatcccttgtttaaatggatgctctcatttaattgtcacaacaatgttttggggtagttattgatttatccccattttgcagatgaaaactgaggcagaagaggtaaaatcactcgtccaaggtcacacagccagtaagtgacagggtcagaattccaacctatgtctgactgacctgcgtgagttctta

SEQ ID NO: 554 - DNA, 1198 bp, Homo sapiens
tgcaggataaagttcacttgttgtttattctcagtctgattaggccaccattgaaaacagaatgtgaactactgtccagaagccctctgtgaacttcaggtctgccttaggagggacgcttccagcgagggagcgcgtgatgaagtctgcaggcattgctggggcaacgctaagtggccgctggccagggtagaagttaaaccaggagatggctgtcaaatgcagttgttaggtgtggcacatctttctcaagctgctgagctgagcaggaaagagagacgtttgtttatggatttatctcatctataagacactcttattagatgaactctatatcagttctatgtagaactctgtaccagttctataaggcactctttaatctgaatctttttatttgctcaagagaaaaataagtctgacttgcatcccattgaagatttagattgcactgtttacatctttcacctgcgccgcggtagcgtcctctaccgatgctatcctacgttgatttttccagcaacctgggaagcaacctcataggtggtttgggatgtcttttggctgtgcttaaaaatttccaacagatttgctacacatcttaggataaatatgtttcctgtgaattgtgatgatttcttacagtacatttgcaagcatgtgtatgcatctgcaggaaacatagcctggctctgtgaaggaatactgctgtgaccgcaaaactgtttctgtagaattttctccggtgtggtcatcctgccttcaggtcagtgaatagatggtgtttggacagcgtctggcacagatactttaaccttaaagcttaatgtataactggtattttttcccccttctgtgtcagcaattggcaacgggacactgtaaataaggattctggtttgtaaatggacgtctgttcctccaggggaggggaaggctggagtaagcagttttgaaattcatgctgcaagtgataagataatttgagtaacctgtaagacctgtggattcacaggtttcaaaaacaggaaagtctcttgtttgaaaaccctctaaagcaacatgtgggcttagaaaagaagccggcttgtggtttggtgattgtacttccttattgatataatggccgctgacgcaaggcctcctgggattgcagcgcggtgaccgcaggcctgacggttaccctgaccgggttctg

SEQ ID NO: 555 - DNA, 1198 bp, Homo sapiens
ttctgttccaaatatccagacgttacagttcccacaggtggccaggagaatgctggaacctttggcggagacggtctggtcttgtcccgcagcccgcgagggtcccccgctatttggggtcaagcagatccccggggcgctctggccaccccttgcggcagctggtgcggcctcctcggagagctccgggccggcgcccgggacaccccgccgccctccctgccgccccagggacgagcccagcggtgcggagaagtgggaggctggagcctgctgaggtcatttcctgtgcctctccgcgagctgcctggagagctgagcccagcgctctgcctttaaggagcgggcggggagccgaggggaggagggcgcccggcggagcgttgaatggggcgcagcaaggctcggccgggctttgtgcagcgagcccgcgggcacccctcccgctccagcctcgccccgccccgcagcccacgacccctgctgccggggaggggagaaccggcggcagcccgggactccggcgagagcgacgcaaggtcggctgcggcggcggcccgagggcgcccgtgtgcccagtgcgcggcggggacggccgcgagctcgctggaggtgagcgacccgcgctcccgccgctgtggtgggctggggctgcgccgcggcggagggcgtcaggctgcgcgcgggggacggcccctcgggcccagaggacgatccggagcaggtgcctccctacctggaagcgagctcccagcggcggggagcgctggagcgcgggtctggcttgggaagccgggcgccccaggggactcgcgccgcgaggccaggaggagcctcccccgggagtacctggacttggggatcggtcagatccagccgctcctgggaagggccctcggagcggacgtgcaggctgccaccttgctatcggtgctcgctccctttcaccccttcccgcacccctccccatctcacctcaggttatttcttctgtgatttctgagtgttgtctttgggaccctatggctcaggctcgactcctaggagcaggtcattcaagcagaaaagaaaacaggttgggcgccgaatgacacagagcattgtgtcctaggagtcttagcgaggactcggtcaccaggaaccaggggccttagtgggggtggcagaggcggtgaagagcctcatctggaaggaaact

SEQ ID NO: 556 - DNA, 1198 bp, Homo sapiens
ccaggattgtttcataaagagggatgtggttggtctttaaccctatgaatgctggctgaggatgcctgcggaacctgtagtgaagctttcaggggctgctcgggttctggctggtaggtgaacactgtccatcttgccggctgggacacagtgactctgggtagttgtgtaagagaggggcccttggcagacaaacaggttcttctctgttggtgggccagccagcaggtcagtgggaaggttaaaggtcatggggtttgggagaaactgggtgaggagttcagccccatcccccgtaaagctcctgggaagcacttctctactggggcagcccctgataccagggcactcattaaccctctgggtgccagggaaagggcaggaggtgagtgctgggaggcagctgaggtcaacttcttttgaacttccacgtggtatttactcagagcaattggtgccagaggctcagggccctggagtataaagcagaatgtctgctctctgtgcccagacgtgagcaggtgagcagctggggcagagggatgggggtcacagtcctaagggagggcattgcaggtggcctcaggggagagcctggggtggcccctaagacgtcctcttggaacattttggcagagttgcctcttcgccctcattatggctcagtttttccaccatgaaatgggagggagggagacaggtgggcaggggagaggtggtagaagtggcctagagaactgttcctggggtctgggacctttgcgaaggggttagagcaccacgctccctgctatgtgactgaggtagcaagagcacgccctcttcccatgtctgaggaagacaccctagcctccttgactcacctaggtcagtcctcttgagccccaacagctctgtgctccccagcccaaggaaggggtaacaggatttcgggcagttgcccctgcagaggccccctgggcaagtcccctgcgccatgtcccttcgtctccttcttcccctaaccaggcctccctccacctgtcttctcagagcaggtaatggcaagcatggctgccgtgctcacctgggctctggctcttctttcaggtgggtctccgaccctgacttcaacgtgggggtgtgggtggaggctggccagagggccctgtccaccctgggggaggagagcccaggccctgattacctagtccctctc

SEQ ID NO: 557 - DNA, 1195 bp, Homo sapiens
ccagagacacaggttcattttcagttaacctactcggagaaaacctactttatcttatttaaattagggtcctccaagcgatcttaacatctcctaagtcccaagcaccctgtttttttcctgatactttttccgtttaccttaaggtctgtgtcaacctgacagtaagctgcacgatggcaggggtcttgcctactaggttccctgtgcacagcagcccgtcaacagtagttgaataaacatcataggtcacaataaccctgggactgcctcttggggaggtagccgcaaactctcgcaggtggcagtgacaccagtacttctccggggggttgttcgagtggaggaatactcttacgtgaaagtgctcagtacaccactgcggcaggaaggaggaagggaagaattccagatggggagaaagtaatattttgcagcacagtacagggtaaactgggtccaggtgggcgtagccgccgcgacaccttcacgtgaccgcggacagcttaaggaccccgcatccagtgcgcctgcgctggagctcccggaagttgccggacccggaacgcaggcggagcgcaagtctgtcagccagtcagtccgccagtccgccagcccagtacctctctctcctcggccctcgtaagctgtccgcggtctgtttggcccgaacggcggcggaggcgctgatcatggcgacattcatctcggtgcagctgaaaaagacctcagaggtggacctggccaagccgctggtgaagttcatccagcagacttacccaagcggcggggaagagcaggcccagtactgccgcgcggcggaggagctcagcaagctgcgccgcgccgcagtcggtcgtccgctggacaagcacgagggcgcgctcgagacgctcctgaggtgggcgcggggctgggagtgggtaggttgtctgccagccgtcgctcgccgctcctcttcccgtctccccccttccttcaatcctgtaacctgggcggagccgccccgtcccggcctgaccaggcgcgtaggtgtggtctgcattctttgctggtgagcaggacccgccctgcaggcccgctgtgactgcccgcttgtcctgcctgcacgtctgctctagcccttggtcggcgagggctccgtggatcagatacctgggagcagcagtctgccctgtactgatctcttttgcca

SEQ ID NO: 558 - DNA, 1193 bp, Homo sapiens
atcgttgccttatgcatttgttttggttttacaaaaaggaaacttgacagaggatcatgctgtacttaaaaaatacaagtaagttctctgcacaggaaattggtttaatgtaactttcaatggaaacctttgagattttttacttaaagtgcattcgagtaaatttaatttccaggcagcttaatacattctttttagccgtgttacttgtagtgtgtatgccctgctttcactcagtgtgtacagggaaacgcacctgattttttacttattagtttgttttttctttaacctttcagcatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggtaggtgcacttggtgatgtgag

SEQ ID NO: 559 - DNA, 1191 bp, Homo sapiens
agtgtggacatggcatatgtgagcttccggacacggcacgtgtgtgagagcctgtggacacgggggcatagagcgtgtgaacacatggcccatgtgtgagagcagccacgtatgtgtatggatgaggcaggtgagcacatgggtgggtgtgggcagggaagtggcaggaatgggctgtgagggcaggcagcagtgagcaaagggcaggggcaggctgggcataggttgtggggggctcggggagggcccctgctaggaggcccacccaggagctcaggggccacagggacctggaactgcggtgagcagcttccagcaggtgctccagcctcctggggctatagggagagagggctttgtccaagcacacaccccagcccagacctgcccaggctgcagcggctgtgctgacccctacccggctccgaccctcacccctccctccctgccctccagctgcctggcccgccaaggagaggatgaagccagccaatccctgaggcttgcggccacacccttggcccatagggtataaatagacctgcttgggagcccacacccagcaactcacacctgcctcagaccagagctctgtgcgggtgacggcgcacgcattccttgtgtccccgcctgtcttggacagagcagaagccacacctgccagaccagtgccaccgggacagctgctggtggccggccccggggagggatacctgctgggtgaagcacaggccgggccgggcccggagaagaggaagcagacactgccacggcagggcagcccagggccttggagcccaaccgtggccggcgaggaggaccacgcccaggcccgctgacccccggccaccaggtaaggccagctcagcccgtgttcaccccttacctgcacaggctcagggtggggcaccatcgtggaggggtggggcctcgtgccaaggaaccggttctgtggggtacacaggccgcagagcacagtccccaggtcccggtgcctggggcactcacggcctcacagtgacggcgtgtgactcaggtggtcacagtgacctgtgtcatcccgccagcctgtctgggactcactggcaagtcaggggtggggcggggcagtgccaggagtcacttctggggcagcctcctgggccccacggggacgcacggccaggcccttgagtctcactgtcacccttg

SEQ ID NO: 560 - DNA, 1188 bp, Homo sapiens
tcctctcttctcctcctttctcccttctcctcccttctcttctcttctcttctcttctcttctcttctcttctcttctcttctcttatgatagggtctcactttgtcatccaggctggagtgcagtggtgcgatcacagctcactgcaccctctgcctcctgggctcaagcgatcctcccacctgaaccttctaagtagctgggacttcaggtgtgcaccaccacagccagttaatttttattttttgtagagatgtggtctcattatgttgcccaggctggtttcccactcctgggctcaagcaatcctcccatctcggcctcccacagtgctgggattacaggtgtgaaccattgtgcccagccaatagctggtgttttcttgaagatttcctgggcctctccagggggtttttgttgttggggcatgttccatggtattcacagcagagttgtttgaaggggcacgtgctcgcttatgtggcttaggtccacgctacctgtagtccttcggaggcaagccaggctgccagctgactgtcttccaccacaaagcctgtgttcttctcctgaccctttgttctttgcacagcgtactgtggctccagtccaagtacacaaacttccatgtagtttaaaaagaatcagtttaactgttggtggttagacagattggtatgtacctgtgtggagagcactgtgacccagcaaaacacttcagggctaagaagacacgaaacggtggcatttgccatctgacccggcaggcgctggggcagatgaagctccagttggaagggctactgctgaattttttttttttttttttttttggttgttgttgtagctctgggagcagatactagctctgaaacttttcccctggctggcttggctgcctctccctgccgggcaggggccaggaagcctgggtgtcaggcagacccgagccaggctctgcacagcagggcattacgcgccccacgcatcctcttccatccccaggcacagatcaaaggcgcagcccaggaggcgggagcccctgcacactttccacctctgctgggcttagcctcttggctggttggtctgtggagtgcctgaagtgaccagctttttgtaaggtacggtttatttgactttgcaagcgagcacctgctttgggggttggagaggtttgtgttgact

SEQ ID NO: 561 - DNA, 1186 bp, Homo sapiens
gtaatggttttcaaactgcgaggtgggaggaggtgctcctgacaattttcgctttgcaaacatttattccttgatttaacccactgccattacgaccactgtgacttgctgatttatcaaaaattggataaatatgttacttgtttttattaatctttctcaagtgtatatttcacatttatttcaatggctaatattaggagtgttgtagtgtttatttagaagtttggtgatgtttttatgaccaaatatatgctgtaggaacttgactcttgtttatatccatcaacttatgggaaaattggttttgttatacgttgctttgcttgaagttgcagtttccaagaaattatcaacaatattaagtgaggacttactatatatccattatgcctcaataaaactgtttttttgttttttttaatttgagacctttacccggggtcctggtgaccaaaattaaggccatgaggacattgagtgatttgatacatgtatcaccctcccaggcccctgtctccctgggcggcctgcactgcgcagtgcccagtgaccagctgtgcttggcctaaataagtgtttgtgtggttgttgaaataatgaataaaaagtagaaagaatacatgcttactgatggttgtcactgtacaaaagataactgacttgtgaattcttggaagtcattttttgttttgtttctttgtttcaggttcatattctaaagagagcaggcactgagcaaatgtttgttgaactgaaccaatctgctagttatggggacatgacctccacttcatggtgttgaactaaacaaacacatacttctccagacaaatattaaaactggtgaacttcaaaataacgtgaaaagctcctatgtttccatgcctcattatatgccacaaaaaatcaaatgataacgagaacaaagtaggttattttgtttgctatttaacttgtgtgcaggtcttcacagaatgagaggcataccaacactcatgaccccaggctagttctgttctttgccagtgtgtggtttgggagttctgtgaagtgtttgcagtcgctactaataatccaggtgacacggcaaacattgcagttcctaggtccagcacaattagaggagggttcactcgtaggcagcatctgagcaacaggctcaccagacttcagcctcttcact

SEQ ID NO: 562 - DNA, 1184 bp, Homo sapiens
aagtttaattcacgcagagccagctgaacggcagacaggagtttggttattcaaatcagcctaccagaaaattcggagactggggtttttaaagaatgacttggcgggtagggggccagggattggcgaatgctaatttgtcaggtgggaggtgaaatcacagggggttgaagtgggctcttgctgtcttctgttactgagtggaattgcagaacttgttgagccagattatggtctgagtggcgccagctagtgcatcggaatgcgcggtctgaaaagtatctccagcaccaatcttaggttttacaatagtgatgttatccctgagagcaattggggaggtcaggaatcttatagcctctggctgcaagcctcctaaatcataatttctaatcttgtggctaatttgttagttctacaaaggcagactgatccccaggcaagaatggggtttgtttttggaaaggactgttacaatctttgtttcaaagtgaaattagaaattaaattcctcctgtagttagttaggtcttcgcccaggaatgaacaagggcagctcggaagtgagaagcgtggagtcatttaggtcagatcccttgcactgtcataactttctcactgttaggatttttgcaaaggcagtttcgtgaacgtacagagacaggcccttgctattatccctattttttagataaggatatccaggcgatgaggaagttttacttctgggaacagcctggatacgaaaccttcacacgtcagtgtcttttggacattttctcgtcagtacagccctgttgaatgttctcacggtggggaggtacgtgtttaaaatgcggggaaggtgcttttatttcacccctggtgaaactaggggagctaatttttttaaacatgatttttggcccccttgaaccgccggcctggactacgtttcccagcagcccgtgctcaagactacgggtgcctgcaggcggtcagcgtcgtttgcggcggcgcaggcgcggtgcgggcggcggacgggcgggcgcttcgccgtttgaatggctgcgggcccgggccctcacctcacctgaggtccggccgcccaggggtgcgctatgccgtcgggaggtgaccagtcgccaccgcccccgcctccccctccggcggcggcagcctcggatgaggaggaggaggacgac

SEQ ID NO: 563 - DNA, 1183 bp, Homo sapiens
gtccatggatatttgggctgttaccaccttttggcaggtgtgaataatactgctatgaacattcatgtgcaggtatttatttgagcccctgttttccgttttcttgggtgtgtatacataggggtgaaattgctgggccctagggtaactctgcctttaactttctgaggaactgccagacttttccaaggtggcagcaccgttttacatccctgtgctgggttttactgattgcattatctcatcagtcctcacatcagagtcatgaggtttaggtagaattgtcatcactctcacttttcaaatgggagagtttgaactcaaagagtttctgcacgcagtcacacagccagtcagttgatgattctttggccagagctggctttgatcacgaaagcagtctcttctccaggccctgttttgtatcttcaggatgaagctttttgactgtgttgttcatgtcctatttcctggcgcctggcacacactgacactcacatatttgttgaataacatgtcattttttcctgatcttggtggcttgatcagtaacttgcaggagacagcatgtcttaggggatcctgtactctccaggttctcacactcctgccagggcctgtatgctctccaccccggatgctgcagaatccccgccagcctctgactctcaagcagctgcagacgcaccgcagtggaaataggtgtcatgacctctgcagagcagaggcaacatctgtttccagcgagtgcttgctgttaacttgacctgttctctcttctgggttgaaggctgctggtgacctgccctcttttttctcctctaggcaaaacccatttatggcggttggctgctcctggctccagatgggaccgactttgacaacccagtgcaccggtctcgggtaagggcatcagagccaactctcagggaggaaccagagaagggacccatctaagggtgaactggcagagtggaagagggagatggagagttgaacagtggatcctgggatagcaggaccagcagggctcccccatttggtgcacttgtacgttgtacagaaaaggtctcaattatacatagttgtgtgtagtgctcccttcagaatgaggagctctcatgtgggtgttgcctgttttgtgggtcaggttgactctaggaacagtaaaatggaagaggca

SEQ ID NO: 564 - DNA, 1181 bp, Homo sapiens
caaagacaaatggctcttccagtgtgggtggaagaggggtgaggtcacccagtcctcagcctgtggtttgctttgcctcagtgccgggagcaatctcttgccctgatttgcattgtgggctgaggattcaggtcagtgagaaggccagtgatagaattgtctgtgtgggtgctgctgatagggatcagctgctgatcatggctagggctagcggctgagcacacgggcaccagcctactgctcgggcagcaaggcagcaggatggaggggtttgtaaaaatgccttccacctaccctgctgggcttgcccgagaggctctgagtgtgtgaaggggaagacaattatcgctaggctggagaatagaaagagcaccatcaggtgagaaagagaagaaaaaaagagaggggagagagtggataagaagaaggaagcctgggacacaagaacaagggctttgcttgctctagggctttgcttgctaaactcctagggagcacacaagtgagaatccagggcagagggaagcaggatgggtgccctgagtgcttggccccatttcctggggcttactggcctcgtgggtgggagttttataggctactgctccttggggaggcctcagtgattgaggatactcctgtatgagcctcggccctgaccccaggatgggggactggaggatcctaacaggattgggggttggttgggtgtaaccaaggtatctgccaaagggagagtaccaaggaaagcggaggcacctcctccctggctgtccttcaccccctctcccctccttgttctctgggagtggctggcgagcagcggcctccccgcagggccaggcaggtgggccagagcttttggtttgctgaggtttgtcagattttccagctcagggcccagccagctggcaggaagcaggacagaggtcacttgaattcagaccacatgtccctgttaaatacattagcttttaaatcaatctttgttcaaagtccagtgagttgcaagcctaatgctcacctgcagagacagaattcctgagtgaacgaacagagcagctcctcttccatctccaggtaagaactgctcgtgtcctccttgagggtgctggccaccggggcctgaactaccttctttcttttccttttccctttttctttttccaagccagtagctg

SEQ ID NO: 565 - DNA, 1180 bp, Homo sapiens
gagacggggtttcaccgtattagccaggatggtctcgatctcctgacctcatgatccgcccatcttggcctcccaaagtactgggattacaggcgtgagccaccacgcccagccagtttacctctacttaaaatggagagagtgcccagcacccttctaccttctcccttggggctctgcagattgaccgcacaaagattgaccacacagattgattgacctgtgaaaccccaaggcagaaaaagaagctttctgtgcccacacagaggtgttcttaaagtcagggttgctcttggcacacatattaataatcctgatgtctaggtaccattgcagatcctttggttcccctctacccgttccaggaaagactgcctgtcttctccgagtttcttgagggctgatgaaatatttcctgaatgtgatctcagaaggaatcccagttttgagggaccaaacaagattttttaaaaattaaatactactactaaatagctggtattgagttaatcctaagtgccaggcattatgcaaaacactttacatgcattatggcatttaatcctcactacaaccctagtgaaataaatatcaatataattaaaagtataaatataaatgaagtgttataatagtctcattttacagatgtggaaaatgaggctcagaaaagttcacgtgcccaagatcacacagctgctaaatgacagagccacgattcaattcacatagtcatctctagaggcaaagctctggtaaagggcttgatgactggtcactgtcgtcacgaacttgacctttcctgcagcactgcctggtactttcccagtacagtgttctgccctgacacagccaaggccaagggcagtgcaggcacagccaccgtgactctctgctgggaggttaacagctccatcagttcagggactgcctgacccagcctgaccaaattagagcaagtaatgggtgtgacataatttgacatgtacattgttaattgaacccaatgggagatgattttaaatagaggcgaataccacgctgtgaactatttgggttatgaagctcttattctcttatccttgcaggagaaagaattgtgccatgaaaaatggaaaactcctgagaagctgttccagcgtcaggagagcagcagacaagctggactggggaagattct

SEQ ID NO: 566 - DNA, 1177 bp, Homo sapiens
accttcctggtaccctcttcaaagtggccatcaggacgggaggccagactgaccacctgtgcagggaggagcacactgtggctggaggtcacctcgtgaagcgttcccaagccacctggctggagggtctccatcgctagggtgttgaccgttgggggagggggagtgacagcgtccagtgcgcatctgggagagaggagctcgggttcaaggaccgcgacaggtcctccgagccctggtctcagccccagcaggggccggcacccacctcggtcacaatggtggacaggtagacgtcctgactgaactcccagccatccagacagctctcctgctccagctgccccaggtccacgtcgcgccccggctccagcccaagcgccgagaagttggcgatggtggcgagccggtagcggcggcagctgtggggcacctcgcggccgtcccgcagccgcagtgggacagtgtggttgcgccaggcgctgctcaggttcgcggcgtccggcacccggcagcggtgctccggggtcgctatcaggaacacggaggacaggccggtgaagccattggggatgatgctggcgctgagcaggaagaagatgaggcgctggaagggcccccactcgcccaggaaggcggtcacctcgtcgtagtcccgcatgccgccctcagaggcccacagagcgcggcctggggtcggggaacgcggcgggctttgcgcgtgcgcgcggggcacccgccgccgaccaggcaagccaggcagcaggcgacccaagaccgtccgcggagggtaggctcgcgagctgacaccgccgccttggtcctgccgcggctggccttacatagggcgcacgaccagggaaggttgcgggcctgggccgcaaggcgcgccccgctggcaggcagagcggcgccggcgaaggcggagctggggcgggacgcgagggcgcggggcgggccgggagtgcacctgaggcccgggcggggcctgtcctggggacctggcgaggcccggcctctgccagccaagcctgctggggacgaccgaggtagcccgggctcggcttaggaaggcagcgggactcgaggccttggggtccgagtccgaactcgctcctctagcgccgggcggggagcgagtgggagagcggccgcgaagctccagtgttgaaaacgc

SEQ ID NO: 567 - DNA, 1176 bp, Homo sapiens
catctgtcctaaccgttttctccaccctcaatacagcttcttgggaaggctggtttctgctggacaggggaaaaacacctcggcttgaattctgtcaaggtcacgactccccagatcaaccaaggactttagagaccggcctagcgacggtcactcgacaggtgacaacgcccagctcgagcctccggcaagaggcgagcgccacctcgctcagggcttcagttttcccgtctgtgcaatgggaccatctgtccctctccgcttccccaggggaggctgtgagggctaaaggtgtcggcagtcacatctctcaaacgaatttggggccgcagagttcctttcagggtgtctggaactgccaaatcgcccctgtccctcccactccttaagaggacccctcaccgcctcggtgccaccgtgacgcctcagccatggcggacctgcactacaccgcccgttcgttcgcctgaggccgcggcgcttgcgcgctagtcttgcggcgcgcgctgcccggctctgacgcctgcgcgagcccccagctcctccagggcggcgagctactcgacaagtcgtcagcgcggctgcgccgcaggagcccgggaggcctttcgcccgaggcgggctgcgggctgctggggtctggtgcggagggccaacttctgggaataacctggctgtgggcttaaaaatcgtagtcattcattatcacgggcttctctctctcgaatacctttaacatttatcgccttgttagtctccacatccacctccgtgaaaggtaggtatttttgtcctcattttaggcctgaagaaaccgagaagctgagaaatgaagtaattcactggaagttggggccaagtcttggatgcccaagcccaaattcctaaccgtgaccctacgctgctgctgctgctgctacttgcagaaactggttattaaccgagagctgttgctggaagtagcttccactcccctgcccccgtgatgtaaaaatagatgaaaaactctgcagtgattatgtgaaaggtcaggccgacacaggagtcctggggcccagacccacatctgacccagaagctttgcaaagatgagaaggttggtaaaccagctatagaaaaggccaaactaatttggctgtaaattaaggcagccaaaagccctccaggatgtaagac

SEQ ID NO: 568 - DNA, 1174 bp, Homo sapiens
cctcctgatagatccctgtgatgccaggcaggaatgagccgcttgggtatccagagagctcccagtgcctttctgctacttcctctacccctgtattttgcttggcttggttctctaatttgactcagcttcacataaagtcaggaacttctcctgcaaacagaacttcagcttctccagtggggatgtgtattctggagagggggatcaccctttcccacttccattgttggggcactcacagtgtttgggatgtctcccaggtcctgcaggagcagtactcttcctgcagagggtgtgtggatcctctcagaattgctggtctgttcttgcagttgatctgcagctaaaattcacaatgcaagcctctgcatgctgctctgtctggagctgcaatctagtcctgcatcccatctgccatgatcactggaaaaccctcatttattttttaaagggtccagaaaatgctaatctatagagatagaaattagattagtggttgcctagggtaggatggatgcaaaatttcagagtggggggttagaggctattgtatagaatcttttggagataatactgattattgtagtggatgtaaaattctgtgaatatactaggaaacattgaactgtacacactaattggtgagtcatatggtatatgaattatgtgtcaacaaagttttagaagacattacttgcaccacgatattaaaaaatgccgtttgagttgtataattacttcttctctctatgtcaagggcaccgaacaggcaggagcctctcacttgccactgttcttaacagtattataaaataattacataagacaggttacttacatattctaggtcataaaaattattgcttgactagagtaattgtaaacataaaagaacaccaaacacactaaaataaatatgaggtcatcaatcttttgttggtctccttggcatgcacctattcagactgttagtattatgtatttacttcaaattttagcagttatattttaacttgattgatttttcctcagatataagtatgagaaatgacagaaagaaacaacaactggaaaagaagcattgcataagaccaggatgtctctgaaatggacgtcagtctttctgctgatacagctcagttgttactttagctctggaagctgtggaaag

SEQ ID NO: 569 - DNA, 1168 bp, Homo sapiens
aattttccagaactggtgggaatgggagtggcagggtgtgagatgggagaagctggagctgggaccagaatgaggccaagggggcctaggggcaacctcaggctgggtccgagagggccagggatgggagagcacaagtcacacacacacacttgcacactcgtgatatactcacaaggcacatgctcacatccacactctcacatatacatacgttcacacactcacatacttgtagtatgctcacacacccacacatgcatgttcacacatgctcactcacacacatgctgtcacacatgcacagaggcacaagctcacatacatgctcatatatccacatgcacagacactcacatgcacacacatgctcacacacactcacatgtactcacgcactcctctcctagactgcctttcactgggtatgcctggggctgggcatggtggggaggaccagaagaagggggcatttgggaaggggttggtggccaggctgaagctgggaccatgcaattaggaaaagagggtgtgggaatctccaggcccctggcagggggccaggacaaacagacaactgattagcactgaggtctgtgagtgagacctaagctgctctgttacccacccagggggctgagagccaatggggctgggctgtatccgagcagaggtgggagaggaggcagtcgaccaagaggcagggtgggatggggtggggggcaccccaggtgctgccctcctcccgtgctgcatgtaggaggctgcaggtcaccttgccctccctgccgcagcagaacaattaggaaatggatgcagttaatccctaagacaaacagggcttgagaaactgcaactcaactggagagaagagagctgtagggctaactcctcagcccgactcttatcgctccccatctctcatccggcacccagtctttccggctgggtggctgcacctccaagagggagaggaggaggaagcgaggggaccaatacactgggaggaagtgacctgaccagacctttgctctctaactccggctggacagaggcagcccagcagccccctagcatccatctggcttggggagtggtgccccagggcttatgagtgagctggaaccccatgtcctggaatcccgagtggctgtgactgctgactgat

SEQ ID NO: 570 - DNA, 1167 bp, Homo sapiens
actcctgacctctccgaaactcttccacatgatgaggtcagcagggaccctgccggcattccatccaagctactgatcccgcccagtgccggctcagtgccagagtcctcactgtggtgacctgaacactttgtttcacgattcatagcagggaagaggagttgagtccggatgatgatgtctgcagacatttcctaactgtttcacagagaagagggttgaggagtgcagactctgcctcagctccatcctgagggtgggactatcaggtgaagggaagctctcagaggacttctcaatttcccaagactcagagaagaggatacaaagggtctgagagccctccagccctgtctgagcaattttttttccagcatgccaaggggacgacaacattgactctggtcagggttctgggtgcccgtgacgtctgcagccgcacacccaggggcccccagctcctctccacgccagcacagactcctgggaactctccctgggaagctgacggggtcctgggatgtgctcagggtcaggcctgcagaagggccctagccagtgttgggaaccggctgctggctccggcctgggctcactgtgtggcccaggctcgccatgtcaccctgccttcccctgggagagaggaggccaaggcagccagggaacgcctctttgtcttggtgcccagggctgtcagataaagccgttgagccagccgcaactggggcatccagactgcttttccagccacgccaggcctcgccccactgtcccgtttgcccaaagggggctgatgagtttagtaatgtttactgagcacccgcccgccttgtggagctgacagccagggagacgagtcggctgcagactttgccctcacaggcaagacagccacaccttgaactctgactcaaggaagagagtgggcagctcaccagagaggccagaggaggcggcaggaaggtggggtctctccagccaggggcttcctgaaagagctgccttctgagcaggccccccaggctaggaagatgtgcacctgccgagctgggcaggagagggtggcccagtggaggacccagcatgggcagaggtttggaggtggcaggtcctgagggaagcggaaggtgagtgtgcgttctggggaagataaggctgcgtgcagag

SEQ ID NO: 571 - DNA, 1164 bp, Homo sapiens
aactgtcactacaaggcccagagggacttgctgtataacccttgaagacaaactgcttctgtctctgagtcccttatctttgtgtactctgtccacagaattgtggcactgccatttatttttcctaatgaaaattacaaacgaacttagtgtttctctctctgatattatacaaattctgctatatatgctaataaaattttcttaggagactagcagtaaagcaataaatattcatataaatatttggaatcttgcactaatgccacagatatcgaaaactttagataagatataaatagatgtttaaacttactactgattagggaaatgcaactaagtaacaattatatatcatttatcacattggcaaaaactttaataaaactttgacgtgggctgggggtggcggctcatgcctgcaatcccagcactttgggaggctgaggcgggcgaatcacctgaggtcaggagatagagaccagcccgaccaacatggagaaatcccatctctactaaaaatacaaaagattagccaggcatggtggcacacacctatagttccagctactcaggaggctgaggcaggagaatcgcttgaacatgggaggtggaggttgcagtaagccgagatcgtgccactacactccagcctgggcaatagacagagactccatcttaaacaaacaaacaaaaactttgacttgatccagtgagaaatatggagggggaaaaaaaaaaacactgctggggtaggggtataaattggaacaaagtttttagatgaatttaacaatgcttgccaaattttataatgtgcacaccttttgacgaaagtataagttgcttatggctgaggctaacatgtccctgagaataaaacagactgaaaatactaagtgttattcagtttgaaagggcaattaaaagaaaaattacaaatctacatttgctaagaattgggcaaaaaagctgaaaataggctggggaatttatgtggaggtcagagtggaagcaggtatgaaagggtccagcagaagaaaacatggctgccaaagtgttttgagtccgttggcaagtttggcctggccttagctgttgcaggagacgtggtgaactctgccctatataatgtggatgctgagcaaagagctgtcatctttg

SEQ ID NO: 572 - DNA, 1163 bp, Homo sapiens
attagaaagccccaaatagcgagattcagtgaaaaaaaaacccaaaacaaaaaagagtggctctttcaagtcatttgaaatatactgagtttgttgtaggcctttttgttttttctgtttttttaaaaaagaatacaatagaaaaatgttttctctccctgagaatatcctggctaaacaattccacgtgctggtctcagagcatgttgcttccttccttgctggggccagaggccagcagccagtaagaataggagctccacacacagggacccatatccaatttgatacattccactggggcctgggaactacagacagccccacagcaaagatttggaattgctgggggctagatattatgtcccacaagcaagaaacccagagagctctgggccagggcatgtaggtggctgtaggcccatgggcaagttctccactcatctgaatgagttaaccccacgtgcctcatggggcaggggtatgggatgagctgatgcttatgacctcacaaccggcacggagcctgcaccgtgtatgaatggtaacaacactggcaacaacacttgtgatggttcaacccaacagccattacctgtgacttttgagatgccctgtccctgtttctgcccgttcctgtctcctggccctcaggatcataaaggacagtgaggaagacagttatgagatgaagggtgggtgacattgttgaggcaggatgtgccgactaggtttggggacagtcacttcaccctccgagtggccgctgtgcaggctgggtggtcagagaagcagagggctgaggcccagaatgggtttgcatgttctgtttctgcagaaagtgaggcagcaccccatccttcccaaccccaatacctagaatgggggccagagtagggagggaatgtgtggatctgcttctgagatgggtctcaccccagcccccaaagcctggacctgagtccccaggagacaggggctacaggggaatctcaccagggaatggccccttgtgggggccccacagcaggggctgggggcaaagtctccccttctaccagacacaagcacaggcacactcctgggggccgcctggcccaggcccaggtcatgccgagcacagggtgctgctggtggccacgcctctgcttagcttctgaggt

SEQ ID NO: 573 - DNA, 1162 bp, Homo sapiens
agaccggaccatcattattctcagctgggttgcataaaggccagtgccactgccttttcttactctacccacagagcaaatgactggttctttctttaagcaaaatacgttaagatgagttcattaacttcaatcagtgcatatagcaagttgaatacgaatttcaggcaatggcaacacacgaagatacacgaataatagggaagctcagatcaaattcaggcattgttttgccctcttgataggccaggaagttgaagtttctttttaactattctgtttacttatttattttttgagacagagtctcactctgtggccgaggctggagtgcagtggtgccatctcagcttactgcaatgtctgcctcacaggttcaagcgattttcctgcctcagcctccttagcatctgggattgcaggcgtcttccaccacgcctggataatttttgtatttttagtagagacaggatttcgccgtgttggccaggctggtctcgaactcctgacctcaagtgacccgccaaccatggcctcccaaagttctgggattacaggcatgagccaccactcctggcccgtcttttttactattctttatagtttctgagaaaagcctttggttcccgttcgttattttttaaataggtacatgaaacattttatgtctccttcttccaaaaagaaaataatgaattaagtggctctttatgtatgattattagaggggagcatcggggcctttactaaaaacaaaacaaaatgtaaaacctttcccgtctctgctgaaggggttccctgctgtgcagcagacattcagtgatcacagagcttagctcaagtttctcctaattcccagcacctctgattcccagcatctcttcttgttctgatcataaacaactccagctcttggattacgtcgggcaacataacagcaggcacggaattctctctgcttatttagaacctagtctgaagcaagcttttttttttttttggttaagtcaaaagtgaaactggagagggaaagctgagggaacaataagaggattaaagattagctatgacacatggcttggaaattaacctttaaccaaacatcttataagtaacgccagcgcagcttcccttgtgaatgtaaagagatccagggctcttg

SEQ ID NO: 574 - DNA, 1160 bp, Homo sapiens
cttgatctctacaggcttctggcagcctgggtcataaaccacaaatcccctccgcttacggggaatgtttcctttcaagttgaacttttacagcctctggcttccctacccagccacctccccagggcagggggaggaaatggctttacagctcctccctcaaaatgtccaacggtggaggctggcaggaccctctcaggaccagaggaactttcctgtcaagttttaggacccaggtcacagtgggctgggaagcctggaggtacagagggaggctggtgagtcccagagcccatgcctctggaatcctcgcatcctgggactacagagtcccaggcatgtagaggctttgatggggaatcctgggagcctgtgactggagacaccagggaggtttgctgggctccccgaagcctgggccgaggctcgcagggacaagctgtcataacagcccctcggcccccctgccaccctgcccccgcaggtgggccccagtggattctgaccttgctattgtggcagggggccgctcagcctgcccctgctcctgctctgcctcatgagaccctcgtaggcttctgtgaaacccatgcaccctgcttagctcctgccgggtgttcaataaacgcccatctctgtccttctagccagaactcctttgttgtataggcctccccgagcagtggctgtgacaggtggtttcctggcacttgcctgcatacccctggggctgggtcttcactgctcccagggcagcctgctcccagctctgattttctctgagtaggtccttgtgctgcgctctctgctctctgagggccccggcgtcctccccttctctgcggtcttaggcctcggtgtcgtgtctcttgcagaagggcctgcccctgccgctgccattcccactgctggaggtggccgtacctgcagcctgtgcctgcctcctcctcctcctcctgggcctcctttcagggatcctggcagcccgaaagcgccgccagtctgagggcacctacagcccaagccagcaggaggtggctggggcccggctggagatggacagtgtcctcaaggtgccaccggaggagagactcatctaggccagcctggctgctggcaccagcacctggaggtcctgaatggtttctacctggagaccc

SEQ ID NO: 575 - DNA, 1159 bp, Homo sapiens
tagctttttctcttcccattcccacctgtgcctcagttttccaaagtgctggatttagaaagggtgaattatgagggagctggagggctttgccccacccccctccgcgcgcacacgcaagcacaggcagaggcacataccccctccaagtcaaagttgtgagtggggtggtgtttgcgcgtctgtggctgggactggatgtgtcagggatgggaaaacccatcatgctggtcacagaaaatgcgcggtggggacagaagcagttttgaaggaaaagaagaggagggggactgaaagaaagaagggggcgctgaaagggagggcgctgggaggaaaaaggtgcagtgtggaggaagcgcggcgtgggcagggcttgggaagggataacggaatatctgaggtggagtgggccgtggagcgtcggggccggtctgagcagcgggtgtgtaaatggaacagtcccgagatgaattttatgggagtctgcgcaggtccttaatgtgtggctgtaccctccagccccatgtaccccacacgatggacagacagccttggtgtggcagggcccaaagaggtcctatctaccgcaataacacgaccaggcggccctgggggcgcaggggctcggggtgggagcggcggagcgcgcggagtcgccgcggggtggcaggggtgggccgggggcggggccgcgggcgtcggggaggtggcagtgggcgcagggcggggcgagctcagcggagggcgggtttgaatgtgccccggcgggagagggaagctgcagcgagagcgcgcggatctcagcgcgggagcagtgcttctgcggcaggtgctgcccggggccggggactggggactggggactgccggggcggaagacgccgctgcccgcctgccacggagggcagggagggcgggcctgacggctccgcagcccggagaagggacgccgggtggggccccagtgcggagcgtgcggagccgcgcagcacgtggcgcgcacgggccagggagcctgaggaccctgcggggaccgggacccaagctgggcggggcggcctggctcccgggcctaaaacaggctgcggtcacgttgacctccgcaaggggcaggcgagtggacgggtgatccccatcgatctggtcggtatcagggagg

SEQ ID NO: 576 - DNA, 1154 bp, Homo sapiens
tttgatatggtgaaggcaggactgagggctcatcacccctacccctcctcctagcagaacaagttgacctttaccagaacacaccaggtcatgagtcagaattcccatgccatgtttgctgaagctattaactcttctaagtcctggcaccccaggacatcttgaccgtcccaacgaagcactgccaccaaaaccagtttgggtggagccttggcttttcttactccatgtcaaattaggaaggtgacccctggcaccagggtcccatcattccccacagtacttttccaagacccaggggggatatgagagaggagagacttgcagcctcctccacaaggaagggggctcctaggagatgagatgggagtaacttgtgccttggctgtggtgagcagtaggggtactcctggtgtaggtacaaactgtgggaggtttgggcatagccatatccaccttgcaggtggatgtgtcagatgggccatggtgtgtgtgtgtggggggggcgtggggggtgacagttcctgcaaggtagggtccgaggaaaggaaagacctatggaaaaggatacacctgggatcttgaggagccagctgcacctgtttctgggctgagaggcttccggagccaccacaaggtggagaccaaggatggcgggggtggggtctttgcagaccggttgttaagtcctggggctggctgtgcatcctgaagcccgtttggcacagcctgcaggagggactttgcaaagccgcgtccaggtagtatatgaaaggtgtgttgagctcaaatggtcagcccggggtcatggggtcctggggtggcggggagccgagaagagggagatccacgaaggaggctttcaccccttggcagcgggcggctgccttgaggggcgggctgtgcctggcgcgactctggcgccgccgcctgggggcatccggctgtgagccccgtggatggggcgcctggagaccgcgtctctcgaggcactaggtcctggtacttgctgggggtggggagggagaggggcgcacagcgccgagaggcggacgccaagcgcgtgagtcactctgctcccctgggttaggagcgggactttgcctcccgcctggggtctgcatttcagctccagcttcagtgactcatcccag

SEQ ID NO: 577 - DNA, 1148 bp, Homo sapiens
aggctaactccccagctgactacctccagccccgctgtgggctgcctgtggaggaaggtgccgagtggggcgcttgtagcttgtgctggaatggtagcggctccatgcagacaggcattctggggtggggtgggggcaaagttgtggggaggttcttaaccaagtgtggaggctgacagaacccgccctggggatggagtagcgttttcaaaataaaaggcccagtttggtataagactgtcaaggcatcaagcaggcctgaggttaattccagcactgatctaacgtgctatctgccagtccctcccctctcctgcctcagtttccctacgtagaattggttcagatgacctctagggccctcccagctctgtcacattgtgccccgtaaattccatggttcctttctcctcatcaccctgctgtccagagaaccttgctcgcagcccagttgtctcctgtcttttctggtaaggacctctggccactaaagtcctgggatgggtgccaacctcagtaccctccttgtacctccaccactggatggggcaaggggtagagcagagcacactgcccggcacaaggtgattggcagctggtcaggacatagtgttctgggcaactcccagccctcccctgccacattctggtccatgatgtttctttccgtactggggtggagggtaaggagcagcaggaggcgtctacctcccaagtagtgtggaaatttctccactgccaaatcccattcactagaggcacacccaggagtgtgtgggagctaaacccaagctaccatttttttcttgaactctatagagactggagactcccaaggttggggacagagaggagcatgagtgactgggctaaagcactgggggcttggggtggttgtgctcggcattcaaatgagcacctcctgctggagctacagagcccaggagagagaccagagagatcctgccccacccacccacccacgcactgtcctctccccatgctagcgcttcacggatggcatcaccaacaagctggtggcctgctatgtggaggaggacatgcaggactgcgtgctggtccgggtgtatggggagcggacggagctgctggtggaccgggagaatgaggtcagaaacttccagctg

SEQ ID NO: 578 - DNA, 1141 bp, Homo sapiens
attgctggggcttagcattaactctcagtatcctgacataaatgactaactagagccatttatatttgtccaatatatctggtcaccttgaacagtgcccacctctcccttggcatattttcaggtgtatggtgccagtggactggtatccttgccacctgttagtaacaaggctcccaatggaagaataaacatggtctggaactaaactggaaagaatagagctgataatgatgattacgatgatgtggtgagtggcagcgttggggagaattaagaagggagaagataaagggaagaagaggagagagccacacagaccaaagtctgtgtgggtacaacagttctattttaagattactgtgggaaaacaaagggtatgatcctgtctggattgttctgaccctcccctgtttctctccccaccccacttgaagctctgggatagccttcaaggatagggttggagattccaaccctacctcttactctactcttgtggctcttggtggggaggaaaaacgtctccctgccaatcggagactcccagaatagcacagcaatttgatctggggatctgggagaattgttaaggatcatgagtgacctcccctcttccctgtgcccaagctccttgaataccaggaatcaaaagctaaaactcaactaacggagtttgaccagcattcaacacagtctgggggagagtgaaacgggaagctgaaaggcaaccaggaccccctggatgcaaactgccaacctagaattgccaaagtacacttctctatttcaatgttcttccctcccctcttcctcttcttttaaaacatccatagagctgcccagaatgagtggaaagtttcagggtcagggagaacctcttccctcccccactttccattgtctaaaatcagcctcagctgttgctagatattttttttgctggtgatgtcagttcatcaaagcgtctcaccctgtgttcccccaggagaacaatgatggggtggagggagctggaaagaccatattaggaacaaaaggtggagctatgagcacagataaagactcaagtctggggacctcctggtcactcaggcagcagccccttctttcttgccccagtctccagttctccagtgtt

SEQ ID NO: 579 - DNA, 1141 bp, Homo sapiens
cccacacacaaaacctacaaacaccaattttctagttataagagcttgttttaaggattttaattctattccaattaagtcctaaagctaatgcaattatcaaaatctcgaagagattttattcaaacttcacaaaaggtctctaaagttgtccagaaaccttggtgaaacagattaggaaatttggaaaggaaataatgcggagacccgtagtaccaaatcatgagacctctaatacaattttaaatattaatgtaataaaatttaaattttggtgtaataaaatcataaatttcaatattggtcccaagtatagagaaaaagtacatttatgttgaatgtggaaaacattatttttaaaatacagccgattaaaaaattgctggggaactgattataactattgataattcctaagaaacatagacaccaaaacatcacttttatctctttaatagaaattggttaaattataatcaatataaggaggttacaaaactccatatacaacactgtatacattttcttggaaaaatatgtgcaactgctctgcaaaatacatgattaactagcctgtgtgatgggataacattgtagtttcttaatttcttgtcctttcttgtatttcccacagtattgatgtatatcttctgcgttcaaaagcaattttttaaagcctcataacgtggtaacaaaatactatgcacgttacaaaattcagaacacggaaacaagaagctcgctttttttttccccctatttcggtttggccctttagatttcccctcccccaccggggcgggacttcccgccgacttctttcaggttctcagttcggtccgccaactgtcgtataaaggcgctgcctcaggccagagtcctcacaaagcgttgggtgagactcctcttgctcgtcatgtctggccgcggcaaaggcgggaagggtcttggcaaaggcggcgctaagcgccaccgtaaagtactgcgcgacaatatccagggcatcaccaagccggccatccggcgccttgctcgccgcggcggcgtgaagcgcatctccggcctcatctacgaggagactcgcggggtgctgaaggtgttcctggagaacgtgatccgggacgccgtgacctatacagag

SEQ ID NO: 580 - DNA, 1140 bp, Homo sapiens
aggtgacttggtgacttagcaggcaggctgagctctaacctagggctactggcttctgatcccagaggggctctttctaaccacaccagcccagctgaacttgacttccgaggtctcttcccagggaagatatggggactttcagctttgtaaccccacccctggtacttactacactcaagctcgagggaatgcaccagaacctgcccctccgccccccaactttttcaaaagacagggtcttgctgtgttgcccaggctgatcttgaactcctgggctcaagcagtcctcccacttcagtctcccgagtagctggaactacaggcatgcgccactacgcccagcatggccctcttttgtgaaagcctggaagggggccctcctgggtctgcgggttagggagtgacaccctgagaccccccccttctcagaagctggacaggatgaggcactagtactcctggccaaatgcatgatgattttaggtgggacacaggtgagccaggttttatttttgtggttatttactttctgtaaagccttagggggaaaaaagtataagtagcccatcaaacttggcttcaccaggtcgtggtagagtactttcatttccaatgaataatgaatgtctgtttgtgaggccctcttataagatttgtaaggcagctattaggtaagtgaatgtgaagataaaatgcgtggagatggcaaatcctcagggatctgggagcctgggatgaaatttggcaaatgtggcctccgtggaagccgctggaagccagagcccacagtttcctccaccctgagcttcctggttacagccgcaggcaagctctgctgatgggcttggaaagagtgactcccagctggcctgcgtcggaggtcagagtgaccgggagcaggcgccgtgcctgctgcttggcgcgccacgcccagcctggtcagcagctcccatggccctcggtggcccatccctgtggcctgcacatggctcagggctctcctccccagaccaggagttcccaggctctggctcactccctctgccgacatctgaggaaccccccaaagccgggtctgcaacacccctcctgagtcctcccccactgccctgccacagcttcttggtgggactctag

SEQ ID NO: 581 - DNA, 1125 bp, Homo sapiens
gttgtaccgagcgtggttctggggacaccgtgcggcctcgattggaggtggctgtgatgaagcgcggttaccgcacaatggaaacgtgggcacctccgctcccatgaaagcctgctggtagagctccgaggccggccggtgcgcctggacgggagtccgggtcaaagcggcctggtgtgcggcgcgccccgccccccgcaggccccgccctgccaggtcgcgctgccctccttctacccagtccttaaaacccggaggagcgggatggcgcgctttgactctggagtgggagtgggagcgagcgcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggctgcgggttcctgttgacgtcttgccctaggcaaaggtcccagttccttctcggagccggctgtcccgcgccactggaaaccgcacctccccgcaggtcagtctgtctgccgaggcgctgcccggcgacctcttcagatggattattacaggtagcgggtggcgtggtaggtactttaaaggaaatcaagcgccaccgcctcgatgcccgcagcgttgtccccagattgcaggaaccgttacgcgccttgcggggaggggaagggtttggcgctgggttacagcgaggtggaaacacgccccttctcttctccaagggagagtgggttggggatgggaaggggcgtcttcggccatttctccagagagtcagctccgacctctccacccaacggcactcagtccccagaggctggggtaggggcgtggggcgcccgctcctgtctctgcacccctgagtgtcacgccttctcctctctgtccccagcatgggcaccagcctcagcccgaacgacccttggccgctaaacccgctgtccatccagcagaccacgctcctgctactcctgtcggtg

SEQ ID NO: 582 - DNA, 1104 bp, Homo sapiens
ccttctggacttctgggtttgtaatacattattatataattgaagcctagtatgaattaggatattttattagatagctacgacttccagaatatttgaacaattgtaatctggccgtatacctgtaagatttacaacagtttttaaaaccacaatattctatagtatttttaggtggattagtatcaatttaagcatcaatcttatgccagtatgtcatctacatctatgcaagcagtaatattttagaaactttttagaaactggcctaatttaaatatgggctggcccttttgtaagttgatgaatgggacccacagaagttgaaataatatttaaagtttgaaaaccattaaatataattgaaactccctcctttaaaaaaaacaaaaacaactaaactcagaatttggaattcaaaattacttaaaaatgataaaaatctctaaccaaaaaggaacgtcatatgttggcttacaggttatccaagggaaattctgtatcagtttgcacttaaactgtatttttctggttcaggatgattatatatttctttacctacttgatgtggtatatttcagtttttaccatcccactgggagatgctttatcacacatggatattggatgtccagaaggaaagccctctcccatcttcccccctgtgctttgttgaactggacatgtaataaatggctttgcaaatagtcacaattattttgtggcttgctgttgtgctatactaaaagaccattaagcagagtccaaaattctgtaaaaaatagatgatctgtaattgataatttatgtgtcttaaagaatgtacctgaacatttaatattgtatttataatagcatattgaatacaagtaacaaatggtaaactgcatgggccatgtgatacagagagagagatcagggtgagctttcttgagctgatggggtagataaggtctttgagatgggataaggttgctgtagggggagggcagaggtgggggtggtggcatctgagcatcccagatcagaagaaagccccgagatcacagagacccggcgagatcacagagacccggcctgaaggaacgtggaaagaccaatgta

SEQ ID NO: 583 - DNA, 1101 bp, Homo sapiens
tggggataaactagagcaggaaattcgaaccatacatagacttaaaaaaaaaatccccttaagccattaaaaggcaataagcaattagttttataccagtgaaatcaataattaaaagttctacttaaaaaaatataacccatgcaacatcgtgtgtccactgagcagtgataggcgcctgtgtaaggaaaagagctctcatcatatcagctagcatttaaggagcttactgtgcgctcaactcttttcatgttatatgatctaatgtgagcatctatgccggtggatttcacatccccgtttcacggacgaggacacctccggtgacctgcagggaccccgcgccagtggctgctgcagctgactcatccgactcccacgcgcgacgctgccctagtggcgtttaaaaaaatcccactcgagtcccatttaaaacataagcaccccactttttaagtgtgactggtgacctcgattttaccttctgagtcacagcaccaagacctgtgtatctgtcaaactgagcacagtgggcgagggcgcgctgtgagagctggggagaagacaggtggagagcacaggtgcaaactaaggggagggctagaaggtaaaaatagcgatcaggggtatgggggtgcgcatggagacgcccgcggagcgctggcgctggccagcggagcaggaggtgaggtcggcggagctgggaggaccgcgcctggcggctgcaatagccgcacctgtgcacgtgatcgcgagcggctcgggcgccagggcggagcggcgctcacctgggcccacgtgacggggcggggctcgaggagccccacggccacgcctcctcccgcgcggcgcgcccggagcccgcggagctgagcggcggcggcggcggcggcaggagcccgggaggcggaggcgggaggcggcggcggcgcgcggagacgcagcagcggcagcggcagcatgtcggccggcggagcgtcagtcccgccgcccccgaaccccgccgtgtccttcccgccgccccggggtcaccctgcccgccggccccgacatcctgcggacctactcgggcgccttcgtctgcctggagattgtaagtgg

SEQ ID NO: 584 - DNA, 1097 bp, Homo sapiens
gagctgtctttctctggctgttcacaaagcatgttttgtgagtggaaaggaatgcgggagtcatgaatttctttctgagtctcttgcggaggaggaggagtggactgttaatttgtagaattgcctgacccagcctccagacccgtgtgtgtgtgtgtgtgtgtgtgtgtgtgtgtgtgtgtgtgtgtgtgtgtgtgtggagggggggctgccattctaacctctcaaggctggggaactagcaagtcactttccaagagaggccaggggactcctagggcaccaaatattgcatgcctgactgtagcaccagaagtcattgtgaccttttcccaacaatgacttcattttatggcctgccacctgctgccactcttgtcactgtctggccacctcagaccccacatgcgtcacgcttggctgagtgcactcatagtccagcaaactggccatgcacgtctgctcccagcttggtggtcacaccacagctgcccaccccccataccaggccaacttctggctgcacactccgaactggtgattggttaggggcatgggattttgtttgaagctgtgaagacagccacggtcacactgtggcagctctgtagcccttcatagtttagaggcctctgcccacttgctgtcttgtttgattcttgcaacacctttgggaggcaaatgatggggccaggggattgactgggcccattttactgatgaggaaactgaggcccagaggaggtaagtgacttgctcaggatgacagagcctagaagtagcaaaattgaaacctgaaccctggaactggagctcttgagggagatgaaccaacagccaaatcttctggagtggaggctttgttaggaattcctttcagggtggaccagaccaagtctgagtctctgagagtgtgttgaggtgagatgttggcttgttgcggggagcatctggttcccggactggatgagtccctcaactctcaaaaccattgccctctcctctcccctcacaccccccccgtacagatgagatgattgaggcacagagaggggccatgacttgcccagggtcacactgagctagagacggagctg

SEQ ID NO: 585 - DNA, 1095 bp, Homo sapiens
gccacatgagcagatagaaaaggcagttcacctattcatcggggcctttgactgcagaagaaaacactggggcactggctgtcaagttcgggagggaggtgactccaggataaacagagcagcgagcagccctggctgcagacagagaggggctggctcccaggccctattttccttccctctctctctcccttcctggggcattgtggagtgcgtaatgtgaaacggaaaatgtcatgatttccactgggaacgtgtccacggttttgagaaagctccagaaactcaggtccataaagcactgaggggaggaggaagggagggaggagaatgggcggtcacagtgccctctggtcaccaaggtgaacccagcgagcaggagccagtacgtggctgtggcccaagcctctgcctgctgctggagcatggccaggccgtcgtcgtagggttgcaggctgttcgggggtcctgggtcccacggagccctgggacctgagggacagggatgttcccttttcccccttggaggtgtagccagtagtttggctttacagggggactctgtgaagagtccagttccctatttttaatcaggttcatttttcacctgcttagaaagtggaacatctcctgaaaggtgacaagtcgtgatcaaaggcaagtctccaggcagagagttggcaggtttccgaagcaaaggttacttagaagtggaggctccactgccagcttccccccgctgcaaaatctgacactcctcaccctcagggttcagcaagattctcggaaaggccttttctgattctaggaggtgctgcagcaggagctgactcggccatttcctggcctctttagttggaagatgacagaaaggcggaagcagggactgctattgtgaggcccatggcagccttcctgtaaaacaaattggcaaattgtcaccttcagatggaccacagctggccctctgaacagccctccttggcctttccagagtgtacatgattgtgtcccatgtccagggagaggacagagccaccaggagggtcaaggtcgtggagggaaacatgggtgagtaagagatggaccccagaa

SEQ ID NO: 586 - DNA, 1088 bp, Homo sapiens
gatagtgagggtgagggcttcttgcaaaaactggattttacaaagaagtgcacagataatcttagaacaagattcaggagactgggttatatttggtcaaggaaggaatctttgtcaagggatttcttaacctttgctgttttccaagatcaaagggttcgggtggaatgcgacaatgtcggtggtatttcaacttagcaacctctttttttgttttgtcatggttgctgagctgaaagggagaaaatattcaagggatccaccaagaaaatgctcacttaggctggaacagcatataataagagatatgttgtggttataagatcaacgattgccaaaaagctcacttgagggtctctcaggctgacaccacttgtcacttagcagcatgatgcaacctggctctgcagttagcaaacctgggctttccaaaagctaaaaccacctcagcacaggtgcagcttttatagaccttaaaataaagcttactcttataagaatagcttaaactatctttaggaaagaaatgcctggtcattgacccagactgaagacaggtataagagaggggggaaaatcccttaaactcccgttcagtctcttatctgaccatctcattctctatggcccatgtcactggcctgttcctgctgtaagtttcataacactgctgctagcataaaccgcttgggtatcagattgtgtctgcatttatctttgacacaaatcataccgaaggggagaagttgccccttctgaagaatccggtttaccaggatcacctgaaactcccaaaagaatgcagcaactaggcaaagagtgtctccgcctcacattatctgcccaagcacagtgctgttggccaagcctccagcagctgacgggacccagctgtagtgaggttgcagtgattgagtaggattggcctgcttcaaagcagaggtttctcatgggaatatgcttattaaactcccactggtgcagaaaccatgaacagaggatgaacaagtgaagttgcaatctcctccatcacagctcagttccccaacaacaggatcacaagctggagatgcctttaaggtaagcgt

SEQ ID NO: 587 - DNA, 1086 bp, Homo sapiens
aactcacgcatttcttggaagtcttgggagattcacctttactcagatggttgtttacctgtctcgtgcacagcttgaccttggactttaaagtgaggataaagaacgaggaggatggggggatgccccccttccacggggccctgtggcttccaaacctcggcctcctctggtctcttgtctgtggagcctccttcaaacccagggaaataaaaccacctgccacgggttgtggttcttctaggatcttctatcaatgttctctgaggtccccaggagccatgaagctggggctgactcccagggcaatgggactgcagtgtccttgttctttcttgttctatgcatccatgctctgctccacccctgccccttcactctgcccacacacatccctctagactggccttgtggtcagagcctggagtgcatgggctgctgggggcctgtgggctgcactgggccagaacccctggcaccttcaagactggcctggagccagcaggtaggtgacctttccagggcctgcctatcccagctttctcctccaatccctcccctctcttgcctgggtcaattagagagagcttgtctgttggctgcctggcagggtggagttcaggggcaggtcaggagcccagtgacagctcggaaaaaaaaaaaaaaaaaaaaaaaaaacagaaaaaaaaaacctacaaaaacaaacccaccattgggcctttcccctttcattcttctgttttctacacagcaaactcagtcgtggctttggagatcactttaagcttgtctccagctggcacactaaggagggtaatggagaagctcccccacccccaaccccaccccttccttccggaagcaaatctaagtccagccccggctccagatccctcccacagtggacctaggaaaccctcagctcagagaacaaccctgcattccccacacaacacccacaatcagccactgcgggcgaggagggcacgaggccaggttcccaagagctcaggtgagtgacacagtggaacggcccagggcgccctcaccctgctcagcttgtggctctaacattccagaagctga

SEQ ID NO: 588 - DNA, 1069 bp, Homo sapiens
aggaagctggacattgcactaagatggctggatttgggcacgtaactgtcagggacagaaaaagtggctgcatgtcagtgacagggtgactgtgttcagtgggccagcgcggaggtgactcagtttgttactgctggatctgatttaaatgtttgtgtaaggaagggtggcaaggggacgcttcaacagggaacgcatagtgtgtgagaaggaaaatgagcaaaagaaaagctaggactaaatcccaaagcccctaaatcccaaaattgggaggtgcgagaggcaggatcaggatgcctccaggatgccttcagcccactgcgccccaccagcgccaagcctgtcccacaaagagtgcgggctggggacgcggctcaggtcgcctctccgcctcgcacgtgaatgtgttgttttggaaaaacgaagccttttgtgttcacttccttgccctcctttgaaacaaaatcctaatcctagagctgccggagcgagactgcggagctccattagaactttccttagggccgggcatggtgggaggccgaggcaggtggatcatctgggctcaggagttcgggaccagcctggccaacatggtgacatcctgtctctactaaaaatagaagagaaaaaaaaaattagcagggcgtggtggcgcgcgcctgtaatcccagctactcgggaggctgaggcaggagaatcgcttgaacctggaaggcggaggctgcagtggggcgagatcgcgccgctacactccagcctgggaaacaagagcgaatctcccatctcaaaaaaaaaaaaaagaaaaaaactttacttaggaagtgtggggagggaaggagggagtggccaaggtcagaggtcagagaagagcctagcaaccagccggcccccgccgtcctagcataggtggagagcgagcgcgtgacgcaggccccgcccccagcacgtgaccgcggcgcgtggggcaggtcgggccgccccctcccctctgatacccattgcgcgccggcctcaagatggccgccttctggcgtctccggcgctgttgaatggcgaaagctttatt

SEQ ID NO: 589 - DNA, 1040 bp, Homo sapiens
ctgtccagtgaattctgtgcttgataatagtccatctatgctgtattaaaattaaattgtaacatgatcggttcacctcataatgatctttatttcataaaacaatttgagatgaggtaaaatttgacttcaaaactaacataacaccataaatttccaaaatagttttataaaaaaattaaaaagcccacaacactatagatagataacataccttaatttttattttattttatttatttatttttttatgagacggagttttgctcttgttgcccaggctggagtgcaatcgtgtgatcttggctcactgcaaactctgcctcatggattcaagcgattctcctgcctcagcctcccgagtagctgggattacgggcatgcgccaccacgcccggctaattttgtatttttagtagagacggcgtttcaccaatattggaggggctggtcttgaacccccaacctcaggtgacccgcccgcctcggcttcctaaagtgctgggattacaggactggccactgcgggagctgcggcagctgcggcctctgggtacggggtcagcgggcagtcctgtaatggccacattacaggacaggccatcgcgcctggccacatgccttaattttcaaagtcaaatttgtctttaaaaagaatgaattcctaccctttgggggtatttatttttgcaactaacttccatccttttattaagtaatcaaacatagcccatttgaatgttggaaaagaactgtcagaaatacaagttcttattttgtactttggtaacatgaattttacacttagttgaacatgaagaatcaaaaaagctctggattgttgtaataattgtttagaattttagatgtaccatttgacctttgactttaagatgaatttcagtgtcctcagtaaataaaggcttacccccaaccttaaatagtgacgcacaaaggctattattaccaccactgagtggcttaaataatcctgtcaacagcaatcgcccatttccaaagccatggtgaaacatctctgt

SEQ ID NO: 590 - DNA, 985 bp, Homo sapiens
cccagctagactgcaactttcataaagacaagtgatacatgcatgttgtagagtgtttggcttgcagttgaaacttaataaggattggaggaaagtgagaagacacatccagattcaaatttagggacctgtgggatcatgctgtttgggttttttttgagccatttcccacctccctttgggtactaatcagtcaactgataagcatttcattcattcaactatctatcttatctatcgatcattatcatctatttatttgtttttgagacagggtctctctttgtcgcccaggctggagtgcagtggcacagtcacggctcactgcagccttgaccttccgggcccaagtgattctcctgcctcagcctccagagtagctcggaccacaggcgctcgccaccatccccggctaatgcttttgtcttttgtaaaggcggggtcttgccatgttgcccaggctggtcttgaattcctgggctcaagcgatcctcccgccttggccttccaaagtgctgggattacaggagtaacccaccgggcccggctggaagcctaatttatacttttttaaagatcatgctggcttctctgggagaatatgtaaaacatctattatacacagaatctaaaatacttgccataaagtagttacactctcggatacctattgtcaaaagggaagtctcccagaaaatatgggggcgctgtagccgccgggtcagccgagtccactctctggtacttttagagacgtcggtcgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggtaagcagggcggtcggggaggaggtttgggagcaggagttc

SEQ ID NO: 591 - DNA, 959 bp, Homo sapiens
ccaagcctgttgttcatctcttaagtggtctttctttctctcctgtctcttgttgaattcctctcttttaaactcactaaaatgaaaacattttgaaatacatggtttaaaatgtctgttgtttcctttttttttttttttttttttaaccaagtcttgctctgttgcccaggctggagtgcagtggtgtgatctcagctcactgcaacttccgcctcccaggttcaagcaattctcctgtctcaactttctgagtagctggaactataggcggacaccatcacgcctggctaatttttgtatttttagtagagatacggtttcaccatgttggcaaggctggtctcaaactcctgacctcaggtgatccacccaccttggcctcccaaagtgctgggattacaggcgtgagccaccacgcccggacttgtttgctatttttatcaacattttaactctaaagcaggtgggctttgtgccattgacctggccagcagagatccaagcagtaagtagtgagaggactgttgggctggtgacagaggagcacagaggatggtctgaacacacaggcaagaagaccagaaacaagctagggactaagtcatctgaggagggtggggggaagtatggtagtcaggaccatggacagctcagttggtgctgctattctgacatcgtgatgtgctgtgttctgacattgtgttattctgacatcgtgatgacatcgttgatgtagcactccagctcccctttccaatgaagctattctgcagagtcctaggttcctactgttgtgatgagagattggtctcgtctacagtgcctttctgtatgtgagccaaatagtaggtaggcctacaatttttgtttccactaaaaagttactctgaaaatgtactaatttaacttcattataaggcttgtcagttacccataatcctgcgaggacgtgttaa

SEQ ID NO: 592 - DNA, 957 bp, Homo sapiens
atgtgcttttcctttgcatttgtccaaggccagaatccttggattttgatgctccttcttcccacaaaacatagaagatactgtgtattgaaagggtgtgatttttcatagaatataggctacagaacagggctggactttttttttttttttttaagaagccgagagcctatgtttatataaatatcctatgtaattaaaaagaaaaatacagttaaatcccagaaataaaagaaatttaaatatagaaaaatatataacttatcaattgaatgtttccaaacagaagagttttagcttctgtcaggcattgcatatctccagcatacgtttttgagaacattttgttctgaaaatttcctgttggcatttttctctgtgggtctctaggtttctgaataatgtgttcttatgtttacaaatcatgctgtactttagtcaaccatggtttatctttggaggataactagtacgttaacatttgccagattttttcttttaggctgggtaatcattgagctaactagattgcaaaatatgctactttaaaaaatgtaattagattttaatcatctctatattgtatgtgtggtttgtgtatctgctgctgctttttcaccattgatcacaaggggcagtcatctgattccagggaatagaagatggaggcttgctctggcgtgtgcgtgtgttgttaatgtatgcatggaactaatttcagcttgtagaaaatgaggccccatatgcttaacagatgctcttctctttttctccagggttccgctatggaagtgatatagttcctttctctaaagtggatgaggaacaaatgaaatataaatcggaggggaagtgcttctctgttttgggattttgtaaatcttctcaggtatgattgtgaacaaactaaatgagctttttcctagctgttatttgaaatggtatgcttttgattgg

SEQ ID NO: 593 - DNA, 929 bp, Homo sapiens
ccctagttaggaagtgagagggctctttccgtaagctcttacttagatcgtagtctctctctctctctcttttttttttttttttagacggagtctcacttgttctgtgcccaggctggagttcagtggcatgatctcagttcactgcaacctccgcctcccgagttcaagcagtcctcccacctcagcctcccaattagctgggattacaagtatgtgccatcatgcccagctaatttttgtatttttagtaaagacagggtttcaccatgttatccaagctggtctcgaactactgacctcaagtaacctgcctgcctcagcctcccaaagttctgggattacaggtgtgagccaccgtgcccagcccctagtctcttaaaaactttttttgggggagccttgtggaactgtcacacctcttcttttagtactgacatactgcgtgtgaaaaagcttgctctgtctgtctgcctgtctctctctctctctctctcttcccagcttgttcaggatctctgtacacagaaggctgcagatgtagccttaaactcatcaacagggaaaatctcgatgagtctaataagcagcagcttccaatgagtcacaaggttcccacccactggagtccctccccgtgtgccaccaaccagcacttttgtcatgctgggaaaacctcccacccaggcctttgccctgagtccagggtctgtgccctaaccccacagtcactgagagcaactggaggccacataaaacagacatctcttgttttccagatactacgggtcataatccctaactccaatcactggcaactcctgagatcagaggaaaaccagcaacagcgtgggagtttggggagaggcattccataccagattctgtggcctgcaggtgacatgctgcctaagagaagcaggtaggaa

SEQ ID NO: 594 - DNA, 720 bp, Homo sapiens
ttttcttcagcactgggaattgtgatccaaagcttttcctgatgaggcacaaagttggagaaacacaacgcaaactaaacaacaatgaaacagaacagagtgaatctgctgtagctcaagagaggacgtagctgcccccactccgcatccccgggctcgggtttgccttgctgacctctgctgccacctggtgctgcacagagaaactgaggagaaaccacatcagtctccttcagcctcagcttcacatctgtgggtcaagcaaccctttcagaagctgtataatgtgggaaagctttcctctcaggaaaatgcacacatccaactttgagaagatgcccttgggggtgcttcaaggatcctagataataaccccctttcccgaacatccaagaacctaagttttttttttttttttgagaaagtctcgctctctctcccattctggagtgcagtggcgtgatcttggctcactgcaagctccacctcccaggttcaagccattctcctgcctcagcctcccaagtagctggggctacaggcacctgccaccacacccggctaatttttttgtatttttagtagagacggggtttcaccgtgttagccagaatcgtcttgatctcctgaccttgtgatccacccgcctcggcctcccaaagtgctgggattacaggtgtgagccaccacgcctggtccaagaacccaacttttagatct

SEQ ID NO: 595 - DNA, 2695 bp, Homo sapiens
gctcattggctgtaagaactgctccgctgcgacagtgctgctggaggtggtggtgaacaggtacacccactgcagcctggagaggtggatgttgacgcaaagtctatgagtctcttgtgcagccagctcaaggctggctcttcaggatgtttgtgtcctgcttcccaaagagccttcaggcttcagaggtcatcttctccattcccctggctctaccacacaagccaccctggatgaggagaggttcatgccagagaggggtcgggattctccaagccctggctgcaggagaatttttggagcatgggggctgtcatctgaccaaagatgaaaataccacctaacagacgaggcaaggcccaccgtggggctgggtggctggtggagcaacagaaaggaacatgtgggtgagaaatgaggggaggatgcagtccagttcccgggtccagggacccaggttcccccgaacttcccaccagtcccagcttctttagaggatgtggcccagccaaggctgtgggggtctgggggcagtgggcccaagaataactcttacttatgtaggtctcttctcaaaggagcttggccatggtgacggtgatgagaatgttcaccagagccacatttttacaatctttatataatgtggtgactcgtttcctaagacctgaaaatacttcctccttatcctcacacctcgtcccagataaaatggcaatgccaaagtggcaaagcagaaagcagtgacttacctgaggccccagagcaagctgggcaagctccatgaaaaccagcttttcagcctgagcccagatattatctttgatcctggaccccattgccctggctgaccaagcctcggcatatttgatggaagtgttgcaattctggctcccctcattttcagaaattagtttctaggacttcttactttttaatccatcccctgataaagacccagttaagtctgaaccatccatcatgatgttcatttggcttaagatataaaagttttcagagcccacattcaaaactctaaaaatatcttcctcttttgatctaggtggcatctgtcctggtcatcggcctcgggtccagatggcctgaattatctgtctctctcatgcagtctttgctaaaagagaaggtctggtgtaaataatttaaaccccattcccttcccctctctgcagatttctgatgccaagctgatcatcgtctcagcaccagcaaagacatgctattcccgtccctgacgagcatttccttcttgagaaagtgattttgaggggctgcagatgtacttggaggaaggtttgggccgggacagatgacgtgcccatgtgggagctggacggcccctctctgggtagctccctgggaactcccatgtccgcctcccgctgcctcctgatccaaggtggatgcacttcatttgaggcctggtctttcgtccttccctctcctcttcggggaccactttgtctagtgctagactcattgtgcttcccccttggggcttccttcagccctcagccgattcaagacttcaaaaggaagttggacatggagaggaaaaaagaaatgaaaccaggaaggaaccgccaagaagcacacaacgcgtttatgctgccttaaccacacgcttgactctaaatgggtttaaaaattcttacttgtgttagcccaagaaagtttctgcagccgtctttttggtttaaacaatcaaatactcaataattctggggctggtgggccaggatatgggttactcagatcttctgcttcaccccatgctcggtccctgagccagttctgtcattggttctttcagaccagggcaggaaaagtcaagaaagcaaaagcggattctaggctgtggggtttgctgtttgctagccccctggcagagatgcctgtccttgcagtcctgaactggtggccaagtgtgcatgcatgcacgtgcaggtgtgtgcatgtgcaggtgtgcatgcgtgtatgtgcgcacacacattcatgcttgtacatgtttgtgtacacgcacacttttttctgctttcaatttcaagctgttgcctccctgatgtgtctgtttagtgacttgagccagaaagattcccggttctatgtgggatgagaatgaacgcaggcaggtctccacagaagtgagtaaagtagagctgagaagaaggacattgtctcatgccagcctgtccaatagccactttgccccagccctgcctcaagccccagagagatgacaaggctctctctgtttgtcgactccttgaagctcagaaaggtgggtcaagaggtgcccgtcaagcgtttaggcaagcacaggaccctgatctttactaagtctccacatctctcttgcacagccctgggctcagggcttggtcccctctgggcaggccatccagactaagtgacagtcagattgtgtgtggggaggctagagacatccattcttcatggatcagcctgaatggctggacagatcttgcaaatggattgtgtaagacagagtgtggaagaggaggctgtgatcagtggcttggagagcagagtgtggtcaggcgctaaacctaaggcttttctgggaagagctgttaagattagactgttctcccaaaaagccaataattctgagtgtctccattaatgcctaggtagcccatactctcaccca

SEQ ID NO: 596 - DNA, 2546 bp, Homo sapiens
gctcctaggtaaccccaaaacaagtgcttcccctactcggctgcaacccaggccccagacacaggatcaaggtgccctgccccacccccaggccacccagtgccctgtccacaggcgacagacagcacacaggaaggaatctgtcggggcagcactttgttgtacaaactgccaggggctcagagcccgacacaaaggccaaaaggcctttaatcccctggcagtctgagaggggcgccgggccggaagggaggtggccacagcctcctctggcatgcttgtgctgcccgtgccactcgggaggcctgccagcttctcacacaggggcccccaaggtggcaggaacttcaccagccagtcagccaggagaaatacggacgcccccaaacaaggagagggtccaacacgcatccagggcttctttgtgccaggggctgagctaaggtcttcacaagacttacgtcactcagatccaccacaacctcacgagggagacactggaggcacactcatttgatagataaggaaaccaggctcagagaggtacagttacctgctccaggtcacacagcaaaggcaatgggaacggagtctgaaaccaggactcccctctgctgggttcatgcttctgtatttggctagctcagaggcacagctgccagcagggccctgcttctgacctctgaccccttgccctctgtaagctcatatcaaggcctgcaacctggaaaagctgcattccatccagggcttctcgggagcgctggggcaggtcagggccttcagcggaggcccagagggcaggaagctggggtctggagtttctagtcccagcttagccccgcactcaccacgttgccttggacaagcccctgcctcctttaccttttagctaactttagtgagtctctactgtatgcactgggcatccacacccaccatctcagtccatgtgaacaacacgtggaaggcagtgactttgatctgttttgagcattgctgcaactccacaacagaaaacacacagtaggtactaataaatctgcggactcacggacaaaccaaatgaatgaacctgcccaacagccctgaggtggaaattaacccacctgacagaagaaagctaacttcagaaggagacttgcccaagattacacagcttgaaagtgccagaattacctctagtcctcagttcccattaatacgacagaggccataacacttcatcctaagggaaagaggggactaggtcacacgggccctgaaatccgttccaagacacccctgtccctgcagaacaatccctccaagaattagttctctccgctatgaaatgggagcaaaaggccgggcatggtggctcacgcctgtagtccccgcactttgggaggcagaggcaggcggatcacctgaggtcaggagttcgagactagcctggccaacatggtgaaaccccatctctactaaaaatacaaaaattatctgggcgtggtggcgtgcgcctgtaatcccagctaccctggaggctgaggcaggagaatcgtttaacccaggaggcagaggttgcagtgagccaagattgcgccactgcactccagcctggtcaacaagagcaaaactccatctcaaaaaataaataaataaaataaaataaaaataaataaaatggaagcaaaaaaaggtccccgctttgcctccttcctggggctactgggagaggcatgtggaatgaggcggtgatctctttgagaggcacagtcccaatctctgaatctgcctggcccttctccaggcaggccccatgtggtctctgccttggaggctcctatgacatagctaggggtgggcacccaacccggtctggcactgaccaggcaggggactggcgagaacacttgaccaccagccggtggggcagagcaggctgtgctgtcagacacctccaagtccgggccaccctggccatattctagctagggggcttcagcttcctcatccttaaaaaaagtagaatcgatcagatctgtcccatttggttcaattcaagtcacttcaacctcgacttacggggtacctactatgtgctgggcccgggggacaaaatgtgaaatggacacagaactccatgttcctgggggacacaggccacggaaccacgtgctggcaacaccgtgcgaagagagtgctgaaggggaaggaagggggccggcagagcccaggggagggtcccctcacttagggaggtggctgggaggctggggaagatttccagaagaaatgctaactcagctgggcctgagagatgacttcacctaagcaaagcagagaaggggaagagtgcggaccaggtggagggaagggcacacgctgaggccagggctggagagggcacggcacgttcgcggggtgggaggaagcctggtgcagcgggacacgcgtgtgagtggcagaggagtcaaagggcggcacgagtgggcttttccatttaaaagggccgcccctcagttgtgctgctgacccggtgctagtcacagaggccaagtctc

SEQ ID NO: 597 - DNA, 1796 bp, Homo sapiens
cacgcctggctaattttgtatttttagtagagatgaggttttaccatgttggtcaggctggtcttgaactcctgacctcaggtgattctgcccgccgcagcctcccaaagtgttgggattacaggcgtgagccactgcgcctggcctcttttactttcatttgactgaaaataattatctctgtacacagaatttaacatgtgactttttcttgatcctacatgatatgcaaatatcaataattatttagtaaatcatacaagtctagcaaaacattttttatactacattactggtaaaaattaaaatcaacaaaatccagcttagctccttcaatctattgtccaataaacaaatcgagtcattagaattatttaagtcaaaaccacaaaaaccttttactttctcttgagaatcaaggaagacttttctctcacaagaatcagattttgtttcatagcaaggtttagatttgataggctttttgtcctttaagtgctggtagaggtcaataatgttaatatgttaacatgttcttattcctaaggatgaaggaaatcagctaaactcatctcatcttgctatgaccatttcgccggatttctcagcctcagcactatggaatttcaggtaggggaactcattgttgtgattgtagggaactgtgtgttcactgcaggatgctcagcagtatatctggcctctgccaactagatacgagtagtactcatcccgtaagttgtggcaatcagcactgtctcgagacattgcccgtttccaaaattgagccattgacaacacattgaggaagctctgctcaacagacacagagacagctgcatgctcataattttggctgacacttgtgttcacaatgtgttaggcactgtgccaaagattttatgcacattattttatacacatccctaatttataaagaggaaaattgacgttcatagacagaaagtggttgagctgggtttccctgctttttctatactcaggtgaccaataacttccatgtgtccttggcattctcagctttggaagctggtcatgtgtttgtggtcacgtgtttgtaaatagatctctcttaccccatgcatgcaagtatgtatgcagggatagaactgggtataactctacccaaatgagtaaagatggacaatgaaggaaaggactttgaaattctcccatctctagtaagtagctgaaaatcacttatcactataggtttccaacactatacaagatgcctgtgaagacaatagacacagaagactcaaattgcctgaaagggtttagagcactgtaagaacctcccagtatctgatggcctcttgggttgttcctgctgtaatcaggaaactaactccagacctctgtccctgaaggtagacagagcttcggctccttctctcagagggcaaagcagagttcaagatcacactcagatcagccagagtgccctggtcttggcttgaagcccagggtataatcctagttcctggtagggctttgactgtgttgaccttcccagatcttggctgcttcttatttaactggagccaaggactcactcagaagttccagggctaaccgatcccttggcctgcctcacactgaccttgagctgcagcatttacccagcctttcctgagtgaactccagcagtgagctgctattaatcacaccctgttgtaacatcccctgcctccctcttccatttccttttctctggagacactagcgcctgtgctgtttcaggtaatggacacccagatgcctcttttaga

SEQ ID NO: 598 - DNA, 1493 bp, Homo sapiens
acattcctgcaactctgtgaccacagcaggggcgattacacattcctggcctggcagccaacagtgtaaaaaagaacagaatgtcctagggccccgcctagcccccagcttcacctgggcccctcccgggtctggacaaggttggagggggtggcgaggaatcagcaggaaagaggagggaccaggaggaggcagacgcatcccacctgagtgcgctgctcccacttagtgagcggggaggagacctgcagagacctcttctctcttctctgcagggcctgagggtgaggctgacctgtgggtgcccttggagggctgcccacttgctgagcctctagctcctggaagcacacttgggactccccccttgctctccttcctggagacagactccctttggtgctggctccttctatttgcccccaccactgccccccacctgcctctactcactcagtgcccctcctccatccctatctctctgtccttcgctgtccctctctattgtctccctctttctgccctcctgtcctcccggttccccacccaggccctctcagcctggctggccccttctccttgtgttgccctcctagctgtgggctcaggatccttctacttgttcagatctttgcccctcacctgccatcctgtcccccagcctccttgcctgtctgcgtctaaagcccctgcccagagtccgccttctcaggtccagtactcccagttcacctgccctcgggagccctccttccttcggaaaactcccggctctgactcctcctcagcccctccccccgccctgctcacctttaattgagatgctaatgagattcctgtcgcttccatccctggccggccagcgggcgggctccccagccaggccgctgcacctgtcaggtgagggggaggagaggtttggctgccagattcaactggaaaggaaccagtcccagtccagccgcaacctgggagtgggaagctggaggcagcccagacctcctggagccctgcagtcctggggcagagacagaatcaggacacagctcgaggtcagggccagaggctggagctgagggcctagagtgagagggggcaaggcaagggggggagaggaagagaggcaggattagagagaggaggcaggccagaaagaggagagcaggagagacccaaagagaaacagaaggcagatagagagggagtgagaggcaggagctgagacacagatcctggaggaagaagaccaaaggaagggggcagagacagaaagggaggtgctaggacaaaactcgaaaggtggccctatcagggaagcagaggagaggccgttctagggaagcccagctccggcacttttggccccaactcccgcaggtctgctggctccaggaaaggtggaggagggagggaggagtgggagaatgtgggcgcagggtgggacatgggcatggccaggggcagcctcactcgggttccaggggtgatgggag

SEQ ID NO: 599 - DNA, 1081 bp, Homo sapiens
ccaatcaccaagttattgaaaccatttttgcaaaattttaacaatgagaaaattctgacatctcaaatctggccaggcacagcggctcacgcctgtaatcccaacactctggaaggccgaggtaggtggattgcctgaggtcaggagttcgataccagcctggcaaacatggtgaaaccccatctctactaaaaatagaaaaattagccggccgtggtggtgggcacctgtaatcccagctacaagggaggctgaggcaggagaatcgcttgaacccaggaggcggaagttgcagttagctgagatcgcggcactgcactccagcctgggcaacagagtgagactccatctcaaaaaaaaaaaagtaaaaataagcccggtgccgcagctcacgcctgtaatcccagcactttgggaggccgaggcaggcggatcatttgaagtcaggagttcgagaccagcctcgccaacatggcgaaaccctgtctctactaaaaatacaaaaaaatgagccgggcgtggtggcacatgcctgtaatcccagttacttgggagggtgaggcaagagaatctcttgaacccaggacgcagaggctggagtgagctgagatcacaccactgcactccagtctggggtgacagagtgagacctctccaaataaataaataaaaataaataaaactaacaagcagcacgactccaaaatcagaaaacttgtaacgaccaaaaaagtgcaaacgtgccttaaatcagtcatgtgcgacaagcagctatagctagggtttggccgcaggctcagagaagcgcatgaatgagctaaagccacaaagcgcggggctggaggtttggctcccaagaagcgaggaaatgggttcggaactcttctgccaagtcccagtagatctacccggtaaacttccggtgagtttccaacttccgtgcggggcagcagcttcggctggtcctaagcggaccggaagttcgtcaagtttcacgctccgcccctcttccggacgtgacgcaagggcggggttgccggaagaagtggcgaagttacttttgagggtatttgagtagcgg

SEQ ID NO: 600 - DNA, 1037 bp, Homo sapiens
gtgtcctcactggctctagtcctgcaggcctggctctccagaggagcctgccagctcctcttctgccccctcacaggcctgaaggagaccctccagatggggatccaggcctctttcctccaggccagcctcagaccctacgggggacggttctgggaacgtcctctgtgccaggtgtctggggactgctagccttctgggggggctggatcctcaaatcgtgagccccaagcagtccctttccaagggattggagtgagaacctcgtggggcagagccagatctacctaggacccaaggggagtgtctcaggcaggacccccacaggcaaagacacacacactggccacacacttgccttcggatgtgtgccaagcagctcaaaaggatttaaagtccagccaggtggggtggctcacacctgtaatcccagcactttgggaggctgaggtgggcagatcacttgaggtcatgagttcgagaccagcctggccaacatggcaaaaccccatctctactacaaatacaaaaaaaattagccgagcgtggtggcaggtgcctgtaatcccacctgattgggaggctgaggcaggataatcgcttgaacccaggaggcagaggctgcagtgagccgagaccatgctactgcactccagcctgggtggcacagcgagactccgtatcaaaacaaagaaaaagatttaaagtccttgggagaggtggagtccacacctctcttcaagatgtggcatgaaatggtgaacagctgagcacacagggcaggagggccccgggggaccttgggcagcccgggaaccagcatggggtagcaggactgaccggctcccggggcaccttggtaatgctgcaggtgtggccagttgatcccctgtggagacagtaaagattaagaggatcataaactgcgtccagcggctgccccgggagaaatctcctcaagccagagcctgtgctgtgaggggcttcgggaccttggggcagctcctgagttcagacagagttcaggaagggagaca

SEQ ID NO: 601 - DNA, 1009 bp, Homo sapiens
gaccaacaagaaagcctgtgagtaggggataattttgatgtttaacaatgatttgggacaaacttaagatgagataaatttaggttgcatagcacagtagctactctaaagaacacagtgacccaaacattgaccaataataaaatctgattttcaaagaacaaaaacagaaaaaaaaaagaaaagaagttcctccacgagaggtacaatgaattgtcaattatcatcttggagtgaagagaaatggtcatccggccgggcgcggtggctcacacctgtaatcccagcagtttgggaggctgaggcgggtggatcacctgaggtcaagagttcaagaccagctggtcaacatggcaaaaccccgtctctactaaaaatacaaaaattagctgggcatggtagtgcgcacctgtaatcccagctacttgggagattgaggcaggagaatcacttgagcccaggaggcagaggcggcagtgagccaagatcacaccaccacactccagcctgggctacagagtgagactctgtctcaaaaaagaaaagaaaagaaaagaaaaggtcatccaacaatcttggcaatagaagtgattacctttgactcataaactcattcacaagtgcatacacacaaatacaaactcactcccatttttaacacacaaaagaagtaattatgtgttcaaatatccccacagtatttgaggctatcttgtagaataccacattccttgtggtaccacacattcgtgtggtatctttcttgataatcaattgcaaatgaaggagtaagagaaaaaaaaataaatgaagtctacacaatggcaatgagccagtgccaacaatcagctcatgtacaatcaaaaggattccatctggggcaggaaaagagactaggtaacccatgagatctttttcagtactggaatcctatgtgcctattccaaggagaagcctgaactgttgtttctttctcatacagatattttgagaaaactccagccttgtc

SEQ ID NO: 602 - DNA, 3481 bp, Homo sapiens
caccgtgcacttttgaagtctctacttgccagtggccaccccacctctccctgccctcatccaaggacggacaggcctggcaggtggaccggagctgtggggcagaagcatcccaggcctggcctcagaggagggaggccatggtgaaagtggaggctgtctgcatccacctccccagcctttgtcaccgggacctcagcctgaccccaggcccaccccaggctgctcaccgaggtgggtaccctgcccaccgccagctcagatgcggtgtgtggactcccttctctctgggggtgagcgggagttccctcccctccacatcaggagctgggggagagctggagggccctgggatccccttgaccctggtcatcagccccagccctgacaggccctgcgtgtgccatgtgtggcctgggtttggagctcagcaccctgcgggaattctattaaatctccgattttatctgaaaacttcacccacatgttgcattgctctgtgaggcgtctgtgtgtgtccaggcagcagtaacaacgctactaatgctggcggccatcacaggaagccagtccgaacgtcccccaagggcctgtttcaccctcatgacaccaggcgtggcagagacgaggagcagaggcctggacctctcagggtctcagcagggggaggccggcctgtcacgagtgtttgatgaccatggagaggaggtggtggaggtaagcgtggctgcttccaggggaagggcgggcagtgctgggggaggggttctgtattgattaagcacgtactgtgtgctaggtcctctgtgggcttcatttaatttattgccacagccacgggagggaggggtggttagcgctatatttcagatgaggaaacgaggctccggtgaagacacttgtctagtcctctggctgtggaaggtgggaaagggatgtcaacctgggctcgggagagataaggaagctgaggcctagagccttgtcaggcctggagctgctgtcctcccgctggggcagcaccgcctgccttcatttagagcagcagatcctacagcacccgggtcctcacctatcaaaggcagacaccattcctgaccacgtgatggcctggacgagaccagtgtctgggtgtctgggtgtctgggtgtctggatgggaactgggagggcccggccaggcccggcacatggtgactctgcctgccctttgcagctgagagctggcctctcctagacctcaatgtccactgacacccagtgcccctgcaaccttctcttcctgccccacgaaggtggcactctcctgggggccgctccagccctctgcctggggagcaagcggaggggcctgggaccccacctgtgttcctgtctctatccctcctcagctgtcaccagctttaattaccccggctccatccgccccggcccctgcgcagctggagagccccttgggcgggcgcagggcccctcgcctgggcacgcagcattcctgcattcctccccggggcccaccgacctgtcctgccggttgtgggcagcttccgggtgcggggagcccggcgtgtgtttgggggggtgcgcagctgctggatggggagcctggagagagcccggctgtgccccgggactcccagctgcgttgcccacatccctctgccaccccgcatcacgaccggagcctggcaagaagtcagtgattcatcactcgggccctgggggctgcctggaggggctggggtgcttctaacagcaggaaagggaaggcaagagagaaccttccacagttgggagcagcaaagcggcccaggaagccccccaacaggatgggaccatctaaggttccagccaccccaaccccccggagcagggcccccagcctagtggtatgtggataagccctgcctggggtgcaccttctcggggagaccctctgctctttgggctactgtcctggggagcctcccccttcctggggctgggtggaccagctgcggaatggcagctccccctggaggggctggggaagaagtggggcgtgctgtccaccagctcctccctaccccgaggcgccccagatgatctgcctccagctccaaacaggagtagtggccacctgtgagtttctctgaggcccaagtggtcactgccggagctgcctgtgtccctgtgtccggacaggctcctctccacctctgtgtttgggcagctctccccttgtgtctggaatttttagaaaacggaaaaagtgtagacaaaagcaggctttttatctcgctgaatgctccaacaccctccctagttacaccacggtagtggaagattcagaggaagtttcctcctggtggccgtgattaccatctgcagttcttgttcggggacattgcaaaggtcacattgtccgtccagccccgccccgccctgacgttgctcccggagtggggacgggctctgaaccaccccagctctcaggggccccgccctgggtaacacacgtctgcggtgttacccacgactgcctgggacctggccaagggctccacacaccaagaccaaggtgaggggaggtggtgggtggggaccagccctgcctctcttggagaccccgagggtatggcgccaggccagcctggagtcgggtgtggggcggttagtgtgagcattacgtcttcttttccctaaagtggctgaaaatgtccccggggccagtccctcagggcaccctgctggactcaatgcagcagaaagagttggggtgtttggccgggtgcggtggctcacgtctgtcatcccagcactttgggaggctgaggcgggcggatcacctgaggtcaggagttggagaccagcctggtcaacatggcgaaaccccatctctactaaaaatacaaacattagctgggtgtggtggcagatgccggtaatcccagctactccggaggctgaagcaggagaatcacttgaacccaggtggcggaggttgcagtgagctgagatctcaccattgcattccagcctgggtaacaaagtgcgactccgtctcaaaaaaaaaaaaaaaaaagagaaagggttggagtgtcccatcctcagggcaggggtcagagctgcatccctggggtgccctgagcttgggggtcatgataaccttcaccctgcatgcagcccaggcccacacctagaagtcttgtggccttgagcacactgcgttgcctctctgagcctcggtttctccatctataaaatggagagggtaacagtgagagattgctattggctggcttcgttcattgggccctaaatcaaacagtggcttaaataccagaggcttgctcaatgggtggtgggcaggcagccgggctggggcggcgccccccccatctccacggtgtccccacctctacagtgcctccccctctccatggtgcccccccaccacggcctccatccctggggtccaggtttcatttgttcctcagcaa

SEQ ID NO: 603 - DNA, 3468 bp, Homo sapiens
tttgcattccttctttggagaaatgctgtacatttcattgtttattccaggcaatgtcctcaaggaccaagcacagaggaggcgtggggcccctgcagtgccctcagggcagcctgacagagaagcagggcaaacgggaactgacacagcctttcgattaaatgtcaatctttgatttgacaatttggggtcattttctaaatccaacttaaatacagagcagctggaatgtgaagatgtcattcctggggttcctgcagatttctaagtataagacgaagggtgggcatccttatagaggagaattgttagtgtgcgggggatcgaggtgtgagggtggagagaggatcctttctgccagctcaccaccgcagatgggctgtcctggaaggacttggtctcagaccctgagttaaaacggccttcattatcatgatgtcattcattcatctagcacatttttatcaaggactactgtgtgtcccctgctgttctaggtatggataatgcagcttcaacaaaccactgagcttgtccaggcctaaaacacagaacttgccacggtctctcatcctccctcactctgcgttcctcacagcctccacatctgcgaagtgcagcttctatttccctgctcttcctccatctcctgctcaccctctcctctgcacactcttttctcctcgcattccatgtcttttcatcatttttgtcttcaaattctcttctttcttaggcagcctcaactgatattgatcatttcattatcacactccttattgccagagggtagaagttgtgagtctccacggtcaggcagggaaagatctttttagctcttccatgacagagctctcggctcaacatgtccaagactaggagaagagaggcaggtgccagtctcatcctgggcaattgtgtgaccctgggcaggcttctctcccctttctggattccattcttccttatttttaacaaagacaacttgggcattcatgtatttttaggattgatgaggtaatttaggtgaaatggcctgctctccccaggagggaagagtgctagtgggaattctcctgctgcccagagaggcttatacttctggccaggcatctggacactccttacatattgtttccaccagatttgcctggttctaggggcaagaactgtaaagggcctgagatgtcaccctacttgcaagccaaaatttagcctgccacagtttcatgggtgctttggaagacacgagagtcctgggtcagagacaaaggactctattcctcacagtgcagcaaggggcacaaatatcctgtttgtgctggctgcctttgccttctcagtcccacagaggcatgtggagcagcctgtgtatgccgcacgtgcaggcagtttgcattgctgctgcatatcccagagttaagggaaccctcatctttacagtggtctgcaagcagacctgtgcaaactttgctctggaggaaggcattatatttgttaaactggacagtaaacaaacctgcctcttgctctggagggagacgctatctgtatcttccaaggctgtttgctctacacacattcttgaagagatgatctggaatgaaagctgtcagtgtctgtgcacagcaattgtggagaatggtgtatcaacatcctgtcctcggctggacatggtggctcacgcttgtaatcccagtactttggagagccaagtggggagaatcacttgagcccaggagtttgacatcagcctgagcaacatagtgagatccccatctctataagaaaaaatttaaacaaacaaacaaaaatcaacatcttgtccttgcatctcctctgggagatctcagcactacctctgcctgcaagccccccgtgtgggtttcaccccctcctctgcagggaaacagccttggaagttgggatgctacttcccctccatcttagtgtcatagggctgctgaaacaaagtccccaaaactgggtgacttaaaacaacaggaatttattgtctcagttctggaggccagaagtctgaattccaaggtgtcatcaaggccatactccctcttaaacccatagggcaccgtgccctgcctcttcctagctcctggtggtttgccaataatctttggcatttcttggtgtgtagatgcattgttcccatctctgccttcatcttcatgaggctggcttctgcctgtgtctcctcccatcctcttcccttcatgcatgtttgtccctgtgtcctgatttctcctttttgtttttgtgttttggagacggagttttgctcttgttgcccaggctggagtgtagcagtgcgatctcagctcactgccacctctgcctcccaggttcaagcgattctcatgcctcagcctcctgagtagttgggattacaggtgcctgccatcatgcccagctaatttttgtatttttaatagagatggggtttcaccatgttggccaggcttgtcttgaactcctgacttcaggtgatccacccgctttggcttcccaaaatgttgggattacaggagtgagccactgcacccggctgttttccccctttttataagggcaacagccacgttggattagggcccaccctaatgactcattttaactagatgactctgtaaagactctccaggccatctccaaataagatgccattctgaggtactaagagttaagacctcaacgtgtctttctgggggatactattcaacccatagcacatcccctcatcccccatggaataaccgggtcagaggtggagcaggtaggactgaactagagaatgtgccccttggtgggtggccctttccctaattaaggcacctttctttgggctgagacttctctgcaaagaggggagggggaaaggatagttaaatttgtaagtttcatggcactccaagtcaggttctgtggctttctgctcttcctttttctggttttcagatgcagatgctgttgctgcacagatcctgtcactgctgccattgaagttttttccaatcatcgtcattgggatcattgcattgatattagcactggccattggtctgggcagtgagtacaattcattatttagtaggatctcaaatacctagccaagtagttaaactttcatgagcgccccctctcatcccagcattttgctgctgcccagccttaattactggaggcaaacatccttttggtttgctgacttgaagttttatttgcccacatgaatgtaaagtcagtctggggtgccgcaagggctgctggccatgctcatggctttgtcaccaaggaacctgcccggttaggagtggccaaaggcagctgatgaaatagaatcctgcaggtgggagggaggcactgaccggggcagcggggagaagacaaagagacctattcatgcaatgcaggcgcaccagctgtttttacaataaggtgcatgtggctttt

SEQ ID NO: 604 - DNA, 2966 bp, Homo sapiens
aatatcagtggcctagggaggacaggaaagtcggagtgacctttcctggatgcaggcaataacgggtggggggcctacagaatttaaagataaaataaaactgatgagaagtcagtctgcttttatgatcactgtgcaatggcagatctaaataatttcagtggtaaaatactttgtcctgaaaataccctttattgatctaagttctaacaattggtgcagtaactgttggggtttaataatgtatatgtaaagcttcaaatcagcacatttttattcttatcctttaataaacatattctacatggaagtcaacttgacttggagaactttaagaatcctatagttgcccccagagcatgtggtctcaggaacacacatcagttgagagtaagctcctcacaactctggaatcttccaagcttgctttgaatgcattcctgtctccaccgtccagcattcatatttctgcatttatttttattattattttgtgtgtgtgacagagtctctctctgtcgcccaggctggagtgcagcggcaagatgtcggttcactgccacctccacctcccgggttcaagcaattctcctgcctcagcctcctgagtacttgggactataggtgtgcacccaccacgtccggctaatttttgtatttttttttttagtagggacgggtttcaccatgttggccaggctggccttgaactcctgatctcaggtggttctcccactttggcctcccaaattacagacgtgagccaccggcccagctgtatttctgtgtttaaacagtagagtgaaatcaactatgaacgcagaatgatgggaaagatgacgataagggtatttcaattttgtcattttacgaaactacttggagttttgatttgtatttacagtttttaaaagagtaaaacagtgtgaactgtgaatggtaatgattttgtttggtaagtgcaaattttaattcatacatgaaaaatatttgttttgtttcatgattattactgaaaataattttgtactatgaaggaagaggggtgttaaaaatgatccactgtggatgtaaattattctaggcatgcttctgactaaaacattagcatttccacaagaatcccaaaaaataaaacaaaatttaaaagatcccttctgtttcttttcctccaagtttccagacccccatctccaccctggccacctcttcctgccataaataatcaaatcccacactttcatcttcaccttccgtttccattgcctcttccgatgggacagcacccgtggggaatctcctccatgctcacaatccccgtcttgccactatatcaagtcacacttcttcctcaccaatcgcccattctggaacctctgctatccagctagatcactttgaggtttggacaactactggtggaggtaatgggggccccagacagcccttgacatcacctcttttatctttgccaaattctacaaacaaagcccatgtctttctgtcccccgcccccatggctggcacatagtagatgtccccaaatcttggtgatgtgaacttgtgtgtctcacccttcacagacatcaccatttcccgttgcacagaaggctccactcataccaggcgctttggctcccagaataagcaggctatcatgctatgtccgacatctaggcgttggtacgtactgttcccttggcctggaacattctgccctctctcaccctctcttttcttggctttctgaaatggcacctccatcagaaagtgtccctcactcttggtctgagcaagggaccttgcctggtattcctgaacttccacctgttttccctctgttttctccctctctgggccttgtcctcaggtcagtgttgtgcctccagctcctgcagaggcgaactcagaggcggccgaatgaaaccaaatggatttggcttgaccccatcatctagcggtgcccagcaagcgctggcacatagtaggtccagcctgcccggactcgcccaccacgggcccccttccagagccgggaggcaggccaagggaggccccttattgccaagagcaaacaggccgcccagggaagttttgctctgggtcacacccacctctgggtggctgccaatctgcctgccagaaaccgcaggctgggccgcggctacccagagtcagggccacggagcttaggagaccttgggtcagctctgcaaaggggttgtttactgaatgcttctggtatctgcagccccgctggggttcggacagggggtctggaatagggcttcacaactacagcagggctaggaccctcttgggctggaaggagctggagaggcctctgcaagctgtcacaggctcttggtgctggcactggctcaggctttcacacacacacacgcgcacacacacacacacacacacacggacaggcacccccttggtggccttcacagtttcaccttcaggtaaatgggctcatcctttgagccatgaggatgggaagcgaagcaaggaatgaaaaagctagtgtgtttgtgtgtgtgtgtgtgtgtgtgtgtgtgtgtgagcgcgcgcgcgcgcgcgcgtgtgtactcgtgcgtgtgcctgtgtgtgcctgggagtgacctcacagctgccggaacataaagactcacaggtccgcctcccaggctcaaagctggctctgcaggggacatgagaggcacaccgaagacccacctcctggccttctccctcctctgcctcctctcaaaggtaaggaggcccgggccctggaatgcactgctgactatttgggtgtggagggggtggggatgtaaaatcgcagccaaggacccccttggcagaattcctccagggccccacattgggcacagtctggcccccatgcctaagcagggcttctctccctggaactcagagctgcctccggccagccctgctgtgtgacctcagatatg

SEQ ID NO: 605 - DNA, 2793 bp, Homo sapiens
cccttgagcctcagtgttcttatctctaaaatggggcaaagtcaccctgccttacacttgagacagtggctcagccccagtcttgagatgcagaggcactgggtaggtgttccctccccttatccacagtgtctgggctgggtgctggcatgggggcgcacacaaggaggggacagtaagagcagcttcacaagaagctgaagcctatctcctttggtgctcctgtccagataacatggagcccatgggcccctcgatgccaggacagtccatcagagtctgggagatgaggctcctcttgtcccaggaatctgctcctacctgggctgaacattcctgtagctatttctcagggtttgtgggccccatgcccatggccctgggtgtgcctagcttagtgccacagtaaacactcactccatccaccatggcccagaggggagatgaagcccagtaggacctgacctgtggccatctgccccccaggagtggcctgcagtgccatcctcatgtacatattctgcactgattgctggctcatcgctgtgctctacttcacttggctggtgtttgactggaacacacccaagaaaggtaagtgcaaggcctcccttgccccacctctcattctagggatgctcttccccctgcacaagctgaagggcctcatcctgagtgctgtttcttttaacacccactttgtgaaaagcactggactagtccttttggggggaggttaaaagcccctcaaagggcactgttctggtcctgacaagagttcacactcagtcgagggtttgcataacatgaaggaatgaatgtggaaaggggcctgatgggaagggggcatggtgcatggggtgatggtcacctgcttgggtttcacactggccctgtcttgtctgccttgcccaaatgtacccccacccccaccaactctgtattttattccctggaaggtggcaggaggtcacagtgggtccgaaactgggctgtgtggcgctactttcgagactactttcccatccaggtaaagtgctgtgagtgttgttttgggagggtgggaatggatgggaaatctgaactcaggccttaacccacccacagggaagcaagtttagaccaagttggtctcttcatttcctttctactgtgtcactggctgtgctggggaccccactgctcttctgagtatccatcttctttgggccagccctgaggtcctgacagggaaatggtggctcagtttggctttcagtctcagctctgtctggcccctgcctggtctgcaagctgggctggtgaggcacagccatctggccctgatgcatgtgggcaatcctggtgaattgaggataactctggcaggatcctgaaggttttccccacaggggaaagacctgtctggccagctcactccacaccccagctccagcacaccctagctgctgagtaccctgcagaaggtaggggtgctgaagagtggaggcagcacgtgaatgtgaaagagttctgtgcagggtgcagggtggtgtatatttgctgttgtgagtcagtgactgagatcctggtgtgttgcctgggggcagtggctgggtaaccctgcatccttcactgcattcggtattttgggggtggcagggccagctccttctgctcatccttagcctaagcccagtcttcccgggaccttcctgctcctcagggtcagcgttccttctccttttcctgaccccatctctctaactgcagaaaatttgaagctgtttttgttgggagaaagttgcatcataggacccaaccctctaattttggaggtaaagaaactgagcctcagagatgggcaggacttgtccaggctgcatagtctagtatgatggcaacattgcaaccaccatccaggcttattgaattcagggcccaggttcttttccactgatttcctactgcctgtttctctgggagagattcaatccctggatttccccattggattgattccagcttcctgggtctccctctcccccgttgctgctggagatctcagtttaagttcctgccctgtcactccatttattaacctgccaccattgctccctgtccagtgcagggctgtgctgggcatggggacacaagtcagccctgcccttggggtgtctattgcatcctgatagactttgtcactttctgccatggggccatgggcagactttctcaagcctgctgagcctcatctgcaaaatggagctgtctgtatgatgaaaagtaatcagttctgattgggtgggagtgatgatagactgttctttctgctttctctctcacctcaggggccaggctccagtgttctctgttgccactgtggcctggtcctctggaagtctccaggaggccagtagccccatccacttagaacaggatgacctgatgattgttggtcagacctgggacaggcaggtgtcctttgctatctgatctccacccttccaaaagaaccaaacaaacccctgtgtccttctcacatctctgttccaagaagtcagctgggagttggagccttagggcacatacaacctggccctgtgagggctccctggggcactaggacaaaagccaaactgggcccgaggcaggctggggtgttgagcctcaacccggggcttaggctgatcaacccggggcttaggctgagcctgcctctctccctctgggcctcaatctccccttcacttggccttggtgatctgacatcaggtctgacactctatgggggtgtgtgtgaccctcctgtcc

SEQ ID NO: 606 - DNA, 2767 bp, Homo sapiens
actgcattctagcttgggtgactgagagagatcttgtctctaaaaaaaaggagggagccagggccggtcatggagaccatcctggccaacatggtgaaaccctgtctccactgaaaatacaagaaagaaagtaaaaaaaaaaaaaaacccaaactagctgggcgtggtggcaggcgcctataatcccagctactcgggagggtgaggcaggagaatcgcttgaacccaggaggtggaggttgcagtgaaccgagatgaaggcactgcattccagcctgggggataagagtgaaacccatctcaaaaaaaaaaaaaaaaaaaggagccaggagcggtggctcacacctataatcccagcagcactttgggaggctggggcaggcggatcacttgagaccaggagttctagaccagcctggccaacatggtgaaaccctgtctctactaaaaatacagtaattatctgggtgtggtcccagctactcgggaggctgaggtgggagattagcttgaacctgggaggcagaggttgcagtgagccgagattacgctgctgcattccagcctgggcgacagagtgagactctgtctcaaaaaaaaaaaaaaaaaaaaaaacggaaaaaaaattgaatactgttttggggtcatggttaaagctgaagtttaccaacccctgatgggtcataagtgtcatgatttgtgtttacagagtatcagaactttgtttaaagttaccagctgataaaatatgaggacaggtttatggctaacagggtttcatcattgacagatagcaagtatcaggattagtcttttttcacaaagtatcagaacacagcaagctctgatggctaatcaggtgtcagaacctgggtttaagtccaaccctgccttggggcccacggcaccgcggtaaccaccaactactgtccactctcaggatactgtttactaagtatcgagtgacaggctgatggcaaagtatcgggtcatggatgtcacactgtgagttgggcactgtgacagcgtctctagatgccagctgtttacagtgacaggagactggctgtttacaggggatgagtcagccccacttccagatacccaagtccagatggcgggtaggattggcacctctccaggtgtttacagggtactgaggtcctggcaagctgggcttctctcctgcggccacctctagccagggtggggaatgagtcccctgaaggctgtgggacccatgatcctggttagattctccttctgcttgtccctggctgtgctgcctcaggcacattacttaacctttctgggcctctgccacctcatctgtaaaatgggcatgatggtgaagccaggttgccagataaaatataggctactcagctaaatgtgaagttcagatcaatattgaatttggttttactgtaagtatatcccatgcaacatttgggatatacttatactaaaaaaaaattattcattgatgctatggtttgaatggtcccccaaagttcatatgtttgaaacttaatcctcaaagcagtcctttcaaccttgtcaacctgtcggcgcggcctctggtgcagtggcggcggctcctgttcctgccgcagctctctccccttcttacctccccaccagatcccggagatcgcccgccatggctttacttactgcggccgcccggctcttgggaaccaagaatgcatcttgtcttgttcttgcagcccagcatgccagtgcttcctccatgaatttgaaagacatattggctgacctcatacctaaggagcaggccagaattaagaccttcaggcagcaacatggcaagaaggtggtgggccaaatcactgtggacatgatgtatggtggcatgagaggcatgaagggattggtctatgaaacatcagttcttgatcctgatgagggcatccgtttctgaggctttagtatccctgaatgccagaaactgctacccaaggctaagggtggggaagaacccctgcctgagggcttattttggctgctggtaactggatgtatcccaacagaggaacaggtatcttggctctcaaaagagtgggcaaagagggcagctctgccttcccatgtggtcaccatgctggacaactttcccaccaatctacaccccatgtctcagctcagtgcagctgttacagccctcaacagtgaaagtaactttgcccaagcatatgcacggggtatcagccgaacccaagtactgggagttgatttatgaagactctgtggatctaatcacaaagctaccttgtgtcgcagcaaagatctaccgaaatctctatggagaaggcagtggtattggggccattgactctaacctggactggtctcacagtttcaccaacatgttaggctatactgatcatcagttccctgagctcatgcacctgtacctcactatccacagtgaccatgagggcggcaatgtaagtgcccataccagccacttggtgggcagtggcctttcagacccttacctgtcctttgcagcagccatgaacgggctggcagggcctctccatggactggcaaatcaggaagtgcttgtctggctaacacagctgcagaaggaagttggcaaagatgtgtcagatgagaagttatgagactacatctggaacacactcaactcaggacgggctgttccaggctatggccatgcagtactaaggaagactgatccacgatatacctgtcagcgagagtttgctctgaaacacct

SEQ ID NO: 607 - DNA, 2743 bp, Homo sapiens
tgtcatagtgctgatgggagtgtcttttagcatgctaatgcattataattaacgtaaaatgagcagtgagtttgaccataggtcacttccatcaacatcttgcatttggttggtgttggccagcttctttaccacttcctgttttatcagcagggtctttttgactggtttcttgtgataccagtcctgctgacctcccccctcatcctgtgactgagaatgcctaacctcctgggaatgcagcccagtaggtctcagcctcattttacccagccgctattcaagatggagtcactatggttcaaatgcctctgacagaatcaccttctaaaagtcctatgtccaaatgcagtcacttagtgggtacgaatttggcgggggacacaactgagtccatagcaaacagtattcgatttttaatcacatcagcacacacaataagactctgaaaagtgagtcccttggctgggctagggagaaaattgtgacaatatgtagtgttccaaaatgaccctcctccctgcatcagggaggggagcactcagaaccttccagcttggtgaacagaatttgttctcaggccaggagccatgctctgtaagtatgttgtctttacatctggcccagtttgatctttggagatagacacatagtgggtcccagattgtgtcctgttgcaaagatctggaaacacaggcttgggatacctgtatatcaacagaaaccagactagcaggtggtaaggctggcattgttctgtgttcttaggttttttttttgtttttttttttgagacggagtcttgcgctgttgcccaagctggagtcgtgtggcgcgatctcggctcactgcaagctccgcctcccgggttcacgccattctcctgcctcagcctcctgagtagctgggactacaggtgcccgccaccacgcctggctaatttttttttttttttttttttttgtatttttagtagagacgtggtttcaccgtgttagccaggatggtctcgatctcctgacctcatgatctacccgcctcggcctcccaaagtgctgggattacaggcgtgagccatggcgcctcttaggttcttaatcactgggacacccacaggcaaggcctggctttttccacaagaagtattctggatggaagtaaacacatcagtgacctgaaagttctacatgattacaatgacttaagcttgagaatttttttaaaaacagagaagggagtagtaaatgactaaatataaagcacctagtgctgtgtttcgcaaatggcaatcactcggcaggtgtctcagctcctcgctgcagcaaccaggcttccaggactggaaggaagtcttctacattcaaaactagactcaaactactcccctccaccacccagttctactcctgcgctcgcgatcctcctgcctggcaaactccatggcccgacagattcactaccactccactgccggaccaggcacgtccgtgggccatccacgcctggaaaacggctggctgggccggaggggcgaggcccgcaggcgaggggggcgggtacaagccacttcttgggagccgcggtacgcgcagccttgtgggagttgtagtttccgcagctctgagtctccaggcgaggtgtcaccacaggactcgttttcccgtgctcctgtgcgcgggtccacttgggacgggtccctgagtaggtgaggaggtgggtaggagcttgcttatagaaaagtggaatcgagtagtccttgctggtggagccgctgccgccagggaactcagggccggctcctgttccttcaagagtgctggaggccaaacttgaaatacaagtttaatgttcctcgtcgggcaaaagataaggatccgatctcccccggcccggtgtgcagcaggagcgaccaaccccgacccgggttaaaactcccagggactcttcgctgctgccacctcttgttctctcccccgttcccactcggggtctccctcagggccgggaggcacagcggtccctgcttgctgaagggctggatgtacgcatccgcaggttcccgcggacttgggggcgcccgctgagccccggcgcccgcagaagacttgtgtttgcctcctgcagcctcaacccggagggcagcgagggcctaccaccatgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcaggtgagaggtcggcccgggctggggctggtggggcgaggaccgtgtgccaggccaggagtctcgccctgacacacatcttcagagctttactcgcgcggagcggggctcgggttgggtccagaagaagggaaaacagcagtagccagtgactccccaggctcttgagcaaaggacctgctggggttaggacagccccggaacttccagttttgccctgatggcgcagccatcagtaagcgctgcttaagacgcatgggagtcgcctggggatcctgctacgttgcagattctgattcagcaggtgtggagtagtgccccaggtcagcatttctattaagggtctaggtgaacttgaatacaagggtgc

SEQ ID NO: 608 - DNA, 2718 bp, Homo sapiens
gttcttgtttatggaccacaggcaccccttgaacctcccctcctgttgcttctctcatatagacttcccggtttccctcgtcaactgcagctcacatttaactgttaactgtgggcttcgggccagtcaatagctgacctgtaggcactcctggccatccccatagggcagtgccctgccagcctgactttggtcttgaaacacaggccaagcatcctcttcacttttcgaggccttaggcccagctaagccagacagagtgggatgatcctttatcaagggaaatccagtgatctcacagtgaagcccacaccaaaggccatcattttaaatattttccttcttccaaagtttatttggaaaaagcactctgaggaaaagctcatttccttaaaatatcaaggaaccaaaaaccaaaagatgatatatttttctggagacacactgcaaagtgtataaataaaattctgtaaagtgcacaaataaatattacaaagaattcatttctgctacagttgtctaccatcttcaatattacatttagctaacttaattttccatggatcaaattattcaaagttaaatttctcttaataggtcatctgagtaaacaatttcaagtgttacttgccaaaagaaaaaaaaaaaaatgtttccaggcttcagatgaagtcggcagtgtcaggctaagaaaacaaccttaaaaattcacagagagctggaacaattgcaaagaaaagttggagcccggaggtcagtcagtcttgttcatgcagttctgaaggtagaaaaaaaaaaaaaaatcacaaatttctaccaaaactaggtcttcaaggggcaaaggaaaaatgcctttttttttttttttttttttttttgagacagggtctcattctgtcacccaggctggagtgcagtggagtgatctcagctcactgcaacctccatctcccaggctcagttgatccttccacctcagccccccaagtagctgggaccacagactcacaccaccacgactggctaacttttgtacattttatagagatggggtttcaccatgttgcccaggctggtcccgaactcctggcctcaagtaatccacccgccttgggctcccaaagtgctgggattataggcgtgagtcaccgcgcccagtgccatttttttgaaagcagaaaatgtataaagtaatatatccttaaagtagcagctgtcatcagaagacagcaccctgggctttctctggcaccaaaactgggcactctgtgctcctggttttcagacagagagaaagggagaaggcagggcagagggaaggggaggaggggagagggagtagaggaaggcttgaggtatggcatggaattctgcaaacacagcagttattaagggaaatgggagagtgtcaaggggaagaagttttcttgaatttctattcttgaaatttcttggaataaatggatgtgtgcaagggaagggataaatgtagttgaagatctattttgtaggtgaggaaatggtaatctgagaggcaaaccagaatcatgccccaacagggaatataaccagaatagaggtaactctgtctccagtctctgaatctacaggcttcctctaatagcatctaaagccagggcttctgacagcacagtctgagaagccccatgacatcacaagtggcagctgggtgtactttatgacaaatgccaaattaactcctgcctgtgaccttgccaccataactcagacagccaggacacacactgcaccccaaacactcaagtccctgtgtaaatcttcactcctccaagcacagagggaagcctgctccgtaggctctgttaagtgtactgctgccgctgacatcatcataaataggaagggagagagtccaggaaccacagggctcacttcctagcctctctatttaagattttcgagggcagatggcactatatttaaccagcacaagtagtattcattgtgcccagggcctcttaaggaaaactgaacaaagttttagaatgaacctgccctcacctcactcctgctcaaccatttcacccaacaacaagttagaggcagagaagatgaatattattaaaatgatgcttctaaatcaggaccttatgggtgctttggctctcaacttttttcataaaatatctgtccagtccagaccgaggagccagcttcgacagcattctggtaagggcatggaggtaaccagggctcacatgtgtctgtggcaatgttctgatcctgttgttagaaatagtcaatgcagcagagatgatggcattcattgccaagcctgaggtcttcagggcttgcctacatgggaagatggtactgaagcctcctgtctagatgacggtctgtttagacctgagctacctgcggtgtggcctgctgacagactcgctctgcagggagtagctggagaatgttgctctaggaatcttgcactgtgccccacccgtaatgatgccccaggacagagggtgggaaattcacgaatacactcctactacagtgccatcaaacccagggcactaagctgtccacactttattagtaattctcacagcaatcatgaaagatcagaatgatgatgtcaacttctagagaagcacacagagactctgagaacctggctatttggccaaagtccacagcttcaggtcagtgtgactctaagacccggggtagaga

SEQ ID NO: 609 - DNA, 2638 bp, Homo sapiens
ctgaacaggcaggaagacaagatgcccttgacggtctagattctgtaaggtcaggaattccttaaaaggttagaatttcccaaatctcaccatgtcctcatggtctgggtgacttagagggtcacagagtgattgtgagcccaagatgttgtgctgagtgtaaggtacagaggtcagagcctcttggagggtctgtgtgtcctggagagtgaatgcatcctcagtgccctcagcattcaaggacctgacagggccagaatgggtaccccaggcagcaggatgcattgtaattcagtgttctcttgtgagtccaagctgactgcatgtcactgggtcttgctaggttaggactgccatggggttcagggtgctccaggaggtcaaagtgtgtcctagggtaggggagaagggttaaaattagagcagtgtttcccaattttacgttgctatggactaaacgtttgtgtccctccaaaatttctacgttgaagtcctaacacccaacgtgatggtatttgaaggtggggatttggggaggtgattaggtttagatgagctcatgagggtgaggccccatgatgggattagtgtccttacaagcagaggaaaagaaaccagagctggttctttctccaccatatgaaggcaccgagagaaggcagccacctgcaagccaggaagagagccctcacaggggagccaaataggcggaccccttgatcttagacttcccagcctccagaactgtgagcaatagaagtctattgtttaaaccacacagtctatgctattttgtcatggcagccccagctgactaagacccacgtgcactcggttctcctggagatcttgatacaaggcagattgtgactcagtagaatggaggtggggcccagggatctgcatttccaacatgctcccattgctggtgctgctgctgctgctgatccatggaccacacggtaagcatcgaaatcctaaaggattctgatttcctgtcttgaatcaccagcgtgtttttaaaggacctgtatgacggcatgaccctgggaatcagactgtcctgtgggtacagtgtgttccagggggtccatgtgttctcactgggtcagtgtatcctgagaagcagaggtgaagtgttctgggtgtcagcgtgtcccaggggatcctaaggtcctgggctgttgcatcatccttaaactgtcagagtgtcctggggatgtcagaatgtacttcccaggtctaagtaacctcaaggggcagagtactgtgggaccaggctgtcctgactgctcagagattcccggtgtcaggattttcttgaagaatcagaatgtagtatgtcacgggaatctcagtctctttccaagtcctggagtctggagtgggtttgggggtcaggatgcagctggaatgcagatgttcaggtcagggttttcggagagtctgggtgaccttggaaggtcatggtgtcctgggggttctgggtgaatgaggaagtggtgtttgagggaggaaatcagaaagtacttgagagctaaggtgtcctggaggcccattctccggagtgggttcaggttggcctgagcactggctggtgtgttctgaactatcagggtatctgagaggggccagcatgcacttgtgacttctccttttttagtttcctggaagcagatccttgagtgtcacccccatgctgagacgccaggcaggctccactcctgggtccctttcccctgctcttcgttcctctccccacagtggggttgtgaggagggggtctcgggaggaatgcattttctcctcctccccctgcctgctcccaggaggggatttaacaggacaaaagaatccggtcctctgggaatacgagcccttggccccagtccctggaccctccgacagaacaccttccctcatccggcttgtgatcctccctgagcaagggggctctggtgaccgtgtagtgattggatgggcccacaggggcgaggaggaggtcactcctccaagactcaggggtgggatgggaaagtaggcagctgacagaagggagcagcatcccggtggggagaagggccaggcagagaaaagtagtcagaaacagagcaacaggtgaggctgaggcaggagattgagctgacactcaagccaaggaagggggaattaggaaacaattagaaaaaaagtaaagacagtgaaaaagtcagagacagctgcctgcacctacacacacattcagagacagagtcccagagggtggcatacacagagggagaaggggagggaacaggtgtggagaggagctgcggaagcagagaaatctcaagtcagagattcagggacacttggtccccgtggcgagccatggaagcagaaaggaggcgccaggctgagaagccaaagaaggggcgagtcggcagcaacctgttgcctgagagacacccggccactgggaccccgaccaccacggtgggtgagtgaccgtcccggtgtgcgtgggtccctgaggaggcagcgggtgtgaggctgaaagcataggctccatgaagaaggttaggaggagaaattaaaacccgaatcctatcatgttaaaactgtgggaacctttgaaagtaaaagggactggagcacc

SEQ ID NO: 610 - DNA, 2637 bp, Homo sapiens
agcagacttcacctcactgctttattttttaattgtcagcccagccctgtcaggtcaccttggccaaaagctgtggtctggtgacctcttaagaggatgaattgctggtctcagctgaatgcttatcacgtagaaacacaaggcaccagatgttggctcattctacagatctctcgaagaaagaatgagcactgggactctgtctctgtggctgccttctagaaaagacaatccactggaggcagatttgttagcaggagctgtgcccagatggctggaaatcacattgcctctaagaccaagacccacggtcctggggcactacagtgacacaatcccatcagaggtggcaccaatgaagcaatacatttcctgaatcaaatgcaattgattagctaaacttgagcaacctgagaatggtgtagacaaagctgccagtgccctgcccatgtctcctggggaccagctcacacctgctggcttcctttctgccactgctgccttccactctggccaccgtcaactctgcacaggatacttgtccctaggagtagctggcagcccaagattgatgggagttggtggctaaatccccagcttcctcacaacttaggtaagacaacgcaagggtgcactctacaatgtctctcagtactagtagactagttactagtagtgggatgagtccaactgtccacaagagtgacctgctcatgacacaccctgatggactgccttcccttcccttcctcacctccccactcccctactagtacctcctggttcacttcccaaataaagtacaggccctcacagcttggtttcagagtctgcatccaaagacaatagatgccaattattcaacacctaccatgtgctttcctctgtggaaaggtcataaagggggtgggtcagggtcagttcagagaaagaatgagccaagctaagagtgacaaagggggctgggatttcttctgagacagagtcttactctgttgcccaggctggagtgcagtggcatgatcttcggctcactgcaacctccacctcccgggttcaagcaattcgcatgcctcagcatcctgagtagctggaactacgggcatgcatcaccatgcccagctaatttttgtatttttagtagagacggggtttcaccatgttggccaggctggtctcaaactcctgacctcaagtgatccgcctgcctcggcctctcaaagtgctgggattacaggtgtgggctaggatttcagatgaaggattgttcatcttcagctggccttccatccttcttgggttttgacatgcaatgcatatgtcaaccttataaacatttactgcaagtgttttacaagacccagaattatgggtttgctgaagaagcccagagaaaatggagcagacctttaaaatgaagtttctggactggccttttccatgaataataataaaagacagcatttatgaggctcttactttttgtcagatactgtgaccaagggcatgatcttattcagttgccaaaacaatgctatgtggcaggtcctactatgtttcattttgtggttgaaaaaactgagtctcagagagattaagtcatttgtccaaagatgtccagacaggtagatggtgcagccaggaatcccatggtcaccggtgtgccaggcccggagtgtgattaagatgtatagatcaaagcctccctcttcctctatcccactggactaccagatccagggaatggcgcatttctctgattggttctgtttttaacaaggtgctgatgctcattgtggaacactgcaaaataccccctcctttcttgacctttctgtctctgcaacagcctcatgtgttcatcataggcacatcaggtggaagggaatgaaagccactgtgacaaacaagacaaagaaagcccagcattgccagtggcctgggacctgaaaacaagtcattgtgtgttaattcttcatggaagaaaactaaaggtcgtgtgtgtcagtgtgaatgctggctgtgaaattaatgctttggccaaatgactcagtcgagacagaaacatgattttgttcgcgctggtgtgagccaacatctcaaaaaaaaaaaaaaaaaaaatgctgcttggaatcagtggaatcttcgaaggccaggcctttcagtttccactgctcctaaccaagctacttcggtctctctgattgctgccctgcaaagaccagacagaactcacttttctccatctttccacaggtgtaagagctaccagagggaggaaagtggaagctaccagacggaggaagcataaaccaggtcctgatccctgattaattgagaatcagccagcttgggaaggggatggctgcgcaagcccacagaacgcagactcccagaggaggcaggggtaggaaagctcttggccgtggcctgattgtctgggagacgggagtcaagatggcttggtttcaacaaactggctttgattacttggcgtttggctctgtgctctctggccaggtcagcctgacccacggttgtcaccccagaggactgtgaaataacaagtgcagttaactggccactgctgatctgcgcctagaagacaacgtctcagttgttaaggcttttgttggc

SEQ ID NO: 611 - DNA, 2626 bp, Homo sapiens
cattattcaaaaacaaggccgagcacagcggctcacacctgtaatcccagcactttgggaggccgaggtggacagatcacttgagcccaggagtttgagaccagcctgggcaacatggtgaaacctcatttctacaaaaattcaaaaattagctgggcatggtggcacacatttgtagtcccagctactccagatgctgaggtggaaggatcaccagagcccaggaaggttgaggcttcagtgagctgtgattgcaccactgcactccagcctgggtgacagagtgagaccgtgtctcaaaaaaaaaaaaaccaaaaaacaaaaaacaacccagcatgattatgtccacagataattcaaaagaagctacaggtgaatcattagaattagtaaatgaatttagcaagagctcagaatacaagtcaacgtaaaaattcctggtattttaatataccatcaacaaataattagaaaagaaatagtattgatgaagttttaccttaaaaaaaaaaaggcagcaagatggaacaagtaggaaagaaataaagacacattacccaaaagtcttgtcacatcacctgggaataaacactattaatgttatgggatactttctttcagacattttcctgagtgttatgcacacatgcatgcgtgtgcacacacacataaattaaaatatttgtctttgttgttaagttgagaaatgtcatagaaaataggaagggttgataactggaattattaggaaaccaggttatctagtgacagtgtccagaagaaagggacactgctgctgtggaaaagcagaaagcatctttggagaccccaggatgtagaaaatggcctccaaatcaataactcaatagcttttacttttaggctgtatgttgccttattagagaaggatttggctcactgaaaaagataaagttctgccctgcattggcctttaagagagaatctggttcctctaatagaatcataatggggcctgctctcctggaggctggttgccctggaaggcctttcgtttctaaaagctgttccaagaacctgtcaaggcaattaattaaaagttaatagagcattttcttcgagtcccaggacttgctcagctctcttattggcacagctcttcttggcaaatgacatttgagctataaaagttcaccttgcccttgagctccttgtgaccaatgtgtgtttttatttgtcttcctgccagtgcaggtatcctaagctcttatatttcagatggaaatttagctttctgcttcttcagatgctaaatctagaggatatagtcctcatttactgttcagatccacacaccactttcaagcaaagatttgtcatcccagatgttattctacacctacagtttacaaatatctgttgagttcccctactttgtgtcagatgccatacttggcactggagctactacagtgaataaggtacaagcccggcctttgaggaatgcatgttccttgaaggcacacatgtaaacaggtcttcctggtactgcatggtaggtatacacagggtgtgggagcagtgactaggggatcctaatagccctggggaattagagaatgttgttgagaaatgtttaagtggaatcttcaagactcagaatttcatgacttattgacagtactataatccctgtgtaattaggattatgtctttatgttctcattggataattaatagaacataggtttgaaaacattctggcatttaataagtaaataattactgcctgacttgtttttttttttttttttttttttttagaggcagggtcgctctgttgcccaggctggagtgcagtggcatgatcatagctcactgtaatctcgaactcctgggcttaagtgatcctcctgcctcagcctcctggttagctaggtgcatgccaccatgcctggctaatttttaaattgtttttgtggagatagggtcttgctgtgttgtccaggctgatctcaaactcctggttcaagggatcctcctgccttggcctcccagagtgctgggattacaggtgtgagccactgtgcctggccctaacttggtttttaaagaagtaactttcaagatctatatgtattaaattctttttccatgcctaggacaggtctttgaaagttcacagtctagctgagaacaggtttatctacctaaaatagagaatagcaggaaacagtcaatgaccagatacaacagatatacttctgtcactaacatcacacatcttttcattccctcaggggaaacactatcccagcctcaacaaggagcttgatttgggcacagaaacaggagaaagagacctgccttgcctcccttatccaaccggaagtattcttcttcttctgtcttcaatttattgcatgatcacatttattgcatgggtggcttcaggaaggattttagggattcctggaaataatcagtcttgaaatactcccctcttcttccttcatctaggatgcttcctcttctctcaatatattctcacttatgggtataaaggtaagttgagtcctcctttgatattaactctgccttcagttacccttaactttcctttagtcagctttcaacctagcctgaa

SEQ ID NO: 612 - DNA, 2559 bp, Homo sapiens
cccaagtagctgggattataggcacctgccaccatgaccagctaatttttgtatttttagtagggacagggtttcgccctgttggccgggctggtcttgatctcctgacctgaagtgatccacccgtctcggcctcccaaagtgctgggattaccgcatgaaccaccgcacctcgcctaattcttgttttaaaatacccactgttaacattttagtgtatttcctcccagtcttttttctatgcatttaagaaaattacaattagattaggtgttaaagatgtgaatgataccgctttctctctttatatatacttttctctgctttctactattgtttcgtactttctgtcatttgaatatgccatattaaatatgttgaaattatctttgctaaggagtcaacattagcaagaataaagtgggaaatgttcatttattcctgaagagtttagcaaagatcatatattcgagtcattaattcttgcttcttaactgcttgaaaatcaacccgcgtataggagcccttcatcagtcaacactctcatggcacttatttctggtaggggccgggaaacagatgggaaagacaacttcctaggagctctggtcttggagcgagggaggttcatgaaaattatacctatgttcaattgtggccaataaaataaagaaaatcaagtgtgaatggtttccttgatcagggcttgcttctgaagggcagagctgataacgtcctcactttgagcaaaagccacaaagtagttatctttccttacgcctttagtttttgtttaaaggttcattacgaactttagcagtgaaaaaaagtgtggcaactgggtcattctgacctagaagcaaccaaaatacttctgattgccgcagcagacaatgatgaatcatacctaaacaagtttgctgccttttcatttctgtgggtcgtaatcagactcattgttttgtagccagtgagacatttgcagcagcatgtttgggtctgtgggaggagggaggcttgcagatcttcccagcgatgtgtgtgcttgtccccactagcgcagtggaaacagtgttcttgttatccaggtttaagccctgttagggatatggcttgtccattgtcatcgtgatgatactgcttaaagatatcctttgttgagcacctgccatatggcagacggtgtaaaaggtgctttacggtcctggtgtcatggaaagccttccaacaaccttatgatagaggtattattatcttcattttgccaagaaaactgaggctctgggaagttaagtcagtcacatagccagtagataccaggcacccataaatgtttgttgagtgaatgaataaatgaaggaatgaatggcaactccaaactaatgggagagaaatgcaagaagagagagactgatcaacatgagacaaaaaacttggtgctacaagttaagaggttttgcacatcccaattattcatttttgcaatttttaagctccactttcaaatagagacggggattgggatgggatttcaatgcaggcgaataacacaagacagatggaggaatatgtttatgatcagcaaagagatcactcatcttgaaaaaaacagataaatgggaaaacactgaagtgccagccacagtactaaatactctactacattatctcatttaatcctcacaaagtcagctttgaagtcagcactgttatctctgtttatggctgaggaaactggagctcagggagtgagggaggctgtccaaggtcacacagctccggtgggtgagggggcagggactggacccaggcacacccagctccacagcgtccctgagactctgtaaacagaagccgggaacaacaatttcattatttatgcttgaatttaattttgtgtttgatggaggaaaaaatggatgatacacagattgctaccaacaaaacccaacaattggttctttgagattctagcttagtgcagggagaaaggcaagccggtgatgaacgttttggggtagccagaaacaatgaactaggggtgactggtgtgaaattcagttgtgtggaccatattttctaaactagaatctgcacaccatgctctcccgccatgttctcccctaggagaaaattgtagcttgcaggcagaaatgtaaacacataatcaattctactataacttgatatatgtgttcctaaaaattattgcaccatgcaagattgggcaataaaaaccgcagggtttatgacgaatacaggcttagggcaacagctctcaaaaacttcatcaatgacacattttttaaaaagataaaaacctaataaaaagggcagcaccgttttacacatgctaaatggttaagagatacataaatactgcagtagagatgggattttacctcaaagtgcaaaggtaaatgaaataaagttttttcaatggaaggcttgcagctcttgaggacctgccaaatggaagaaggacagagacctggagccctatggaaagttctgacaccatgtgtggaaggacatggcttttaacacgtgtggtgactg

SEQ ID NO: 613 - DNA, 2539 bp, Homo sapiens
aagctctttcctttgcttcctgtagaagcccgtcctagagccctgggctgtgaggaggagcagccccacagggtcacactgtccttttcccttgcagaccttggcacccgccatcaactggttgccttttctcaacaccatcttctaccccgtggagatcaatgaatccgagcctattgtggtctatgacaaggaataccttgagcagatctccactctcatcaacaccaccgacagatggtaagaggacccccagtggcctggggcacgcctctcacagacagccctcttcttgggcaggtgggcaggggtggggatgacagtctgactcaggagagtgggacctgggcgggcttttacgagaggcagcaggacatcctggttacaggcacaggtttaaatcccagcctctttcaaactaccagctttgtagccttgggcaaatttcgtaacctttcttaagttcattctcctccttcataaaatggtgatacaaatatcacctgtggccgggcatgaacgcccgtaattgcgggacttttgggagacagaggcaggaggatcccttgagtccctgcgtttgagaccagcctgggcaacatggcgagacggtgtctctacaaaaaataaaaaattagccagacatggtgtcgcgtgcctgtcacccagctccttgagagggaggctgaagtggaaggatctcttgagctcaggaggcagaggttgtagtgagctgtgattgcactgttgcactccagcgtgggagacagagtaaaaccctgtctcaaacaaaaaaacctagcacctaccatttagggctgttgtgagaatcaagtgaaacaatccatatgaggtgatttaatagagtgcctagcatatactgggactcagtaaatgttggctattatttttagttaatacttacgattttctttcttttcttttcttttttttttttttttgagatggagtctcactctgtcacccaggctggagtgcagtggcgcgatctcaactcactgcaacctctgcttcccaggtttaaatgattctcctgcctcagcctcccaaacagctgggattataggcgcctgccaccacaccggctaatgtttgtatttttagtagagatggggtttcaccatgtttgccaggctggtccccaactcctgacctcagttgatctgcctgcctcagcctcccaaagagctaggattacaggcataagccaccacacccagcaatacttataatttttaaaaaattttttgaaaactaccaaaaaaatagggaaaaaaatttatcgtatttaacttatttttttcctaactccccaaacttacttgttaaaatttttttaatgagatggggtctcactatgttgcccaggctggtctcaaactcctggtctcaggcaatcctcccaccttggcctctcaaaatgctaagattacaggtgtgagccacctcaccaggctctgaaaaaattttaaatgactcctgttgatcttgtggtatgtgtgtgtgcatatgtagagagaaagcatgggggagggcaggagagaggagggaaagagagatcggttttctaatatgtggtctttttttcccattatcataactaaatgtctagtctccttttcccttgacctgtatcctgaacattttcccccttgtcatctcaaaacctctgcaaacatcatttttcatggttgcatagtactccgtcgtgtacaaatacagttctttacttcctccttctcattatcaggcattttggttgattctgattagaggttagatgttcactacagtctcaaggtgacttcttggcaacggtggcaacagctacagataggttccctgtgccctgcaggtggggcagtaggagctgtcatcatggaaagcttggcctggctgggctgagcttcttttcctgcccctgctattcttagcctctctggccttctggctggggcacctccaagctgtagaagtggtagtcacctctccagcccagccctgtagcatacaccattggggtgggtctccatgctggggcttcatagcttccagacacagagcagctaggcaacaagcatttattgagcacctgtggtatacaagtgactgcactcaacactgaagcgtttcctatggtagaagacccaggcttttcccttgaagagcttacattgcacgtgcttagggagcagtaacccaccaagcccccgcaggctggaaggggcctggggtcacaggccaagtttgagagccccctaggggccagcaggggaagggccgcaatcctccctgcctaggtgtccctgagcctctctggcctcctctccccgcagcctgctcaacaactacatgatctggaacctggtgcggaaaacaagctccttccttgaccagcgctttcaggacgccgatgagaagttcatggaagtcatgtacgggaccaagaaggtgagcctgctactgcgtatgcctgaatatgggctgagcgcctactttatgccaaggtgtctatggg

SEQ ID NO: 614 - DNA, 2514 bp, Homo sapiens
ctggagtgcagtggtatcatgtcggctcactgcaacctccgtctcctgggttcaagcaattcttctgcctcagcctcccgagtagctgggattacaggcgccggccaccatgccctgctagtttttatatttttagtagagacggggtttcgtcatgttggccagggtggtctcgaactcctgacctaaggtgatccacctgcctcggcctcccaaagtgctgggattacaggtgtgagccaccgtgcccggcccaattgcattttcaaagtgattttaaattggtggttgaaacctttgaggacattaaatgttcaaaacgggtgatgtgtttccttttcttaatattttagcgtctgcttctacgctttgcctgggagaggccctggtggcctcgttcctggcgcccggagtccctgctgcggccccacccccgggcggtcacggtgacccatgctgcccagcctggaggtaaaatcgttcgtggctgtggcttcagcatgtcgtcctcggtgaaaaccccagcactggaagagctggttcctggctccgaagagaagccgaaaggcaggtcgcctctcagctggggctctctgtttggtcaccgaagtgagaagattgtttttgccaagagcgacggcggcacagatgagaacgtactgaccgtcaccatcacggagaccacggtcatcgagtcagacttgggtgtgtggagctcgcgggcgctgctctacctcacgctgtggttcttcttcagcttctgcacgctcttcctcaacaagtacatcctgtccctgctgggaggcgagcccagcatgctaggtaggcggcggctcgggcagggtggaagccggccacctgccaccccacagggagcagccagcaaccacccgggagggccgggggagcccaggtcaggatgggagaccgggggtggagcccactgcaggcacgggaggggtgattctccctcttgtcttcggccccctccctcccgcaggtgcggtgcagatgctgtccaccacggttatcgggtgtgtgaaaaccctcgttccttgctgtttatatcagcacaaggcccggctttcctacccacccaacttccttatgacgatgctgtttgtgggtctgatgaggtaaagaatctcctggttttggttgagtgtctctttttctttaaatgtaaagtccctctcgttactagagcggggactctgctggctggtgagttttcagtgcagactttataaaagcaccagggctgtccagatttcaggacaccaaatgaatgtggcttcgtggctctcactgccacgtgtgttcagtcagcttctttccgggctggtggtctcaggacagggtgcctccttgtctctgggacgttttcaaggggtggcagaagtcacttcccattggacgcagtgccgtttcctgggggctcgacctaaagcgtcacagaagcgggtccaggcaccatgttggtgatgaggaggtgggcggagaggggccgacgtgccaaccgagcgagcgagccccttggagagcctgcccggtgggtgcaggcagacagactcgttctaaggtgatggtgcttttggctcatttttaggtttgcaactgtggttttgggtttggtcagcctgaaaaatgtggcggtttcgtttgctgagacggtgaagagctccgcccccatcttcacggtgatcatgtctcggatgattctgggggagtacacaggtgaggccccctgggccccacccctccgcctgcgccccaccatcccaggcctccatccgtggtgcccgtctctgctgcctgccatggggctctgccgcgaggaccactcagagtggtgcccacactggcagtgccttcacttctctcacggtcacatgtgcgggggtgtcttggagcctggcgtctgccaggtgttctcacactggcatgcggaggtcagggcagggttgtgtctcgtggccctaactgggtggggagacaggtgggggctgggcagattcctggcaagcaagattactgcaggtgccaatcactgatccgaagaggacgggcgggggccgccttcggccagcaccatacaggcggccgtggcccctggtccgtgggccctcctgtgccagcaccccacagcctccccagcacccgccaccacaggcctgtcctgggccccagcccctgacctcagctgcaacccaggctcctgcctctcccacctcttaatgactcacaggcgatttccagtgacatgtcagccccatgtcgcgtacccagtgtggctgcatgaaaaccagcgaggagcagaggcgcccacagagcgcggcatcttgaacggagtgtgggggtgcacacgtgttcgcttatttaagaaacgacaagatcttaaggccgagggaagtgtctgtctgcctttggggacgggaggaggccgagggtccaggatggggttgggcttgccccacatgcacttgagacccgcacacacgtttaggtgattat

SEQ ID NO: 615 - DNA, 2512 bp, Homo sapiens
gcaatgatagcttactgcagcctcaaactcctgggctcaaatgatcctctagccttgacctcctgattagctgggactacagaagcaggccaccacgtctggctaatttttgtatttttctgttgagaagaggtcttgctatcatgggcaggctggtcttgaactcctggcctcaagtgatcctcccgcctcagcttcctgaagtggtaagattacaggcatatgccaccacacccagcttttttgttcctttgaaagaaggcattgctaatgattgccctgaggtgtctagatgacccggccagccatccacctctgcagtttacacagcttgttgatctccacagtgagaattaacttcacaacctgggtccaagaggctggaggattgtcagtctttagaaaaaaaaaaatctattatctttagagaagatggacttgttgaggaagaagagtagacaaatactttctggaaatattttcaaagggaattagaaaaagaaaaagattttggttgtcctttggtgaatgagaatattcatcagcagaatgcctcattaccacgtcacacagctgaccaaggcctcatctgagactgtgtttgaatagaaattaaacagggctgacagtgaagtttctgcttttaattagctttcaaaggtacacctctacctgtgatgttgaaacatcttgaaaaacctctctgctctgtgcctgaatgaggggcatctagagggcttggaagagaagatgtggcacagggcagccggggagaggctggtggccagaagatggacctgagcttggtgaatttacctggcatctgagcctggcctgaacaattcagaaacctcatttcatcagtcttggagtcagggctcctgtctcttagcaaaaagctaaagcatacatcaagcatatttattgacaagcgtaaccactgtgaggttataaccagggtgctctgtctgcttatgggcaccccacccgaccagccaaatggtcagagagctgggtgggtcggggaaagggagggagggagtcatgggaagcagttgtgttgaatggctacaggccctggtggctgggtgcatccccgtatgccatccaggcccacccactgctgggccggaccttcccctctggacagttcttgcttgggcactgactgggtttgctgctgaacctcctggcctggcagctctggttgctgatccacccgcttctttctttatagagattaagagcggctccagtgtgtgtacggagagcctctttgaagcgctgttgcctttctgtggctagatccacgatcttctctctgggatcaccccataggacatttgctttccaccttctccagtcccagtgaatgcatggacctctgtcctcattgttactggctgagccagatgtcagtcctgtgacctggcctcaggaccactcttgtagcccaccgtgggtggatgaagccggtgggaacagaatgataggagttaaccactttttaggcgttattgggccttttcactttaatagcttaacagagacatctgtgatggcttgcatccagagtgcgtggtgtttatttttgatttgaaatatgaaaagcatttttttaagacaactgactcctctgagtcatgcccaggggagcaaacggcctgaaatatgagcttgtgcttgctggaggaggatgacagaggagcctgctgctgagttcactggtgctggggttaggtcactgctgggctgaagcgcactgaccataagagcaacatgtgggcaagagccgcggcactggggtaatttattgccgccgctcgcttcaccaggaaccccacacgctgggttcccacaggatgcgacattcccacaggatgggacaactgcatggaaacccacactcgggcctgtgttgagcaaccacgtttgagtaagagttatcttatttggcagggtgggttaggtgtggggtatttgtcactgagaagcagaaactgtatgctcgacacacactccctgagtccttagggaattgcgtagtttttttcttttcttttctgggttcatcttaccagcagtcgtgtttgagaatgtgcacagctcaccttcgttcagccctttacagtttacctccatagccttctttgcgtcttggcaccatcttgcgaggtgtcaggccaggtgttaggatgctctgtttacagatgaggagattgaggcatgagttgtgattgctcacaattgcctcctgagtggtggggccatgctggggcactgtgcccagactctagacttccaggggtccgggacctcctgctgccagtctcctagcccgttaccacagctgtctgtttcttggcctctccctagatttctaatggaactcttggggtacagtctggaaataggtattttaaacatgctttgcagtgattgttacagatcttcatgttcaggtggcccaggggctgaccctgctccaacttccccctcagacattaaacct

SEQ ID NO: 616 - DNA, 2480 bp, Homo sapiens
agaggcagagtcttctgggaactggcacactgcagagtcaaggcggcccactcatctctgccctttacttctctcacacccagtccctgctgtccactcccgcgggttttcccacttcctccaagcaagcagcgacttccccaagccaagctgttggtcccggaggacagggcttctggcaaggtcggcagtcactcggagcccacaaagggaagcgagaccagccccggtgccaccctttccagaccactggctctcgcagaactgggtcactgcggccatgtttagatttctgtaaaacaaatatttgcctggccagtccagtcaggtcaaggagtgtgctaagtgacgagggcgggagtggggtggtgggagatgtgacaccgcggcggccactcacggtggctgctttgcggacccagagtgtcctgagtgggaggagagagtgggatattctttggggaagggcgtgccattcaccctttcacctgcacctcccacatcccgaggctctggaacttccagtgaaggccaagcatctccccggctggacagcaagccaacagcacaggtgaccaggatggattttcattccttcacgcccgggcctctcccgagacccagcatgtctccccgcgagcccactgagagataatcattccacagtgctccgtggaatgcctgccacgtgccagccaccagctaaggttctgggagcacagctgtgaatgggacagacatgggggagacaggggtcccacaaataaccgctgtgatgaaggtggagggaggggacagccaggtggcgtgtgaaagatgagcagaaagaccagcttcagcgtggatggtgtgaaaggtttctgacggcctgccaagtacttcagctgagatctgattagaagctggccaagcaggctgggtgcagtggctcatgcctgtaatcccagcactttgggaagctgagggaggcggatcacttgaggtcaggagttcgagagcagcctgaccaacatagtgaaaccctgtctctactaaaaatacaaaaaacattagttgggcatggtggcaggcacctgtaatctcagctacttgggaggctgaggcaggagaatcgcttgatcctaagaggcagaggctgcagtgatctgagatcacgccactgcactccagcctttggagactctgtctccaaaaaaaaaaaaaaaaaaaaaaaaaagtatatatatataaacatatatcaaagaagttaagcaaagtgaggaaaaatgcactccgagcaggagggccagcatgtgcaaaggccctgcggtggaaaggaatttggcctgtttgaggagctgagtgaaggctcatttggctgggtcacagggataagaaggatgagattcaagggcttggcaggggtcgacagcagccttgaggtggtggtgagaactggttgttatcccggggactgtggaaaaccaggaagggttttaagtgatggggtcttggcagtggatgtggaacatcctggtgggaggtggtttcagtcattcagccaaagccaagcatggtggctcacacctgcagtcctagcaacttgggaggctgacgcaggaggattgcttgtggccaggagtttgagaccagcctggggaacatagttgagacccccatctccaaaaagaagaatgtttttaaagatcattcatttgagaggtgatggtggcttgaatcttagcagcattagtgacatggagagaggtagaccaacccaagaagtgtttagggagtggggaaagcggcaggggtggggctcgtctggaagaacctgagtgcctcgcaaggggcagcattggggcagctcgtaggtaaaacagttctcctttctcatagtctttgcttcctccccgcagcttctcgctgaattccgagggggctgagaggatggccaccaccgggaccccaacggccgaccgaggcgacgcagccgccacagatgacccggccgcccgcttccaggtgcagaagcactcgtgggacgggctccggagcatcatccacggcagccgcaagtactcgggcctcattgtcaacaaggcgccccacgacttccagtttgtgcagaagacggatgagtctgggccccactcccaccgcctctactacctgggtaagccgggccctgcaggctgcttgggcggggacagcatctgggaccacagttccctggtcctctctgttcccagaggtccacaggagttggaagatctgctcggatggctgggccctgggcatgctgtccttcgaggctcagccacagacagctctgactacagggaagggctgccgcggggtgggtggggcggcccccggagggtcagccgtgcagggagccatgcacagggcagccccgctcctccatgtggccaggatgccgtggctcaagccggccctgtggctccaagcccggagattgtttccagtgctagtcagcc

SEQ ID NO: 617 - DNA, 2298 bp, Homo sapiens
gccactgacatttctcctctgatctaagtctctgcttaacaaagaagcctgtggctactcttaaagtctccccatctggaatgggggtgagtttgttcagctcactccttcttctccttcctgagcagctgacttattctgatgtggttttgcggttatacagtaagcagcactgcttatgtggacatggtgtactttcagtttctgaaagtgagtcatgttgactttcctctgaggagtaagagtgacccttgcttaaaaggacaacatgactagaaggaagaaacaccagaggccaccaggaccagaatgtttaccaatgtaggcagtcactagtttttaggagtagtttgtgtcatctttttaaacaaggtaaactaggaagaaacatttggttttgaatctttgagtgtttgccaatgtttgaagtacttatctatttttactcatcatttaaagtgatgtttgtggctaagagctcaagatctacaaacatacttaaataagtttacatttggtcagctggaacctgatggggacatttccaagaggatcacttgctagtattacatctttaattttcatgtatgttaatggcttgtgatattggactattcatccaggccctaagaaatctcagcaggtctattgagaatcaaaattaaggctgtacatagccactatacagaataaggagtttcttgtaatctaactctccttcgtggtcttatttggttaattttttcatgataacatgtagagccaatatgggctcttgtcaccacttctgcatccttgcaagcattgttaattgtcttatgtttttcttgcttagccaggatgtagcctcaagatacttcccgtcaccatgctcctgacagccactgctgtcagatcacagtagataagtgagatcaagcccacttgcatgtctgccctagaatctccatttaactttgctcttgggtatccaaatcataggagtgccgctgtcctccaatcaaggagactgtctttctttcctcaataattaaatccctctgggtccaagaaagcgcgaatagaattattgtcaaattctatatcactgagccatcatcactacctattgccttggtaagtcatttgggcaattggagagaataagaaaagcccagtagtgaagcagcatgtattaaataattagtgagatattcaagacagtttatatttcacaagtatataaaaattgctattacttcacgggactgaatttccttttctattttctctttctttctttctttctttctttctttctttctttctttctttctttctttctttccttccttccttccttccttccttccttcttttttttgagatggcgtcttgctctgttgcccaggctagagtgatcacagctcactgcaacctctgcctcccaggctcaagcgatcttcacacctcagcctcctgagtagttggaactacaagtatgcaccaccaagcccggctaatttttgtattttttgtagagacggagtttcatcatgttgcccaggctggtctgtgaactcctggactcaagccatctgcctgccttggcctcccaaagggctgggattacagggggctgaattttcaaggcaaggcaagtcccccttttaacttttgttaggtactaggcctgtcatttggtagttgctataaagtaggtggcagcatctattaggatggaatagattcagtagggagacttactaaactgctaatatttatgaaatttagtatgtgatagctatttgtacttcttaataaaatatatttattaaaatcataacatacaagtactgattaaatattgttctagctgagagtcttggttgcaattaataggtataagctctagattatataagcaggaaaaggacttattgaaaggttctagacacagaacctcatctcctccggtgctgaagcccgcggcggggcaggatgggcaggagagcagagccgcggagtctgccgcgcgggtgaagagcggcgcgtaattcctgtggcggaattgttctgcgcctgcagcccctgtgttagcaggatctgaacccgggcggctgcatgcttacaggcgcagaggtcagagagcccttggcttaaagtaagccatcccctcaccttcttcgaggcctccagggctgggcccaagcacccgtcgacggcaccctgggcccagagcactcgcgggcctcatctccaatgattcagaactcacattcgtcactgctgcaaccccaagatgtcagagacacagtg

SEQ ID NO: 618 - DNA, 2293 bp, Homo sapiens
tgaattaaaggcaatcacaaggagaaacggtcatggtgacccattctgagctgtacacagtgtcctctgtaggattgtagccagaggcagatggctttcctagaaatgcctcaatgttgagttttaaagcaactccttatgactgttatctgaatttaccaaactgtccctggcttttcttaggaatgaacttctgatgttgctgtggaattttctgcctggaaacttattgttatgaaacatgtgactgtaagccacattcctcgccttttatgcacctcacagtgtctatgcaaatgaacagtgtgattttaaatttgaggaagtttcaataagagtgagatctaagaggatctttaatataggggcatttttagagagctaaaaaccaaataggtctcagctttctcagggtgacatataatttagatttgacttggaactacagaaggaatatggggcaaaggacatgagaaacattgcagaggtcagtgccatatggagcttccacctcagctctcgaagtaaaggcaaccagcccaggctgggagccagtcagcagcagggtctcaatctccatccactaccttcccctctggggcagggagggtgttgcagggaggaggccactcttggagacctccagatccctgcctctgtgcagtctaacagaaggggcccccacagtggccatgaatctctttgttctgcaaggaagggggtgtcattgggcctcctgggtccctcagcatctgcgtggccacacaacgcggttttgttcaacacgttacatttctgcttaattaatgttcatttttggtccccagcaaagtccaatctgtttttcgttttctttcttttctttccaggcaggcattgccagggctaatcatctataaaagggcttactttcttaccttcacgctaagcaagaccatccaagggcagtgttagagggcacctgagaacgcaggaggggtgtgttacctggtggcctgtttcttcctcctatgggcagcccttctacaggaagcagaagcctcaggggcgatggtagaaatgaggaggaggggatggagctgaggtagcaggggaggggtcgtaagagcagaggggagggtcttgctttgttcgccatccaataatcagcaggtttcgggttggggtgaactactggggaggagcgccccagggcttctctcagatggaggagggacaggtcacccagagtgaaggaagttgtgagctctgttagaggaaaacagccaggacttagtcaggagaggctttgtttggaaggattgttgtaaggcagggagaggaatgatggcagcaagaggaccccgtgaccataggtctgcaagcacttcaaacagaaaaggcccttcttttatccagtaagggggagccactggggccagcagagtctttggaggggaccctggacaaacccgggaaaatggccagtggggttgagcaggacacaggtcctgctgtgtctagctggttccccagagagatgataaggggtgcgctccagcttctcaggctcactcaggcgtgaggacgtggagctcagggctctgcaggaaggagcgacccaggtgaggtgtggtcaagatagagcagagctgggcagcgggcagtggagcctcgtgggcagcctgggggtggggaggcacagtgcactgggaagtggagaaagtgtgagtccatcaggctggctgagaattgatcacgaacctattgtctgtaaaacttttgttatttcctgagacgtggttcacagcaacccaggtgcgaacagccttgtgattctagggttcttttctattttttaagcacttgcatctacaaataaatttctgagtgacttgtcgtcagctgctttccttgatatgtctaaagacagggcagtgacccgcatcgtcacccagagattctgtctctgtgccacatgaagattaggtgcccgcttttgattgaggagctcctctgttgctctcaaagtatcttgtaataatagctgagatgcatggagaaccacctctccttcaggcgctgctcctcggcttccgtggacgggcatggctatttctcggaaccctctgaggttagagctgtcatggtctttcttctgaaagaggaaaccgaggcttgctggggctcagtggcccttctgtggctgcacagctttcggggtggggccaggactgactgactccacacaaaagtgctcccggcccatgtctttaactcacacggcctcttgcaaacgttcccaaatcttccc

SEQ ID NO: 619 - DNA, 2289 bp, Homo sapiens
tctcagaggtgattcaagatgcccctctgcataggccctaaggcagggggtggggactgtgacctggacaggaagctggggcctcaggactgcatctaagctcctccttttctgtgggtgatggtggctgtcaggcccctgaacctacgtcatccctccctctgatttgactgtacctttgctaggcctggtcaagggctagggactcctaaagtcaagagctagggtagaggttgggggttggatctcagggcaccatatggtgcagacttggttgcaggaaagtgacctatttaggcagaggggctctatacaactgggaccacagcaaaccctagaggtgagcacctgcttcaaagactcacagatccaagctgtgatcctagatctacaacttcctggctgtataaagtccagcaagactgaggcctcactgagcttcaatttccttacctgtctaaccagaatagcaacaacttgtttgtatatttgagctcattacatgtcattttgtaaggcactaaagctcctggaggcttccggaacacagaaataattaatctaagaatcctaaagtggctgtcctggtagcacctctagggagtcctcccatcctacgtaacttcctctgggaaagtagaaaacacggcacctgggaaggggcgctgaaccgtgccccaagtcccagtgggcctggatgcccaagagcaagaggaggcccagaggatggggacaggccacgacctgtggcccaagtcccgcccagagggagtgcgccctgagggagagccaccggagctggtgactcgggggcgggtgctctggggtgtcgctttgggttcagcaatacaaatctgccagctggagattaggcggggcacgccggggagaggtgatgcactgccgctgaagacccaggtaggccggtgcgttcggcctgggtgaggaaggcgcgggacccgggtgcgaggactgcgtagcgtccccggctcccgcttccgcccgctttccacgcccacttctgcaagtcccctccggcacctcggcgtccaccggactcctaggggcgagccctcatttccgaggaatgggaccgccttcgtgcccccggggctgccagtccctagactagccctaggggcttctcgtcccggcggagccgggcggtgcctcctgcctgcgcctcgcacctccccgcctggcacggcccacccgggcacggcgccgccacgcgtgaaggcccgcatcggctccctacgtgggggacgtgcaggatgatgcggggtcgggggggatttcgctgcgtcgcccgccccctttccggcgcaggagggagcggccgccgcgtccccgctccccggccgggacgccaccgccgggcgttgcagaggcgcgccgcaaccaatgggcgtggaggaggtgggtcggctggcggctgtcaccctccaggggacgggagcgcggagaccgggagcgcgcgagctgtcgccgcgccccgggccgagggggaggagccgggggaggaggaggaggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaaggtgagcccccgcccgcgccgccgctggtcctggccgcagccttgcgttccggcatccgctcgccgcctccgctgcctccatcctccggcgcccggccttctccgggccagcatcgagttggactgcagggcgcaaggaaagccttcgccttcgattctaccggcattgtcagtgtctctgtgtgtgtgcgtttttgggaggggggcaatcgggcggaagacccccgagaccgggctgcctgctgcagtgtccttgaaacgggccctggatgtcagataggcccccgggctgtgcggggaggtggccggtgggcccttccgcagggcctgttcgggagggtccgagcgccgtgggaggaggtgtgatcatggagatgctggggaggtgatcgagcagcaggcgggggtgctggctggaggccaggcctcccatatttggggttcctggcggagggtgtcgggtgccccggagaagctgtcgccgggctctcccagttgtttgagctgctcgttaatctgaggacgaggtgacccgcccggcttcccggaacggggaggggcggcgaggccaccggaaactttgctcataggcctcgt

SEQ ID NO: 620 - DNA, 2278 bp, Homo sapiens
caaaaagagctttgtgggatgagattttagggcaaagctggggcagtgtctgacttggcggtggtcatgtgtactgatttaggggaaagatcttgaggttttctcaaataattcacctatccccgtgttccctcaagaaaggtcatgttgacctggaaccataggggaaattggtggggtgtgatcagggtcagccccagctgttgctgcccctgcagtgttttgtccagagcacttgcctgcaggtcaggataggatttcaaggccagttcaggagaaagtcccaacccaccagtgcaaccaacaaaagagtaagttttacctacagcctgggttttcacaagtagcatttttattcctcctgctgtctgacatctgagctccaagctctaaacccaacctgtattatatgcagcagcaggttatctttgttttaaatcacatttgttattctgtacttagtcacctttccgtgtgatctgcatttgaaatgttgtaaacttggtcagtatttccattaaaatatcagggctaatcttgtgtatttttttttgttcctaatgattttatagacaaagactcttggcaaccccaggagaaaaaaaataaagctgtcagtggagtactagggatgagaatgaaactggaggtctgtttctggtattatggcttcccgggactctacagtcctgtatggtgaaatacatttttccattgggatcgtcaatgccatgactgttctgccacctcaaactccagagtttctggtgatgtgcaagagttagcaatatacattcagtaaagcgtgtaatcgagtaagtcgtagtaacttgggcgtaaagctctaccaccctgctcactaacaccctgatctccgtccggtatgaaaacacctattccgggtagtctggctccacgttaagcaaacaccactttccgtgttcaccgacagctagagccagaggtctcccggttgctgcttctgaggctgggtctgcagcagctgaggctcccgcctgtcttgccgaatggcctaagtctctgtcttgagactttcgagagttctaatcgtcaaatttcccattttattttgagattttccctgcggcccactatttcggacaacataggagagcctcaaaaacagtttctagcttccaactcggctcaaagttcagacagcagctgggcttccgagagccgccggtgttccaagaaaagctgcccgggactgggaggcgccctctggacgccggaacctttggtttcctgccgtggagcggaacggtagcgccaggggccttccggaaagaggagcgagagcccggcgatggcggctgcgccggccttgaagcactggcgcaccacgctggagcgggtggagaagttcgtgtcgccgctctactttaccgactgtaacctccgcggcaggtgtggcccctggtcccccgcagccggccgaccgcaaccgtgcgcctcaagctttccttccggggagaaacctaagctgcagccacccgggccgcgggacaaagtgcccgccgcgggcagggcaggggccggggaggagggggtagggaatggactgtgccgcggagcggccaggcagccctcttggcggaggatccagggaaagtgcggccccaccggccagctggcccccaggcggaaacggggcggcctccagcatgtgcccaccggcccgtcccacgcaggctttttggggccagctgccctgtggctgtgctctccagcttcctgacgccggagagacttccctaccaggaggcagtccagcgggacttccgccccgcgcaggtcggcgacagcttcggacccacgtaggtaacgcccagcgggtgggcggggccacaggcctaggggaagtcccaacccagctcccagccacaccttcgttgtctgccctctgccgtagacaactacgtgggatcgagcagcaccctctgctgggagcagcaccctctgctgggaacagctctctggtccctgggtcttcaggggatggttttcattcccacgtggccgcctctggacatcccttaggaagggcaccctagggatcacgaacctttgacgcctctgcctgtttccctcatcttgcttctcaccttgttgctcctttcttgtgactcaaagctgagtaccttgtgacactgcagatgcttggagagtttcaagcccctgccgacactttatccaaggaaggatatcaggataggacttctacctctaggcctatcacaacagctctcttgca

SEQ ID NO: 621 - DNA, 2154 bp, Homo sapiens
agagtgaggtccggctacttctttgtccggtgcccaccctgtaaggttgcccctggcagcttctgtttctcaaccaaattctctaaaccaatgtgcctcaatggagggtgactttgcccccagaggacattgggcaatgcttggagacattttagcttgtcacactgtgggtgtgttctggcatctggtgggtggagcccaggggtgtcctgggattgtcctcctacgatgcagaggtcagccccacacagccaagacatagtcagccaaagtgtcaacagtggtgaggctgagaaagcctgcactagcccagggctcctcaagctattcattgtgaaggagcagcttcgattttccccactctgttgcaggccagtgtttttgtaagactagaactaagttaccagaaataatcatcatgcacttcaatgtgacaaccaatgccaaattgctataaagccttaattcctactcttgacttctgtagtgtctgatcatggaacaggaacaaacagtccatgggccggcatccatctgtgagccacactacaagcagcactggcctacatgcttctctctcctggggatgaggcagacgtaacacctcggctcttggctgctattagctctgggttcttgcacattcccttgtgataccctcttgcctctttacaactagccccttgataaataagatctttaattatccttctaggaagtgccatctgcccattcagggcccggctgattctgcagtgttttcctacctgggcaagtttttgagaatgtgggcagcgtcagaggctgtgtgggtagaaggacaacaatgtgacagcagcctggtttgggagcccagctaaggagtttgcactgtctcttgtagaccatagttagtacttgaagcatctcagtgggcaggcgacacagccagagttgtgttttaggtggagcactagagatggtgtggtgctgagaatgcactttcagggagcaaaatttgtggcagagagcctgactggaggctgctgagtccatcctgaccagaaatggagaggcctaagctaacactgtatgtggagttggaaggcagagggtgttcagaaggtagaatctaccagccagagtgatgggttgtgagcaggagtgaagggggaaatccaggctccccagctatagcttggaggatcagtggatggttttgtagggttggatgatgaggtggacagggggacacaggtcagagatgaattctatatctttcactagagtgcccatttcacgtggctttctcatgcaatttgtctgttggttgcctggaggcagaagtgtcttgcttttaagaagtgtgggctgtgggatgcaatggacctgttctggtctcagccccatcattcccccaagggaaagttcaaactgttcagcttcctccttctctaaaccggaataacttcctcagagggttgtaggagattaaatgagataatgcgtgtaaacttgccaggacaagtaagtgctaggcaaatactggttattattgttattagaaaaggcaaacttgaccttgccagccagggctgttttgagttagctggctctggctctccttaagtcaccccaactcctcctaccgccaacacacacacacagacgtacacacgcacacatacacacacacacacacacacacacacacacacacacacacacacagagcagaggaatcaggagccgccttccgcctttctgctcttcatcctagcaggcttttcctgctggccttgtttctgatgggccaattacagtgcaaaactgttccagacctgacctttcatcccggttccagtggcccgccaagaatcagccttgccttgttacacctccatcagcagcacagcccaaccgcagcttcatcacattaggatgtggcttcatcacattatgattttctctgagttggggagcaaaggtgagttggggagaccaggcagggttcctcacaaagttgcccaggaagggcaggaagacggggcagtgtccgagaggcagcatgacccaggggtcaggtgcggaggccctggagccaaactgcctgatttaaatcccagctctgccaacttactagctgggcctccttgggcaggtagcttaaccttt

SEQ ID NO: 622 - DNA, 2143 bp, Homo sapiens
taaattccacctgcctagggattcaaactacatggaacaagtgcaattcctcagagtggcaactggcagagctcccaggaacaaggtagaactacacaatgtcccaggcatcagaggcatagattgcctgagtcagggagagtggtctctgtgacctgacaccccacccacagtgggaaggaaagctgtgggtgtgttatcaaggaggcctccacaaggggctggaaattcctggttttgtcttcctcttggaatgagacatttactctaagagaatcatggaaaagtacaaaccacagaatcataaaccacagagggagaagctacctcgtaggtcattcttatgctgggcccagataccccgataagcagatgttctcttctcaccacccctcctcgcctttgcttgcccacagccattgccaggactcttcctcaggcccagaaaggcagctgattcctggtaggagggcgctaagagtagaaagtaactaccattgtcaggtccagatctgttcccaatcccttctcactcctcctgcactctaaaaccacaccacagttccaactctttctgagtctggaatctttgagagtgccgtcatgtccttcttcctgtagccttcttgtccaccccagatggactgaccctcccacctacatccatgaggccagaaggcaacaaagacaagcgtggactctggctcccgccgaggtactctgtaccccgtggctctcggattttgcatctaccacatgccacaggcttgcgtccatccgacctccctagtttctcatccccacttgaacctgatgactgattcgccctcctggctacgctgagtaagccacccacttgccaaacctcagacctggtgttgacgcagtaagaaggcatgaggcccatgttgccagaacattcctaattgtttcattgtttccttgtaggatgtggtttcaagtcccatctttgtctcttttctcctggccaggttgcccttggtcaatattccttcattcactccagccactcagcaccgtgattaagaaaacaggatgtgagattagatgatccaggctctgccatgaactaactagctgtgaggctttagagaagtgtcttaacctctctgagcatccatttctttctctatagcattaggaatattaatagtacctacctcacagcttttttgttgtgataataccaataaatgaaataatcttcataaagcacagaggcttgaatgttcactctaagtatttaatatgtgtcctctactattttattttacaattatcattccttaattcatcatataattaccaagcctcatgccaggcactgagatataaatatcccctttaaagagtggtcatgtcttaaatccaggaagagctagttcatgttggcacccagggtagggagcgaagcccagggccacagcacagaggcagaggagaatagacactgaccaccaggagctgcccggggatggtgacaaaagtgccttccacctttccgcatctctttcaataccactgcaactccttgagtaaggtgggcaccacacagaagaagggggatggcagaggggcagtgagaggtccccagggaaacaccctcttcttcttccctgcttctctgacagagcacggccatgcctctgccatgcaggagggtgatgtcctttggggaggccttgttgaatctgtctggggctgttccggaagtaggaagggcggctgggggtggggagacggcaggaatgttctcctggcctgctggtctgtgccggcgagtgtgctgagaggagggcctctggacatcaaaggttccttttgtccccttccgagtggcagggcagcccggcccgggctgctggcgatgactcaggcctggccctgacgtcacccacgcccggccactggcctccctctgaagccaggaaactagttggggagtggcactcgcagctgcagcaaatctcaaaataaagaggcaacggcctttctcttcctctccatctccctatagcacaccttttatttcttttcttcttttttttaagcctcacgaaagattttacttgtagatcaactttcaaaatgtaggaagtcagaatgggtgacatcatcagaa

SEQ ID NO: 623 - DNA, 1800 bp, Homo sapiens
ccagggtgagaagatgggctacaggggcagtctgatccgggggtgcccccaacactgaagccgtcttccctgacttgtcaccacagagactcatgaaattttggagttatcagacaccctctggatcctctagtgtggtttatagatgggctgtggcagcatcacctgggaaatcaatagaaatgttcattcttgggtccccagaccctctgaatgagattccctgatgggggtgcccagtgccatccaggtgcatcttatggatgctgacagttgagaagcattgctgtggacactgctctagagttgttctcgtaagagactgatggaggggaactttggtctagaaatccggagtccattcctgatgcagctgctgacttctggtttccttatttggccctgtctttcaatgatgataatcctacaccttttttaatgggagtgatctgagtggttaagctaatgggtgtgtagttaagagctggtcacctggagtcctatagactcagggtcaaatccaagctcagtgacacttgggcaggctacttaatgttctctagatctgtttctttatctgtaagatggggtcagtaataatcaacacccatggggtggctgccaaaatccagcgagtttacaccgcaggtgcttagaccattgcctcatacatgaaaagagcccccaacttgttatgactcttattattagtgtcatcatcacccatgacctgtctttggggcctggcctcagaggtgctcaccgttggtggtgttcagttttcatggctctccacatctcctgctctgttcccatggtggttgctctgtgtcattctgtgacgttttgggaggagggtctcccccgcttgcccctgcccccggtgacattgattggtcttcctggggaatcaggcctgttacatcgtctgcttatctccatgcctctttctatagacatattgctcctgagccatgttgagcatctcactgggaagaagattggtggttttacaccaccagctgctgtcattcactaagtccctactttgtgccaacattttacattagcactaagctacaccgtagcctcagaatgtaaggactaggatacacattctacagatgtgtaaactgaggctcagaaatttactaactgggtgggactatatgaacctgccatttttgtaggtgaaaattgcagcatattggcaatttcattcggtatttttttcatacaacataattgtttttccacaaaatttagaaaaaaatggcctcaaggaagttttcttatttcttctaaccaaactgttacctaaaaggatgcattaaaaaaaaataagttggggtcatgcactgttccaagcacttcacgtgtaactcactcaatcctcatgacaaccttacgaggtagatgggatttttattatcctcgttttgcagagtgggaaactgaggcacacagatgttaagtagcttgtctgagtccacacacctgggagatggctgagacaagagtttggacacacacagtttgggcccgggtccgagcgcctagcctccgcctatactagtccgttgaatcttggttaggataagtccccccgtttttttttttttttttgagtgaacgggattttcggtgttgcagaactcgatgagtgggggaaggaagggcccagcgtcactgagctcctctgtgagtctgtgcgtggcgctcctcttctgtctttgcagcagccttgggacggacgtaacggcaaccccgttttccaggtgaggataaccagactgggag

SEQ ID NO: 624 - DNA, 1796 bp, Homo sapiens
gcagaagagaagagaacaccgtctatgctgagctcactgtgtaccagatcctccaccagcagctgagagtgtctccctcagtcctcacaacagcccgatgggtgccattcacagatggggaaactaaggcaagatgagcctatgagcaagatggttcccggccccacagctgggaggcactggagctgggatttgaaccagggctgtgaccttcagactctcacgcccaaccatatctggcagttgtctctcatatctgtgtctctccctgtccctgacctttctatgtatctctgtctctgccctctgtatatcgctgctgggtctctcagggtctctgacccctgtgtgtctctgtctcctctgggtgtccgtgtgtctctgtctccgccctccgtgtatctctgttgcgtctctcaaggtctctggcccctgtgcatctcagtcccctcctggtctctgtctcccatgccctctgccctctccctttctccctggctcccgccctgtctgtgctgccgtggtcctggctgtgcctctgtccctgtgtctgtttccagggtgccccttacgcgtcagcccgtgagggcaagtttctgtctgccccttccccagcggtggcctagtgcttggaacagcgcctggcagacaggagatgctcagtaaatatttctcaaatgaataaaggaatgaatgagtgaatgaatgaatgaatgaatgaactcgctgagatgggcgagatcagcgccatttcccaaatgagcaacgtgggctccaggtgggtgcccacaggcccagaactgccagcccggaaggttctggcgtgggcttggcactgaccccctggactctgcccccagctgagcaccagacgccaggacgtgcccatcactgctcctccccgccctcagagcagggtggctccctctggcctctccccgctgttggaggcgtgggtagcagctgggagaaccggctgggtgctgcccctccccttgggccgggcacggagtaggcacctggcgggctccccaggtggcagacgctgtcgctgcgcacacctggcctctgtgccgcctgctccctgctcgtcctcccctccccaccctcacccacctgccatggacgggcccgccgagccccagatcccgggcttgtgggacacctatgaagatgacatctcggaaatcaggtgaggcccagacctgggcaggagccaggagatcccagggaggaggtggctgtttgggggagccggggactgtggcaagggtggcctccagccacccgcagccgcaggcctggcccagacttagctggaggggctgggctgggctggggcatccagtgtggtgtataggtccctcctgagaagggagtgaggacccgaccgtgttgagtcaccagtggggatgcctggggtgtccctgtcgctctccgggcctcagtttttctgtctgtcaaaggggcccacaagccctgtgtctccctgatagagcagtggaagagagcaggcagcttggtgcatagtagttgctcaggaaacacaacagcctgtagtacccaggacaccccatgcaagccctgaaataacgggggtgcttgggggtgaaatgggagagactgggatgctgctgagacccccagagggagaagctgtgttctagggcacttggggcggagagggcaggctctggactcttcaggtctcctaacagtggttagggcagagcactgcccacttccatgagctcagcgtgactccctcttcctggggatgagtcagacactttgac

SEQ ID NO: 625 - DNA, 1779 bp, Homo sapiens
gcattcccattctaaacccagtcgcattgcaatccctgcaacaaaagggatccgagatttcctccactggtgactgtgacctggggactgggaagtactgtatacaggaagatcttgaagagctgtccccttgaatagtcagcaccagggttgcacggaaagtaatagctgaaatccaagttgggttttcctggcaacagccaatattagtcagaggtggcacttggaggattccccaggtctgctcattcctttaggatcattcattcctcccaaggcctcccttgggaacaaaggaaaaccccagagtttgggattgggctcttttccaccaacagctgctagtagtttgtatttaaccctgagtcacaattaaaataaaagagggcgggcgggggaggggcgaggagttggtaagcatcccctaggaaacacttaggttttctctaaatttattccagaaaattcttctaaaggacttttcaaggaccacagcatactgccttggaaacttagtttttaacctttttcttttctttttttcttttttcttttttttttttttttttgagacagagtctcactctgtcacccaggctggagtgcagtggtgcgatctcggctcactgcaacctctgtctcccaggttcaagcgattctcatgcctcagtctcctgggattacaggcgcgcatcaccactcccggctaatttttgtatcagtagagacaaggtttcaccatgttggctaagctggtgttgaactcctgacctgaggtgatccgcccgcctcggcctcccaaagtgttgggattacaggcgtgagccaccgcgcccggccagtttttaacactattagccacactgaaactgaactattgatcaagtgacgccacacaaaggggtaaatcccctgttcaacaaagggtttgtgacgcccctgggtgctgacaagccaaaccgcaccctccctgcggcacctcgcgggccggtggggcgggaagcccggcttctggggaggtgccgcccctccactggcgcaggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcgccgcctccctctacccacccgccgcacgtactaaggaaggcgcacagcccgccgcgctcgcctctccgccccgcgtccagctcgcccagctcgcccagcgtccgccgcgcctcggccaaggtgagctccgcccggcccacgcgcccctcctgggtagtccccaggcccggacctgctgcccggggaaaaccctgcacccggcttcgcggggcgtccggagcaccgcggggctgggcggggagcggctggtggggaatccgctgctcagtgctc

SEQ ID NO: 626 - DNA, 1773 bp, Homo sapiens
atggtgttcactttcggtagagcagtagaacttctctgtagaacttctcagttgtttttgacttggtcctttggggagtatttactaagcagacagtgtagtacatgctctagctgagggtcacgatgactcagaatccttgtcctccaggtgttgcaataatcggagcagccacttccctcagcctggccgcatccagataagcagagtgattacggaggtgccttaaggaagcagcgggttgagggtgctttggaggcatgaggaacaattggcccctattggaggaagcttctcttttggaaaagaagttgtttgagctatggcttaagagggtagggtaaacttaggtgcatagagggaggttatcccaggcatacaagacaacctgggcccaggcctctgaggaaggaaaaccagtcaggctggcagactggacctggtaggatgaaacgtgcctgttggcacagtgccctgcgggtactctgcagatgcagctgccagcgagagagggggcagggatgagaacaggctggcagagtagcgtccctggtgtctgtgctcaaagcagccatagcttgggcctgctctgggtgaaggagacggatttgcaggcagcttggaaaggtgcctctcataagtatccttcagatcatttatcagtaatgctgtgaggactctcccttcttttcgtttttgaatcacaaaactgccatagaaagtagttgaattaattaaagacatacctctaataaaaattaaagtcacaatgtctaatttttttttcaataaattaaggagcatgtgaggtttttttcctttttttttttttttaatgtagggagtagggggcagtattaaaaaaaaaattctactgattgaactttttctcccagccccagagggtccatggtcattatgatggccctaaagcctggctctgacccctgcttctgagccaggtcagagcaaggcctggggtggaggcttctggggaaattttgtgttgttgctttattaaaggatagttttgctgaaatcactctatcccttgggtcatatacactgcatcacactttttataggagaggggctatagaagcctcccctacccttggaggtgacgtagtattgtaagaaaatagtgggggcagagcttcgcctggccaaatatatatgtgttctaattgtgctttacacaaattaattatattgtttgaaggtatcaaagatgaatatttatgaaattatacattaatgaaacactttcaaatgcctttcccgtccccacactgaacacagatacactcactttccaagctaaagtactggaatcatggcaatttcttccaatcagtgccagctccataattgatgagttttcacttccgttatttcatttgagtgtagtgatgatgtggatgttgccctcttacaaaaaaaaaaaaaaaaatcaataaactgaggcccagagcaacatgccatggttaagaaccaaatcagtggtagagctgagtcagaactgataaactgtgatgactacgctcctgcttgtgaagatctctgccaatgcaagaaaataagggagaatccagtttaagtcaattggtatacaacatagttattaccaagactctggagtcaggcaggcctgagttcaaattctggctctgtcactggtcagcactacttcagggcaagtaatatagccctccaaaccttaatttatatgtttgtataatgggaatagtgatccctcactcatagggatgt

SEQ ID NO: 627 - DNA, 1772 bp, Homo sapiens
gctgcaggatcataaaactgcttttccactttacaatcaatcaggttgggtcaggcaggatttcaaggcttctgtcctaggtagatgggctctgtaaagtcccgcttaaaaaaaaagtgaaggtaggttcaagatctgcacacaactggggatgaggggagtctgatgctctgctgtgtgatcatgcaaggaactgttcccagtgcaagttatgtcgctttcagggacactttcttcatccaaataagaatgtcaaccacactaaaactaatggatgtctctgagtggtgtgtgtgtgcgggtgcgcatgtgcaaatgtatcttaatatttaactgtcagacagccagaaataagctctcatcctgtatctcacgctagtggggaggtctagaaaaggcgggggggcttggactgccggatcccacccacgattaatgtgctgaagcccccttctgttatgatactaaagtaattcaaattgaagagaaaggaccgttgggtattattgtgtctcttggccctccaatgtgagcgatccccatgggaatggacgggatgtctctgaaaaggagtagtgattctcacactctgagaaagcagtctcttagggaagggatggtgtctttaggtttggatatcacgtgtaaaaactgggtgtggaaaagaagggagtgacacttcttaaaggtatgttttattttgtttgagatggagtctcgctctgccacccaggctggagtgcagtggcgcgatcttggctcactgcgcctcctgcgcctcctgggttcaagcgattctcctgcctcagcctcctgagtagctgggattagagacgtgcaccaccacgcccagctaatttttgtgtatttttagtagagacgggatttcaccatgttgcccaggctggtctcaaactcccgagctcaggtgatccacctgcctcggccttccaaagtgctgggattacaggcgtgagccaccacgcccagatagctcaaggttttttaaaaaacatctgaatctgcgtgcttgcgccgctccaggtctccatcactccatattctttcactccaaactcctttagacattcctgcctggcctccaaaagcgtttgggtttgcatctctggatttttttttcaacttcctcattttacagttgagaaaaacaggaggtaaagagaggaaggaatctgctttaggaagcagctctggaaagcagaacacagtttcctgctcccgctctctctccactactctccctttaaaaaatatactttcttctatggccaattaaacattcattaccaacctgcgattcccttaggactttaaaaggagggttgttcaggggtgacaacaatcttctgtctgttatacgtgtccatgtaggcaaaaactttcccaaattcaaccccagtctaggtcccaaaaactaactacagagtgcagggaaaccagacagctacagttcagcccaggaacctcctctcctagctcacgtttctacccgagcccgcggaggcacagaccggaagtggcgcgcagcctcccagcggagggaaccgcctatgcctccgtcgcgctggccggaagacgggggtgcaaccctttgaagtgtcccctcctacttcttgctgcctcacggttgctgttgcagacccaggagtctctgaaggcttccgcggctttggggccggttgtgagatgccaggcagaggccgctgcccggactgcggctccacggagctggtggaagactcgcactattc

SEQ ID NO: 628 - DNA, 1756 bp, Homo sapiens
tggggaatcttcctaaaaccctaaaagctagggcaggtctgcttgagcaggagcagcagggtctgggggacccctgagggcaggacagtcagggacccacagttgagctgggcccgctgagccctggatccttcttggtgtcttatcctggccagcaagcaagtgtgagctcctgtgggtctccagaggcccatgaggaccagtgggccagttgggaacaaggcttggcgtcctcttcaggggggaacaccagggcaggcctgaggaggcctgtgtccccagcctgtcattgctgtggctccgcttctcagggagcctaggaagaaggtgtggcaagagcccgaggcgctggctgcacctggcggggcctgtgggcgtcagtttagacccatccattctcactgcagcattccagggtttgcccttatgctcggctgtgtgagggtgaggatgatgctgtgggggcatgcatgctgggtgtgtttcagccttctcttccaccaggcatcctgacatcgaggcccaggagagaggagtccggtgtctacttgagaaacagctccccaatggcgactggccgcaggtatgccgccagggacctgagcgcacaaggcccagcactgacctccagcgtgcatggctgtttccacgtccccctgctctgtgtcctttttggggtactttggacacttgggaggcgtcacctctgccagtgaatgccacagttggtggcaggtctgtggcaggtggtcgggtcctaaagtccagatcttgctgttgtttcaagtgatgctctgggtgggggaggagctggatgggagaagccagtgggcgggaagcctttttgctgcaggacagaccctcccactccagatgacctagtggcccctcactgagccagaagtccctgtggtgtgggtgtcatgaggtcatgtgaggccaaccgccctcccctgggatgaggctgagttggtggaagctgatgtggttgtgaggggctggtgaccctggcttagggtttgctgcagggcggggagtctgagctgggctgatggtgccatgactgatgcgggatggactacttgctttcctatgctcttgcttaattagccctttccaggctgactcacccacaagccagccaagccaacagccagggctccagttcagggactagccctcagctgactggtgaagcctttgtgtttatttctctgtgttcttttaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtggg

SEQ ID NO: 629 - DNA, 1753 bp, Homo sapiens
cttccactactctctgggggatttgggtaagtcaccctggccttggtttcttcatctataacatgatgtcatttgtagaagtttgtagccgatcaccacggaggctgtcccagccctaacatcctaggattcaacaccacttactctatcatcccttcgactgagcactacctcctccctacactccctgccttcaaagtcaacaccttccttcttcagcaaaccccaccttgaatatttagggtcagcttggatttgtccctcttgttcatgccacagccccaattctggaagcttctctccaagaggtgctcccctatctgcacactccttcctgttgccaccaccagcaacctagctcaggccccagcaccacacctcaaggaggccccagtcccagcttcccccatgcagcctgccctcggccctttctatccatggagcttccaaacagcctttgcatggagcctgggattcctcgtgtcactgtgaagaactagaccccaccattgacaatcttcgtgccctggagattcttttcaggttagggatgaggagaggaacatttcatggtggtcagattagatattcactacgtatttattgaattcatttggtcattcatgcttctcaaaacacatccctcagctggtcctctccaatccaaaacagacaatgtcagagatctctttgcaaatcatgaagggcttgggcctttgtgcctcaatgtcacacgcatacaatttcagggggtccatcttcccctcgccctagaccatctatagggcacagtttacctctgattgagctcatgttacaggtggaaagactgagaaagagagaggaagggacttgtctgagaatatgcggaacatttccttctaccaggcactagatcctcgcacaaaagtgctgagtccgctcccaaccccaggcccgtggctttgagcagcaggtcacttaacatctaacgtctttatgctgtttcctcatctgtgcgagagcagctatgtctacctggcaaggctgtagtgagagatcatatcagcataggaatggggctcagccccatgcacagaggacagttcttgtttcattcttttccttgctgtttctcttcctttcctggcagaatatggaggaaggaagcatcgctgccatctacagtggtcacggaaggcttcatggaagaggcgagccctgcctgggcctcaattttgggtgctggagggaagcaggggccaagagttattaatagtcttggcctgatgggcccagggaggctgaatgtgatacagacacccagcaccacggttggggagtacctgacaccggaaggggagggggccggggctacggggagtgccacctcccaaaatagccagagcagaagcctatataggtggccatcccacctccaggctcacttcccgacaggacttcccaccagcccagcctttcagtgcaggctccagccctccacccccacccgaggtgagtggcagctaccgaggttggaggatagagggatgcagcaggatgagccagctggaagggagagctacatctcccctgtccgtagtgacccggggaggggggtgcggtgggggtgctggaggcagggcagctgtggaatgtagggctgagagcatgcattcctgcttctccacccagactcctggtgtggcctggggcaaactccccccacccaccgccccccgtggctgggcctcagattccccagccttagaac

SEQ ID NO: 630 - DNA, 1743 bp, Homo sapiens
atgaaaagtgaacaacccagaggtaaggacaggatgactaagatagagaaaggacaacaaagatataaatatggctcaaatggaaacaacctaaacatctttagctctgtgaacccaatttagtgaacagtacagtcatgtattaatttttaaaaggtatggcatggggatgtgttaactggtggaccatctataggaataatagtactcttaaggatatgattgctggcactttttctgtggttgccatatgccaggctctgtgttaaatgttttatatcatctccttaaacctcccaacaacccatatcacaatcctcaggagcaaaggaggaattccaggctcagggagtctaattaacctgcccacatttacactgcaggtaatggcatagctgagcttggaatccagttgagtctagattcccatactcttatcactctgctcttcttactggagttccatagagtgtccaattcaggactctacaccctttaaaaaaataaaactggataaaaatctagggattaaaaatcagtaataatgaatagaggattaaaagggaaggctaaagcaatatcatctattccattaaaagacgaaacttcattagtatattgtaaattagaaaaactactaatgaaaaaatacagctactcatgaatgactggattcttgatttttataaaggaattcttcaaggggatagttctccaaatgtggatggcataaaaatatgattgatcaccaactgtctaggcagatttacgaggtcgttctcctggaacatatgacctggtttaactgtggccaccctgaccacaccctttgagtagacacaccctagtgagcacaaagatgagattatctgcaggatagctgcctgtacacattgccagaagtgagatgatttgatatagctatagatctaccacaggaacagacgacttaggggtcgagaagaatgcagtcttaaaaaccttgctttttaaagtgcactgttaactgtttaaagaataaaggaaggttccagtgcccttttctccatcggagtgtcagtagattaagcaggataaaccttttgcctgagtgttgctgcaatatttaaaagtacaaatccaatatttctggtccacgtggatttctatgaatagcttcccagcaaataacgaaaaaaagagagtacgtatgttgtgaagtttgttctgtttattagcaacttcccgcatacttcaactttcaacaattttactctagaggcagagtaaagggatactttctttaggaggtgactcttactggacgaacactcagtgtttccaaaacgtttgtgagatctcagggagagggaagtgttaatgaagctgcagttctcttctcctcccctggagctctgagaggtggctccctacagccattccgttcacctgcttgagttctgttgaaaattgtttcctgcgtggctcgcccccgccccccattcttccctgggaaagtatagattttcacgaacacagggagttctgttttctctgttaaaaacaactctcctttactggagcaggctttgtgtttcacctcaggaaacagagcgttgcactgggaggtaactccgctgggtgaggtgcagcctgtcacctgaccggtctctggggctgccggtggcatcaggctgcattccttgaattcttccacccggcaccggctccgcaatgaacaacttcaggttcactgagctgagc

SEQ ID NO: 631 - DNA, 1710 bp, Homo sapiens
actgagagccacgtaagcaggtgcagggctttcaggggacagtggccttggctctggctatcacctcaaggctggactctgtacagcccaagaggcagggcctgcctgggagggctcaggaggggctgcagcgtgagcagactatgccacccggattgctggggttgtgcgggcggtaggtgggacaagcccctcccatggcctgtgggtcgtgggactctgatcaggtcaccttagggcagagggaatgatacacacgtggaaacacatgcacgtgttacagaggagatggggtgttgcagggcacagttgcagttttaaacaggagaggccttgctgagaaggtgttgttgaaataaagcccgggagggagggagggagggagggagacgttgtgggaggccgccccaggcggtggagctgcaggtgcagagggcctcggtggcggctcagcgcccttggggagcactgagttgccgggcctggtgtggaaatgtgaccggtttgtgcctggcctcgtcagtgttgaggacctggaggaaacgcagatcttgggtggggagacaaggcggagagaacgaggtgcattggaacagtccaggcgaggggtgctggcctgcttgggggcaactcagaggcctggaggatagatgaggaggggggctgtgggccttgtaggtgttggctgtggccgtgcctggagtggagggacccttgaaagtttggcctcagctcgggacactgatgttcccgggttggcccttcatgagagtttggcctcagctcgggacactgatgttcctgggttggcccttcacagctggtgggcggggggtgctttggggagaggctgccctgcgcatcagggcatcaagacacaggggagtgaatgaacctggggctgcagtttcacctgggtgtggccctggctgctggggaggggccgtggctctgaagcctcatgattggccaggggagctggcatttctgttctggtttgggtcagtgacctgaggtggttacaacgaagtcagtgaggtcattgccacggatgtgggttacaacttggaatgcttgaggctgcagaacccctccccttcttgactgagcagtaagggttccctgctgtggtgcaggaacatgtgggcagagccctgggtgtctccaggtagaggaattttggtttctttttgaccccaggttgaatctccaaattgtcactgccttgtgttctcctccagtaggcagaaggaggtgatattgtctgttgagatctaaagtcctttatgaaggtcctccttctccttccaggagggagccatggatttgctgcgggagctgaaggccatgcctatcacgctgcacctgctccaggtaggtccctgcctgccccaggtccaggacagctcctgggtgcagcccaggggatggcagttctgagggcacctggcagggcttccccaccctccccaccaggccttagttggcacaaatgcctgttcctgaggagagggtctctgcctttctctgggctcagtgggacagggaggggagtctgaggataacccatcttgtcctccgtggctgaggctcctgggttccaaatgggacagtcgccattgggagaggcctctacctccctgggaggtcccgggctcctgtcctgtgggggccaccaaggctctgccaggagaatctgacccctagggt

SEQ ID NO: 632 - DNA, 1500 bp, Homo sapiens
gctagagtgcagtggtgagaacatggctcactgcagcctcagcctcctgggttcaggtgatcctcccacttcagcctcctgagtagctgggaatacaggcgagcaccaccatgcccagctaattaaaacatttttttgtagagacggagtctccctatgttgcccaggctggtcttgaacttctgacttcaggtaatctgtcccccttggcctcccaaggggctggaattacaggtgtgagccaccgcgcccggcctggtgatgctttctactgaagagtcagttgataggtctttcggggagatcttgtgatgaagaatcaaagcatttgactggggaaagagttccaggatagtcaagtgatgctcaggaagtcagtggagccacgtgctggttccccatccctgctatagcaaattaccacagacttagtggcttaaaacaacacagcttcattctctgacagttctggtggatgaagcctgaaatgggtctcacagggctaaaatcaaagtgtcgggagggctgcgttctgtctgaacgcagagagtttgtttcgtccccttttccagtttctagaggcccctggtattccttgggccatgatctctccttcatcttcaaggccagcaggttagcgtctctcctgtctgacccctattctgtcctttcatctcctctcttaatgctgcctctgtttttatatcttttctctaattttactgcctccctcttggaagggcccctctgtatactctgggctcacccagataaactaggataatttctcccatctcaaatccttacgaaatcccatgtgaaaagtcccttttgccacatagtcacagtcacgggttctagggattgggacatggatgtctttaggggtggagggcgtccttcagcctgccacagatggcaaagtcatgccattgtggctgcagctccattgtccaggctgagtgtgggggcgcatggcgtggttctcatgcccaccacctaccctgaccctgcggaggtgggcaggaggcagcgataatcaccacgtgcagaggtcctgccaggtgcccagcctcatcattccctagaaggcaggcaccaccacatgctcccacactgtagataaggaaacagctttgaaacagatttgaaagtgtttgaggatttgcctggaaggagggctccagagccagggactgggtccgggacacccggagactctctgcttcttggagctccggcaactgcttgtctttctcttcacaggagaagggggccctgctgccgctgccgtggggcggggcgtgggcggtgctggctgcaggaaggctctcccctcccactttgtgctttccctgcaggctgctcctctgtcgagctgatcacacccacagttgagctgcgctggccagagatgcctgcccacagcctggtgatgagcagcccggccctcccggccttcctgctctgcagcacgctgctggtcatcaagatgtacgt

SEQ ID NO: 633 - DNA, 1498 bp, Homo sapiens
catgcatttttcaagcctttttcaaacatggtttgcattgtgtttgccaaagtccctttaggcaaagcaagtcgcatgggcaagcacagcattagtgtggaagggcactactgaagagcatggaaataggaagaggaggattcgaggccaattttgcaatctattccagctccttcagggaaggggagtgaaaagcattccttctctgtagcccaggaatgccatgggccagggcaagctccagatggggatccttggaagaggtgactcgggctccaggacttccttgccctccaaggctaggggtggcagtctggattctgatcccaccatcttctccacatggagaaggtgcaggagcttgagccgctagagggaagggcctccttggcagggaggaaggtgttctgaaccctcactcctatcacctttcagcccaccccaaagtgatgatcaggcttaaggaccccccagcatccctttggtagtgaaggactggattgttctgaggcttatgcctcatcaccatggtaactggtgccacctgctccccaaggtcaagcaggaatccctgtccttccctttcaggggggtgacagtggcctcagcctgtctcttccacaggtggctgcgctggagcggcagatctttgacttcctgggctaccagtgggctcccatcctagccaacttcctgcacatcatggcagtcatcctgggcatctttggcaccgtgcagtaccgctcccggtacctcatcctggtacggctcacctagccccttcccaagccaactcctctcctcacccctgcccactccacccctccctgctcctcaaaaccagaactgccccccaacactggggcactggtcttggctccacccaaaacaagatggggtgaatgtgcacagccccatgcttctttgctcagaggagacaagggttttttttttcctgaagaattttttagggaaataatccaaatataaacaaaatggatcatgtagtgagtgcctggcacgtgccaggcacgctgcgaaatttcacatgcttcatctcatgtctacaatagccctgtgaggtagatcttaacagctccattttccagatgaggaaactgaagctcagaaaggttgcgagtcttcctaaggtcacacagctaatgaaagcaaggcaggattagaacatcagatcaacagtgaaggctcctgctgcggcaccacacggcctcaggaaggggtgggcgcaaggacacaggagggatgggcttcatcttatttagtttctcaagaagcttcaggaaggcttggcatttgtctctcttgcccgatgtacatcaaggatgtgttctggagcagctagtgtggctttgaggtcagtgcctccctgcactccagccccaggagtctgggtctctctcctcctccccgacagcctcttcccaagtcctggtccctgatagtctctgtcaaactcctgctttcagctagattcacc

SEQ ID NO: 634 - DNA, 1495 bp, Homo sapiens
ccagagagcagacgaatccacgggctctgtgtgggagtgagggaggccttcccggctttcacatccaggtgcacctgagccccgatcccccatgagtctgtctcaggaagtaaatggcaaaagcgctaagtagatagccccagaggaggaggagaattctgaattctgtttatagctctgctcctattttgttttctaacctcagaaaactgatttatccttgggaagggtcagtttcttcattaggacaatgaagaaaaatccagctgtcccttccaaggggaggtatcatgagcagtatcaaggtaagcaagggaacctggtttggaatcctggttgacaccggctttcactttaagaagtcgcaagagactgccgcaagagaggaagccacagaccaggttggaccctgagcctggagtactgccttttctcttctttgcctgctaaactccttgcttgtcaagattcagcagagatgacaccttctctgggaaggcttcctgagtctcctgcagtgagcccctaggctcccctagcccttggctcttatgtcttatctctgagaaatctgagatctgcacttttgttagaagtccgttttaaagacaatcttttaaagtgtacaaatagaaaccttatcttattgtattgcaggcctatctcctcccccggtgtgtatcaatgctcaggctgggcctttgtctgctggcttgtggagggaggcaggacaagccagtgaccacattcctgcactctgggctgcctcctgtggggcccgtgaggaagcggcagccttccctgccgcgtgcagggcctgggttgtgtgggtggctctcccgagtctcctccagccctttttgggtctgattctctgaccctcctctctctccttgctcaccacttggcactccactccttatccttttgctgcattaagtttggaaagagattttggagaaaatatagcccatcaacgaatttctcctcctcccagggcctgtctaggcgtgtgccatgcccaccctcttcctttccagcgctggccacatcctccctgcaccttcagtgcctgctttccctgcctcttcctgggctccgggtctgtgtccacagtgtcctgcgtggccctcgcgctgcctctggttgcccacattcctgcaactctgtgaccacagcaggggcgattacacattcctggcctggcagccaacagtgtaaaaaagaacagaatgtcctagggccccgcctagcccccagcttcacctgggcccctcccgggtctggacaaggttggagggggtggcgaggaatcagcaggaaagaggagggaccaggaggaggcagacgcatcccacctgagtgcgctgctcccacttagtgagcggggaggagacctgcagagacctcttctctcttctctgcagggcctgagggtgaggctgacctgtgggtgcccttggagggctgcccacttgctgagcctctagctcct

SEQ ID NO: 635 - DNA, 1493 bp, Homo sapiens
ccttccttagtacgtgcggcgggtgggtagagggaggcggcgcgggagcgggaggagcctggcgggcgctcggcagggcgctcccccagccctgtctcctccccctcttcctgcccccgactcccccgaccccgggcgcgcggcccacgccctgccctcgctcccggacccgcctcgcagaggcctcgcccgccccagacagagcgttcttgtaaacttctcttcagtagaaacggtcctgctctcgaatatttcagggcatccccaccctgagcctgcccttcctctcgggtttggttttagaaagtgtacaaatcaaagaacccggccgtcctgcgggtggggcacgctggcgcagaaccagaggtaaccggctctgcggccacctacgggtctaggaattacttgctggatgaccctgcagggagtggcacgtggagtcctatcgacctcagaggcactatcagattagccctaggaggtccgtctgggggtctcggcggcctgcgccagtggaggggcggcacctccccagaagccgggcttcccgccccaccggcccgcgaggtgccgcagggagggtgcggtttggcttgtcagcacccaggggcgtcacaaaccctttgttgaacaggggatttacccctttgtgtggcgtcacttgatcaatagttcagtttcagtgtggctaatagtgttaaaaactggccgggcgcggtggctcacgcctgtaatcccaacactttgggaggccgaggcgggcggatcacctcaggtcaggagttcaacaccagcttagccaacatggtgaaaccttgtctctactgatacaaaaattagccgggagtggtgatgcgcgcctgtaatcccaggagactgaggcatgagaatcgcttgaacctgggagacagaggttgcagtgagccgagatcgcaccactgcactccagcctgggtgacagagtgagactctgtctcaaaaaaaaaaaaaaaaaagaaaaaagaaaaaaagaaaagaaaaaggttaaaaactaagtttccaaggcagtatgctgtggtccttgaaaagtcctttagaagaattttctggaataaatttagagaaaacctaagtgtttcctaggggatgcttaccaactcctcgcccctcccccgcccgccctcttttattttaattgtgactcagggttaaatacaaactactagcagctgttggtggaaaagagcccaatcccaaactctggggttttcctttgttcccaagggaggccttgggaggaatgaatgatcctaaaggaatgagcagacctggggaatcctccaagtgccacctctgactaatattggctgttgccaggaaaacccaacttggatttcagctattactttccgtgcaaccctggtgctgactattcaaggggacagctcttcaagatcttcctgtatacagtacttcccagtccccaggtcacagtcaccagtggaggaaatctc

SEQ ID NO: 636 - DNA, 1485 bp, Homo sapiens
tttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaagg

SEQ ID NO: 637 - DNA, 1484 bp, Homo sapiens
acaaaaatttgcctgcatggtagcatgcgccttgtagtcccagctgctcaggaggctgaggcacgagaatcgcttgagcctgggaggcagaggttgcagtgagtcaagatcgtgcctctgtactacaatctgggcaacaaagtgagaccctgtctcaaaaaaatgaaacaaaaacccatgggccaggggactgtggcctagcccccttaaatactccagtcctgtggtcaacagcctccccattagcaagctctctaaatactaaggaagaagcatccgggaataaacacagaagccacaagatccacccactcagacaattaactagtctagagtctctcagtggggggaatttcctcgcattcttccttttctcctgctttcttttctttttccttccttttttccttcctttcctttcctttcgttcctcatgctctgtccctgcctttttcagttctcccttctcgggaggaagtaggctgctttgcagcatgcagagcggaagtcagatctcaggaaggacctccagtctgcagattgaaagaactcttgcacagctgggagagacagcacctgggccctcattccaggcagagatctgcctgcagcccccagggaaagtccactcacccacgggagcctgacgggctgagcatttttggaagtctttgggagctgctgtgtcacagcaggcagccagaacaatggggctctttctttccctgtgcaggagacaggcccacagacagggcctcacggctgggacaaaggccccagtgaggtcaggacagtgctgtgggagttgggggtgtgggggaggaatggggaggtaggtgtgtggtagagcagcctggaaggaaggaagctggagaccctggcagataagttggggctctctggaaggccatctcatcaggctgccaagcccctcggcaatgttcaagcccctaaatctcacccaggctgcgtctcttccctccatacacattctgatctccttcattcccaggaaactgaaaactctgcgaagggacccctgtttagacgtgggaaggaggctgagagcttaaccacacatgcaggggcttggcaggggcgagcacatcgttagattagtgctgtgccctggaggcagaggcagacacagatgtggcccctactccacatccccagagatggggctgacactctatgaggggccaattcctcctgcccaaggccaggataggacacacacacacacacacacacacacacacacacacggactgggccaggggttggactctgtgcaggacgctgagtcacccgtggaccagctccgccttccccaggaaacccaacaaagccaggagagggcttccgtttccgggccccgccagaacaccccagcaggtgtcagggacagggcagtattccagcttcagcctgtctacctctggagctctcctgatcaatacatcagagaagatgatggagcc

SEQ ID NO: 638 - DNA, 1476 bp, Homo sapiens
tggcaacccctctaaatattcctctagtgacttgtgctctacattctggctggatcagagccctcctgtggcaaaatattctaaagatgttaaaagagagagagagaaaaaaaaaggctcaactaataaatctattctaaacgactgagtcatttgttttgattacccgggtgattgccaaatgttaatttaaaactgaaataggccatgagctcactcccctaacaatgctgagtgtttgagctaatacggcttgataatgagggagccagatccactgccagtgctcatgttatatgataaacagacatttggagaagtatgcagaacatcttggcagttttcctttaactctaagggttgtaaatacaaagtagaatgtgttaccatgagccatttcataggaagttgactttatttttttagaattcagaactttgcttctaaaaaggtaactttgcctcttgattctcatttttttccctaacttaggcaccttggaagttgttttcaaccatatccagcctttgccgaatacatcctatctgccacacatccagcgtgaggtaagttttactaattgccacaaattcttacactgatctccaaccttctaagttgtggtattaggggcggcattgtacaaagggctttatttgtaccaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggta

SEQ ID NO: 639 - DNA, 1468 bp, Homo sapiens
actacattatgtgggacgtgggtggtgatgggttgggaagctactggaattaggaggagagcttgaaccagcttgagacaggtggaagtggaaaggaagggtattaaatacaggagactgcccagtatttagcatgtgattagctgaaagtgtggcattatgaaataaagacgttaagacaagttgatttgaacttagaaaagagtaaaaataatgagtttacttcgaggtgaaatccttatcttcatcattattatcaccattactagattccaaaggaatacctgcaatttaagaaactgcaaacgcacgaaactacataactggtaagtattttaatgcatttaattaaaaattttccttatgttgctttggagttagtttttaaaattcttttcgttcataatcaggaaaggtagtaaccttacattcagcgacaccttagaaacatacccttttaacgcagcacatttcaatacagattgtgctgttccttttccaaccaccaggtggcgggcaagcgcccaagtcgcactcccgcctcatccaaggcagcctgcgtggctcccgggagcgcgcacgtcccggagcccatgccgaccgcaggcgccgtatccgcgctcgtctagcagccccggttacgcggttgcacgtcggccccagccctgaggagccggaccgatgtggaaactgctgcccgccgcgggcccggcaggaggtaagggcagaagggaagcctcggggcctattttcccggtagcgactgcctcgggggagggcctgcgggtgattcctgcgtcgcgtccgttcctgcccggggacgctgcggaagcggtcgcagaagcggcgagtacgctgtatggcaagcgcatattcttcccgggcagcacggcggctgtgagctggaattcagcgcgggcggtggggtgattgcggcgccccctggtggcagtcctccgcgcccctcccctgactccccctccctcccagcctcacccccgcgccgttgcagcgctagggctggatggcctgcgggtaagcggcagcaggcgcctagtgggaacccccggcaggaagttagcatgggcggaccacacgggggccacacatgacttgtgaagaactactggacagtttggggaaatgactaccacgaaaaggcttactttcagttttgtttcagactccttttccacaatgtcatcagaacaatgggaaaagtcgattttttcccattcatttccagcggtgtgaaatgtgatcacatgttaattggttgcccgtggtgggtgtgaagggtcttgtcctcgggaagtttacatgatgattggcaaagatctatgtagagactaaatggactggcagggtaagagagtatggagagcgccaaactaaataaattttatactgtgaagactcacaggtcaaggcgtccctggagacctggctcttctggactccctactct

SEQ ID NO: 640 - DNA, 1446 bp, Homo sapiens
tgagtaggtgggattacaggcatgtgtcaccacgcccagcttattttgtatttttagtagagacggggtttctccatgttggtcaggctggtcttgaactcccgacctcaggtgatccgcctgcctctgcctcccaaagtgctgggaattacaggctaaggcagctgcttacagaggaataaccctatatcttaaaagtggtagttcgtgcatatttttatataaatttcacttgtacaaaatgtatacatatgtcttattttcaaaattttccttcaaaccaaaaaaatccattttcattcaaggctgccaccaagaaactttatattttaaattttatcaaaataagcaaagcactacatttgtcctcagagtagaactctcttattcatgttactcattttcaactacctctaacaaaaactttaatcagtgaatgatctgaatatgcatcagccagagtcacctcttctaaagcatattaacagtattgaataaaagtctgacatagttcagttaccttattagggttaatagccctccgactatcacctttaaacattaattacattaagtttgagaagacagacaattttgtcattcaactccaggtatatttctagtaacaatgtcagtaggaagaatccaccagaattcattgctatgcatgctattattttattctgttgtccgtgtgcttttaaagagtcagaatatttcttaagagaaaatattttaatttttttataatctgtaattataaatgtttatagaaaacaggaaactcctatacaaatattttaatttaacccgatcacaaagcattaccttgacattaacagattatatgtttctcttacaatttgtctaacaaagccttttggtttctgcagatcggattcctggcagctcgtacagacccagtgccttccttcctcttctaacagcattggctgctcccctttccagttccatgaagccaccatctacaactctgtcaacagctcaagctggaaaagaatcaccatccagctgcctgaccatgtctcctctaggtaggttgcaaattaaggtaaactttgtgaaattatctggcctctctacagagttcatgcagtgagctgaaaacaactgacagtgtgaggcagagctttacatgcagccctggtgccctctcccatcttccctccttttctccctcctctcaccaacccatgcccccaaatggcaactgcatgttccaggaggaaattggagtgtgtctgtaaatgattcagagatctcagatttcctttgacttaataccatagcatgtaccaaactcaatcacaggccctgaatgacagaccccaatccaagactggtgttggcaccagttctgccccagtgttctgccttcccaaaggctgcgcttctcatccagatacaaataccagctgggtgtgc

SEQ ID NO: 641 - DNA, 1414 bp, Homo sapiens
actaggagaaggagggaggctttcccttccccccagtgccccatgtaccaacgcgtctcgccataccccttgcccctcttccagcagctgacggagtaattcgagtaggaatcgaaagatttggaggcgccgggggagaaacctgcggagcgctctccgagcctgtggcgtcccaggaagactccgagcggggccagggaagttctctggaggacatggggtggatacccaggtctccttccctgggtgaaataagaactgaaaatctaaaaataaaataaataaaataaaatagaaaacacagagaagcaacaaaaaagcgcttcccctcctcagttctccccagtccacccaaggtttaccaagactgttgtagttgcaagagtgggcttccggctccacgtaacgatgcgattgggctgtacctctgtctgtctcctgcgcgatgtcccgccccgggaggtgtcacggaactcagctgatataagcccgggatcccgccgggtcaggttctctgctctggacttgggaggctccgttgcctgctcccggagggagacgcgctgccgaggagaacccagcgggtaatgaatcccccgcgcttctttgcccaggccttccccaaacctccccccggtctgcgcgggttctcctattgggctgtggtgaagacaaggtgcggcgactgcagctccccaggtctgggcgctgccgggagagagtctttcccgctggggagatttagtttgttgactcaggagcacctccaacgacagctagtggcagaggacccgggagctgggaggttcggaacgcggggcgagctggggaggagggagaggcgccgacccagcgcagcctacatcttagcaaaccaaacctggcaacatttccccacggttcaggagcacgaaggacttaagggaaaacgacgaaatcggggctcccgaggatgaagttaaatgggttgtggcctggggacaaatagggccaatgtccagtctattacaagaggctttgttccagaggcttgcctataagcccctggcttggaacgtcagtcttcaaactgtaacaacaggggcaggctactagggtagcccacaaagccctgtatcccccatacagtgactaactagagccctagttggtcatatccgcagtggctgagactgcggtgtgattccgtttccctcttgcatgtgtcccgggagcccgagttgtcgaagcccaaattcaggctcaggaacctgatgtgctgttgatgccaaacactgacacacagatgcttggagacagaggaagatttattccatttggccaaagcgagaaggcaagaggtcaagatctctcaaatccaccctaacaaaaagaagtagtggggagtttttatgagaccaggaagtaagggagg

SEQ ID NO: 642 - DNA, 1396 bp, Homo sapiens
agagctctttgtgtgatgggaagatgggataacaggctgttgttactgtactggtttttttttttaatatatttaaaaaaaagagtgtctcctaaagtgtaagcgctatcatgctggactaatgttttaatttaatttaattgttgtcttggtagagatggggtctcgctattttgctcacgcagatctcaaactcctgacgcccaggtacactcccatctcggcctcctaaaatggtgggatcacagacgtcagccaccgagcccggtcacttttttgtattccccacagtattgatgtatatcttctgcgttcaaaagcaattttttaaagcctcataacgtggtaacagaatactttgcacattacaaaattcagaacacggaaacaagaagctcgcttttttttcccccctatttcggtttggccctttagatttcccctcccccaccggggcgggacttcccgccgacttctttcaggttctcagttcggtccgccaactgtcgtataaaggcgctgcctcaggccagaggcctcacaaagcgttgggtgagactcctcttgctcgtcatgtctggccgcggcaaaggcgggaagggtcttggcaaaggcggcgctaagcgccaccgtaaagtactgcgcgacaatatccagggcatcaccaagccggccatccggcgccttgctcgccgcggcggcgtgaagcgcatctccggcctcatctacgaggagactcgcggggtgctgaaggtgttcctggagaacgtgatccgggacgccgtgacctatacagagcacgccaagcgcaagacggtcaccgccatggatgtggtctacgcgctcaagcgccagggccgcaccctctacggtttcggtggttgagcgtccctttctatcaataaaaggcccttttcagggccaccctactttctcagctgaagagtggtaacactgaggagtggttttggtaggtacggaattttgcttggttctgagtcagttctggggggaacagttttttgaacacagcggcacacgtgtggccattcacccggggtcactgtaggcaggactaattacgagatgtaatgtctaaacttgctcaaaattcgtaagcttgtttacgtaatggagaaaatactcgtacacagaatgtgcagtaccagaaacgtttatgtaacccccgtagtgagcttgacagtggtaatcggaaatcgtttttgaaaagcctccaaatccacaagtatttgtgggttttttttgtttcgtctttgtctgcgagttggagtgcagcggcgcgatctcggctcactgcaacttccgcctcctgggttcaagcgattctcctgcctcagcctgccgagtagctgggattacagttttgcgccactac

SEQ ID NO: 643 - DNA, 1394 bp, Homo sapiens
cagcctagcttctggtcactgttctttaatcctctgtatctggaaaatactccagttgtagatctatggaaggacatacgaaggtgatgggtggacccggagggccgccctgactgttatggcttactagggtaacagtgccgatgatggttagcactcagccagggctgctgcatctccgtcccgttctttgatcacaaaacatgcagtgtgaaatcacacggggtgttgtacgccggggttgctaccacctacttgagcattcagcgcttaggaccacgggaaaccaaaccaggagggttttcctgggcaccctccacccgacaccagccctaggggctgccctgactctaatgacctgcccctctcctggaactccccttccatcctgcaccgccccagggagtgcttgactgccttgcagctcatcaaaccctgctttaacagggtgggggaggggggctcaggagtcctttgcttttttctctttgccacttgccaaattctgaaatcaagttgagcaagcccacccacttcaggcctcactgagtcccgtctttcattcctgggttagagaaacactgcccgcaaggacagatctgtggaaacactaggtccctgtgactcaggtgccggaggatgcagtgtcagcagatgctgacgagatcagtcctgcaggagcatctttacgacagaacatgttattttccataagtggcctgtttaatgatcaaatcagtcaaatagctgtgctggtaggacttggggttaaaaatgaggcctaattgcagcttttttctccagcaccaattcatgagaatgcctgctcgctgaccccaggtgactgggcctcccacaaatgggtgttttgggtcacaaagggggcagggtcaaatccctcaggcaaagagtgactgaggtgtatgactcactgaccaggccgggactgcacggcattcgttcactaaagaagcctgctgtgtgccaggcatcatgctcagatgctgcccgagacacagcccctacccgaagagctcaaggacctttatggaaaatcattttgatacacacagggcttgggaccatctatgtgttcaactctttaaaaaatggttcccagccccagttctcttagcaaggctttctaattcattatctcatttaatctcgccatgagtcaggcagggcagtaacacatgggaaaggagggtgggggtggggatagtgtgacctgtccaccaggtcctgctacaaattgacagcagatcccaggcctcgtgttagcccaagctgcttctactgtcacattgcagccttctgcaaggatggggtggtactgtccttctcacttctcattctcttccattttaaaatgataaacctgggtcagagga

SEQ ID NO: 644 - DNA, 1194 bp, Homo sapiens
gtcttgctactccaagtgtggctgaagagccagtggcaccagcatcacctggaagcttctttagaaatgcagactcggccaggcgtggtggctcacacctgtaatcccagcacttcgcaaggccgagacaagcagattgcctgaggtcacgagttcaagaccagcctgaccgacatggggaaacctcgtctctactaaaaatacaaaaattagctgggcgtggtggtaggcacctgtaatccgagctactcaggaggctgaggcaggagaatcgcttgaacctgggaggcggaggttgcagtgagccgagatggggacttggcactccatccagcctgggcaacaagagcgaaactctgtctcaaaaaagaaaaataaaaactcttaggcccctgttccaacctacgtcagagctgcagtttaatgagatccccaggtgacttctatgcatgtggagctctgagaagccctgctccagaccagcatggtggttgaatattggaatcacctaaggagctttttaaaccactgatcccaccaccacggtttctattttcaaggtctggctccctaaatgattccaaatgtacagccaaggtggcaaagcactcgaaggcctcctattccccacgagaacctctgaaacagcagcaggtctgggtgctgctgatgcagaatgagtaccaagatctccctgaagcccaataaagccactgaccactcctgtaagtcaggagcagtgaactgaagccagctgttcggatctgggtgctataggtacccccgtgcacgttctcatcatgattgttcattgtgcatttcattaggtggaatccgtttaggaatctgtcatgggagatcaaaaaaacattaagcttggaataatccatgtctgcttgtttagcccatcagacaaatcatttgcaattaggtaggatcctcatgctgaagaagatagagaaagaaagcttgcacagaaaagttagaggcctcaagttgggaaagcaaacaaaccaaaagcagagaggagtcacccaaaggaagcagcacccagtgaacccctgccgtgagtcagcacgagggaggcccagccctttctaggggagcctgattaaagatcaggctcagctgctgctgctgctgctgctgcttgtcccaagaccaagtcgtaatagcaacttcccttcctcagct

SEQ ID NO: 645 - DNA, 1191 bp, Homo sapiens
atcagtcttaagtctcagcggggcctttttctaaacagacggtaaatgcaaaacctcccccagagcagctctgaaggcagcgcgtttctcttcctccgtggtgggaggaggctgggctttgagggcgggaagccctggtcgaggctggacccgcagcctggccctccccaggcgatggcagccccggctgacccacagcgctctgaagacaggtcctcggacacccgcccaggggcgcgttttcacctgcggagcaggggtgcggggaacagctgggaggtggggggggtcccaaccgcagctgagctggaagtgcagaatttcaactggcagcgagactgggcttcccagagccaggatgagccaggatgtgtggggttaccctgcccccattttccctccgcgtggagtggggcgagtgagcggctcacgcttggctctgaagctccctgggcacggggggctgtgactgggccaggcaggggcggctcttctggcggcagtgacagagctcacgctgcatcgctgtgccccggggaagacttcacagctatggatatttagggtccagttcagtgtgtcacacaccagaaactttaaatttttttctcaaatgttctactttagttggcaaagtataattcttaaaagtcatggcggagtattgggtgcaatcctcctggaggcaggaacgggcttagcaccggcaggttctggttggccctttgctgctgtgtgcgtgggtcccttcgtctctcctctctccctccaaggtgggatgtggtaccctgggagcacctgtgctgagtctctccttggtgtccaaggggctgggatggcccagggtgcacaggtgtccccgggcagcctgcagatgcttctcgacgacacggcccctttgagttcgaaggtcagatctggaagccacgttgccacacaacagcgacttcgcagcactgtcgccatgtgtcccgctctcttgccagggtccaggcagctgggaaacagcttggtttgctgagaagccacgtcctgggtgtccctgtcccagagccctcctcgctcccagcctgcaactggggcctggtcgggcgccctggcatgtttcctcctgctgcaggcgtgctcaggaagtgctgtgtgtgcatggcgcccgcgggcatggcctgtgtgctgggtgctgttttactt

SEQ ID NO: 646 - DNA, 1190 bp, Homo sapiens
aatctcagctcaccacaatctccacctcccaggttcaagcaaaattctcctgcctcagcctcccgagtagctgggattacaggcatgcgccaccatgcccggctaattttgtatttttagaagagacggggtttctccatgttggtcaggctggtctcaaactcccaacctcaggtgatctgcctgccttggcctcccaaggtgctggaattacagacatgagccaccgtgcccagcctaaaaaaaatttttttaaaaaatagctgagtgtggtggcacatgcctatagtcccagctacccaggaggctgaggtgggaggattgcttgagcccagcagatcaaggctgtagtgagccaagattgtgccactgcactccagcctgggcaactgagcgagaccctgtctcaaaaaaaaaagaaaaaggaaaaagaaaaagaaaaaaaaaggactaccaggtgttttttttttttttttttttttgagacggagtctcgctctgtcgcccaggctggagtgcagtggcgcaatctcggctcactgcaagctccgcctcccgagttctcgcctttctcccacctcagcctcccgagtagctgagactacaggcacccaccaccatgcctggctaatttttttgtatttttagtagagagggggtttcaccgtgttagccaggatggtcttgatctcctgacctcgtgatccgcctgacctcggccttccaaagtgctgggattacaggcacgagccaccgcgcccagcctggtgtccttatttcttgggaaaggatacagagggtcagagaggcgccccagcttgtgcaggaatgcattcctgagatctggcctggccgtggtcactggagtgtttactctgcttacagggtctggtgtagtgggggatggctgggtaggaacgtgcgggctataaagccagaccccaggtgtcagtgcggttcagaaagcaactagcacagccatgcccaggccaggacccgtgacacagcgatgctctcagatgctgctgatgttacagatgttgttgggggcaccctgagggggcaccctgactctgcaggtgagaaccttctggggttcctaggaccctcggacaagcactctgatccggatgactccaggtcccaggagttgcagaaacgccaccaggaccttcagagcaccagttaga

SEQ ID NO: 647 - DNA, 1181 bp, Homo sapiens
gcctcaggtgctaggattgtgtagaatcctgagtttctggaaccatctgcctgttgcaccaataccggctccctcccccacacccttcagcagctgctgaggctgaggtgccaaaaggaggggcccaggaatgcccctgtctgcaagtggtgccaggccccagcctctgggtgactcttggcaaggagcaggacggccgggagggacggtgtccctgcacatccccatgggcccctgcaagtccccgtgagtccgagcgtgtccccacgtgtccccgtgagtcccctagcgatccgggacgtccctgtgagtccctgtgtgtccctgcgaatacaggcgctgagctctgagtctctgttttgctttgattaggcctccatctcctagtccaggccttgctaccctcccccaggcctcaccctggaaacaccaccccctccctgttctgtgtcctgggaccccatctcctaggtgggcccccagcagccctcagaccaccctccgacgtgaggttctgtcagggaaccctgtgctactccaatgttgtccccagggcttactccctgagctgcctcccggctcagactggcccagccgctccccttggccggaaggagactgcatgggctgtgctgagctcagcctcctcctctttccgcttctgccaccctcccaccacccgcccacctgcgtctgtgctgggtttccctggcaggagctctgtgcacctgtccaggtgtgtctgctggaagctcccgctgctccctctgggcaggcacaggtgcacctgcaggcccagggaagaatgcagcacgccctccctccctgctgcccccaccctggctaaggaggtgaggggacctgcgcgggcagccgccctggctaaggaggtgaggggacctgcgcgggcagccgccctggctaaggaggtgaggggacacgcgtgtgcagccgtgggcagggctgtgggaggccccaggtggcctctcctggggtggggtgggggcggggctttcattcagcctctcttcctcccacagctcaagctctgggaaggccaggtctttgctcctctgcccagacgcagatgcaggtgcaccctgggtcctcctgtcctcgctgggtgttgagcggagacaggaggtgcctgcccaggtcccttgtcctgagagtgcctcctc

SEQ ID NO: 648 - DNA, 1168 bp, Homo sapiens
gtgactggacagatctgggttctctccatctctccgaaacccttgctggggatgagcgatctgcatttttcggtcctgacttttgggaaactctccagatccccccatcctgcaggccctgagaagagcagcccctccctactgcgcagttctccttgggaccctgtatgcaggagagagctgatactccgtgccccgtggcccatcccaccgcctgctggccctgctcccatcccctcagcttcctccctcctctgccctctcgtcatctctgaattctcaggccctgccctctctgtgcccttccctccacctgacagggtctggctcaaggtcactgcagtaattccatacccagctgcccagggctgctgctgctaccgccaccgccttatcggccgctgggtttctgttacactcccttttatttctgggcatatcgtgttcgataaaaccctttgcttgtaacactgctggcagcgctcccagctgctccctcccgcgttcccgcgttccttcctttcctcctcccttctctgcgcttgggcaggcttcttcctttcctcctcccttctctgcgcttgggcaggcttcttcctttcctcctcccttctctgtgcttgggcagcctcaccttgtcccctcaaactccagagaaggaaaatcaaggtgcctccccatgtttctggccccgcccttccccccagcccctgcaggggtgtgcagagaatgcccaccttctgtgagaaaggtccaggcagggccgctgggcccacaccgagagtcccctcccagaggctggtgcccccacacaggccaggccggagggccagggcagccaggtccaggtagggctctggtgcagtcacagtgcccgactggttctgctagttccagcggccagccggtaggggcgtgtgctgggcgggctttggtgcacattatttcccatcttgactctgccacccccagccacgggttggggaggtgaaggcaggtctgagtcactagcaagggggagggcaggagttaaacaagttgtggccgtggcattcccacagaaggcccacgacccgctggaaggaaagagatagcagacaaaaggtaggctgcgctgtgggccaggcactctccacctcgcccactcccacggtatcttattctctgg

SEQ ID NO: 649 - DNA, 1159 bp, Homo sapiens
gactggaggccctggaggtccgcagctgggctggtccgggtcctagggcgcccgcttcccagctgagcgcgcaggaggggccccaggcgccggggcggggtcgccgcctcactcaccttctgtgcttctcttcgcctcccggtagcgctcccacaggtagcgcttcatgtccggggcggtcccgggtgcagtgcacaagggccgggcggggcccgcacacggccgcccccgagccgcggtcccgcagccaccccgcaaagccgccgctgtcgctgccctcgccccggccccgcgtgccaccaccgccgccgctgccatggtcatgcctgctgcctgctgccgccaccgccgccgcgccgctctgcgactgctgctgcccggcccaagatctacccgcgctctgccctgcaggagggcagctcctgcgtcggaacacgtggcggcgcaggcctgccctcccgccgctgcggggcggggagtgggcggagccggaggcggggtctaacgggggcggggtcgatggggagtgggcgggtctgggacgggggcggagacggggcggggcggggccgggccgggggccccacgcccagcctgctgcggtcaatttcagggtggcgcgggggtggccgtgtggtgtggtggcgcgcaggccacatgggatggaatgatgaggtacgaccccagcgccgcccgcccagctccgccgcaccttcgtcctgccttctgggactgacccccagctctggccacaaggacagcgcccctcccaccccagctgctctggccccggccctagaaggtgacctctctccgcattaatggcctctggcagtctaattaatggcagtctggacctcccctggatcgtggggcccctctgagacgtccccgatccccagcttaaatttatccaggaggacctgtgagtgggtggctgggccgaggttccactcatgggctgatgtcggctggaggatcccagccccttaagacctcagtaagtttgaagggccctcccattacacagcctggaaggccaatgcccgccccccgcctaggtttccgcctggcggcagaggtcattggaacatggtcacccagctcctgcccctgcccacgctaacggctcggtgcacaggtcttctctcaaacctgc

SEQ ID NO: 650 - DNA, 1119 bp, Homo sapiens
tggtgctttcagacaaaacttcaccaggtttaaagagaaaactcctgactctacacgtccattcccagggcgagctcactgtctggcatcaagttccccatggtgagtttccctgtacaagagtccaaggggagaggtaagtttcctttattttgctggatgtagtttaatattacctgaggtgaggtaaggtaaggcaaagggtgggaggcagggagtccagttcagggacggggattccaggaggagaagtgaaggggaaggggctgggcgcagccttggggtctctccctggtttccacagacagatccttgtccaggactcaggcacacagtgtgacaaagatgcttggtgtaggagaagagggatcaggacgaagtcccaggtcccgggcggggctctcagggtctcaggctccaagggccgtgtctgcattggggaggcgccgcgttggggattctccactcccctgagtttcacttctcccaacctgcgtcgggtccttcttcctgaatactcatgacgcgtccccaattcccactcccattgggtgtcgggttctagagaagccaatcagcgtctccgcagtcccggttctaaagtccccagtcacccacccggactcacattctccccagaggccgagatgcgggtcatggcgccccgagccctcctcctgctgctctcgggaggcctggccctgaccgagacctgggcctgtgagtgcggggttgggagggaagcggcctctgcggagaggagcgaggggccctcccggcgagggcgcaggacccggggagccgcgcagggaggtgggtcgggcgggtctcagcccctcctcgcccccaggctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggac

SEQ ID NO: 651 - DNA, 1107 bp, Homo sapiens
gactcagggagttcaaaggaagctggggtgcaccccgtcctacccagcctgccaatggaagcagcagcccttaactctttcctggttgtgccctgggcaacatccaggtggtggtccatgctggagaggggtctgcgcctcctcagaagatgaaatgggtggggtgaccctggctatagctgggaagtgcaaccagacacccaagagtggggaaactgagcgagagcctcctgtgctccctgaccccagatctcccttgggattccctcctcctgcgtggcggtccctggagaaccctggcttctgggtggatgcaggggcgctgggattggatttctggcatgatgaatattcatcagcttgagccggcctctgcttctgtttacttagccgggaggggctgggtttcaggttcaccttgactccaggagctgcagcagagcaggtaacagctcttgcacctgtttctcttgcacctgacgtgcagctgctcctacccacctctcctggctgagccttgcctgatacagcagcccggaggcaccacttgcttcccgagtctcaccctcccaggcagctcctacactcaactgcttctctaggaaaggtctcacctccagcctggagcagtcgggattacaggtacaggcagagggctggtgggtggggaaaccaaggcatagaccccagtcagagcacctggttctgcctccagggctgacaagcccagcaggaaagaggaacccaggcctctaacctggtctccactcaagactcatcccactggcctcttggagtcaatccaggcctccaacagagctcctgctgagtagttttctgttaacccttgctgaactggagcccacccttctgaccccccagtctggagcatttttccagctgtctggtaggaacatctccccattcctatccagggtacccctgtctcatcctgcaggccccctaagtgccattggggccctgcagagggatgggggagggagttctggggttttgtcttacaacatattagctgacttgcttcccctatctgtccccctgcccctccacctctgccccagtcaatggttaacttgacccagctca

SEQ ID NO: 652 - DNA, 1104 bp, Homo sapiens
cagagcatatctctcccctgctacctgggagcccatagctggacctgggtgagcactgggttttaaatttttttaattaaatgagaagatgaacgagagatggctttacagtaacacactccagattcttactcatcccagccaggaaaacagtttcaatattgctttctttcacaagacttcccatgatgtactgaaggagtagtggaagtggaagagacaaggagatgttcttctccactggacaaggccacatgcaggggtgggaaaaacactggcatggaagctgcaggtgacttgtagcaagtcacaatccttcctgagctctgcatgcccatctgtcctgtgggagtcccttgtcctggtccctttggttgctgggagcctcacagagtcatgcttacagtttgaaaattgtcaagcctaggtgtaaggtcgcatttttctgtttgggccagtgccttatgcttctgataggagcagcagagggaagaggcataagatgagcatgaatacagttggtgtctgcctgcctttgtcccagcaggctcttccgacacatcttgggtcttgctgcagctgtcgctcccccaggggaataatctgggagggtgcagtgagagatctggaaaaaatatcctcaaactccctggccttatgccctgtccacctaagaattcaccatcctggagtggccctactcctaagcagagtggctttcccctcactacactttgtccctcaccctggcacagacactgtgtggtgggagaactgatgctgggaaaagtactgttgcctggcccctcctcctggggccagttggcagccacagacactgtttgacacgtttcccctcccacccgctgcacacagcagatcctgcccagaaggacacaatgcttggcaagttctaccacttccagcgtttggcagagctgtaccatggttaccatgccatccatcgccacacggtaaggtggctgggtcaccagcacctgagggtaccatctcctgagctaggggtcccgggcatatctaaagagcagcagactggatggaatgtaacccactggtcacagtgaactgctgaggaatcttggt

SEQ ID NO: 653 - DNA, 1067 bp, Homo sapiens
tggtagagatggggtctcattgtgttgcccaggctggtcttgaactcctgggctcaaatgatcctcctacctcagcttcccacagtgctaggattacaggcgtgagccacagcacctggcaacacattttgaaaataatattgtttcttaataagcagatcttactttctgccatccctaacattcctagtcaagaaaaaaaaaatggcttcaactttttgtccaaagctttcaggatatattcctaaagaaatctcagtaatatttcttctggcctttttgagagcaagatttgaagggatttttgtcgtactcttttaaaaaagcaaatgagggatggctctcttcagtgacaagccaaactatgaaaacatccagacccacaatccttcctgtgccagtgtcaggctgcccctaaggacagggaagtcctggggagaaagcgttttgcccagatgaacacgtgaactcaacattcgtgtgcatgcttccggtgagttgagaaatctagatgacccgaaaagattttcttgcaaagcaatatccctcaaaaccccattgcataatggcttttgttttaaacctttttgagtaagggatctttttgccgagtggctaggcgttctccaaacaaaacccccaaccctcacaggtacagcctgttttgctgtctgctctccaactccctcctgtgacttgaaggaggagatttgatagcccagggtgatgtttcaacctcctgtggccactccacccttaggtgggtgcctagtcatgccagaaaaaaaaaaaaaaaagccgggggaagaaaaagggcaggcgggcctaggtgaagtcatccaatgaaggttactggctgagcggggacaccttctcacaggactggagagagaatgcggggcagctgggcagggctcacttccagccgcctgtcacagtactgggagtaagaggtgacctatttatttttagaagggggcagtgataataacccagctcctagcttcattcaagggaggcaggcgctttggaagtttgtaaacaccaactttctgagtaagggagga

SEQ ID NO: 654 - DNA, 838 bp, Homo sapiens
tacacagattgccctcaaagtcatatttccaactgctcatcaatctaaaaatccaaaattttgaataattttttgatgaaataatttatttcattgtttctcaattttggctgcacagtggaaccacctgggctgtttgaaaaaacctaggcctagccaggcacggtggctcatgcctgtaatcccagcacttagggagaccagcctggccaacatggtgaaaccctgtctctgctaaaaatacaaaatcacctgggcgtagttgtgcattcctgtaatcccagccacgccagaagctgaggcagaatcgttcgaatccaggaagtggaggctgcagtgagttgagatcttgccattgcactccagcctgggcaacaagagcgaaactccatctcaaggaaaaacaacaacaacaacaacaaaatcctgggctctgcttcagactagttaaaccagaatctccagggtggggcaccggaaagaacaagaaaaaagaacaccttatttttatcttcttcagtgagccaatgttcattcaaaagagagattaaagtgctttttgctgactagtcacagtcagagtcagaatcacaggtggattagtagggagtgttataaaagccttgaagtgaaagcccgcagttgtcttactaagaagagaagccttcaatggatccagctgtggctctggtgctctgtctctcctgtttgtttctcctttcactctggaggcagagctctggaagagggaggctcccgtctggccccactcctctcccgattattggaaatatcctgcagttagatgttaaggacatgagcaaatccttaaccaatg

SEQ ID NO: 655 - DNA, 2764 bp, Homo sapiens
gggttgtgcagcctaaataatgaagaaagcagcgaaagcttattttgattttgtggtgatggggagccatgggagggtttacggaacgttgggatgatgtttatattctagaaggagctttctggcagccctcgggagagggaatcggggagtgtgtgagggaggcagggaggccgggtaaggcctgagtggtgagaacctctgtgaagccaagggctctagtgctgcagaggagagagaagaggaggcacggttcccagagtgacgggagcacagggagggctgggcagagccgccccagcctcctgacccgggctgtgcaatgctggggagacggaaggaggcaatcctggaggagcccttgctgacagccccaagttgggtcgagggccttggttttggttgccgggcagaatggcagcactgagcagagccatctccgctgcacacacacacacactcgtacccgtgcttgtgtccgccccactgcaggcactcacttgtacacacctgtgtgtggttgtgtttttcttctcgtgatgctcacagaatgtacatggagacagattcgcacactgaggtgacgaggcagagatggaagcctaggcctgcccttggtgtggttccctcatggctgctgaggggagccttagagaaggccgctccctgtgcgggcctggagctccggagcagccaccagggacgggagcctgggagccgtcagccctcgaggaaggcctgggagccgtcagccctcgggtggccctcggatggccctcggaagccatgtggagtcacgggcacgcaggaggcaggagaggccattctccccttgcccagggtggagggtgaagggcggggcagctgtggaggagggaggctgggagttgctccagctgtggtgtctgccacctgcctgtgcttttagaggcttattctttcagggacgctttagctacagagtactattttttgtcttttcttcagtgaaaatagcgacccgtggcgtatccactccgcacaggtgtttggctttcccagagggcctcgaggggacgccgaaggctgtcatttggggctgtctgcccaactctgagccagcctgtctctagggtgctcagaacatggcaccctgaggcatagacatcatgtagatccgcaccatagacggggctgtagagaagccagtctggcacttttgtgggggatgtttgtggctgaattacacctttgggcatctgtggtttccttttggacacagagaactcagcgtgtgttgtcatttattttcatgtcatggtttagactaaaaaggtttccattttctggttgggcacagaaaggccccggatcacctccgagccccaggacgcagatgtgacctcggggaacaccgtgtacttcacctgcagagccgaaggcaaccccaagcctgagatcatctggctgcgaaacaagtgagttggggccaaacagaaatgcccctgtgcatctctcggagttacactcagacacccaaaccacacctcactccccaccaaggcccacgtccacttttcctcctccacgtagggaaaagtacaaaggagaaactatttctgctccttttccggtcttacatggcagggggtgtgacgacgtttctgccaggctggggccccttccccactctctcctgggcagcacaggggtgccctggctgggcaacgcgtcactgcggcccttcccggtgggagggagggagagcatgctggttgttctctccctgcctgctgacgtctggcagcagcctgtttgctctggtcactgttgttggcagccttgacctggggcattgtgaccaacctgagtgggtgcgggaggggccctgacctctgctgggacggcgtcctcaggagcctggagcgccatgcagctgctgacacaggttcgctcagctcccgtgtggatctaacttgtctcccaaacaaaggaagtcttctcttgtgtccacaaacatgctgtggacctgttaaggctaagacggccctggctgcggctgtcagggtgacggagggaagtcctaccgctgaccattacatgcgtcctggcagcgagccccacctgtgagccaggtgtggggagcacccctgcgctgctggggtttgtgagctggggctgtgttggttaaggagtgatggagtctagggggaagagatgggaggaggtgaaaggcgtgcaaggggggtgggtggggcaggacctgggtgcaggggcagagaggcctaggtgggaatgaggtcagattgccggaaggcacctggggccaaatcactgagggtcctaagttggagtggagcactttcaaagtgaccttttgaaaggaatccttaaaagaaaatcctgaagtaaagccaccatgtcctaccttctcccatctgcctgcgtgaggacagcttctgaaggagctcctcctgccggcccagccccagcactcctgcgctgctcctctctggccatgtttagtcatgaggcagcaagagggatgcgtctgagatgtgagccctgtgatactcgggctcaaactgagtcattgtttgatactcgggctcaaactgtgatgaggcacaaactgagtcattgttccagactccagaggcaaaccgggctgggcttggctctcgggcaaggtggtgtttatagaagagatggacaggagcagggagctggccatccccagtggtcaggaacagaatgggaagatgtgttcatgctgaagaggaca

SEQ ID NO: 656 - DNA, 2712 bp, Homo sapiens
tgagcccatcatccatctaaagtctctccaaatactggtcagatggaggtttccacagctgccattctaaatgacaggacatgtgaccgagtctggagccccatcccagctacccctcagccttccttccagccaaggacaacccactctgcccagagaggccacattgccctccagccaagggaccccctcctttccgccctaggaaagaagttctgtcctctatccccaaggagactgcatatccttcaccacctccactgaagtttctaatgttagatggtccttctcttcacagcacctgcccaagtctgtgtttagatgcctcgagcctgatccttccaactaacatagaaatgccaaggcccggcatacttccctggccatcctacacccttgttgaaagccggagtctcatggacttaaaagttcttcaaaaatgaagccagctagcttctacccccatgccacagcagccctgcacagattagtaagcccactgtgactctgcttagtccaccctcctgcccatccgcactgatcaccaaccactaagccctgcctgcgggagtccaaggaactcactaggtctctgactcaacctctagtgaagagggggtttcccaggagtgaagtacctatgagggttactgccccttctttctggattttggctctgaaagtgtggaataagagagtgcacagtgactcttccacttctcaatccaagagaactccatacagttctgttctattccaatgacctctgatcagaaggaaaatggctattgcaataacatagcactgagagattctgaaagaatcaagccaggcccttttggagatcaaagctttcaggaattaatgctcaggtaattcacggagaaaatgatgtgtgggtaatttctggaatcttttcacctgggcagacacatgactcccaccagagctctcccacctgttgctttgggtgccagccagaaagcattgtccccgcccgggctggattctagccttgggtcaaacgggctacagtgccaatgaagatggtactcagcgaccttggttcaccagcagaacctgagaaaccctcttctacctgaaaggaggagcagccccttgagggcagcacctgccagtgagtgtggagccaggccaccctgtccttacaaaactcttgcaatgtttgatagagagtagacatccgagggtataaagtacttttcctgtgcatcttctcaattcccaggtagtctcagtgagctcgaactattcacccagaaaagacagtatgaactagctttaccctgggcccctgaccaggcctggtggtggcagctccaactccatgcagacaggagctgggctgccctacctggagaagctagccacctactctgcccaggaatgtcttgggtgtccccagaaggcctgctccttccaaagttgaaagcaatggtgatctgctgaagacactggaactccgcaggaaactgctgagcaaaggaggcaaggaaaaggatattcttggaatatccagaaaaccaagtcgggagggagatgcttaagggaagagaaggggctatctcctagggagtggtctagaatcttcccatcactgacacccaacttctgcccattatcggaggtgcatctgtcccttggtgagggacaggtaaggaggactccagcagagcctcagcaaacaagagctgtctgcctgctgcaggggagggtgtatgtgtgacagggagggttggagaaggggctgccttccaccacttgtagtcctaggaatccatggacacccttattgtggctgcgggccagtgttccaggggcccttgtcctggggtgggaggaaggagctgtgaagatgccagcctactagggacaggggtaggaccaggtgtgcagcctggaacaagggacagagggaggaagcagcaccatcagcactttttccttaacacctgggtgtgggtttgggtgtgcatttcttaggcaaagaggcatctcagtgcatgttttaagctgccatctcctccttttaagcctcctagttaatatctgctatgtgaattatttactgggaacagatgttagagtttaaagagcactgagcagagatctttggctaatcaatttattttaacaggtttaagtctttactacacacccaattggagatttccctgccactggaagcctgtgctcctacaagcctgtgttacacatatttccagctcgccccaagcttgtttcctgctctttagcccctccccatcctggccaaagtgcctccttctcttggtatcctatttgatctgcagaagtctaatttgacctggagaaagaatttttcctcctaacatcagtcctcaggttggactaaatggtcactcagtgagatctggccatgtccttctaggctttgagtcatgtttgctgaagccatgccagtaaaatatttctgggattgagaagaagtcagcctgacattttaaacaaacaagggctgcaagactaaaagacccatctctgcctctccccaggggcgtttctcacggggtgggtagggagggcttcgaagcagcctgtgaagtgtgggcagcttgaaacacacgaggcagcaaatccgaacaggcaaaggcctcactctccagtgcagtctgggaggactgatcagggaagaacagatcagggtgaaga

SEQ ID NO: 657 - DNA, 2702 bp, Homo sapiens
gtgtcattgctagaccaaagcctggccttcctggtcattcatgcaaccaggacctctggggtccttcccttggtcaggctgtgctgggagcagtgggaaccagggatgtccctgagttacgtcttgtagggaggacggacagtcacacagacaaatggggcatgaaaaggcatgacaaatggggctcggccacacaaatgcacaatgtggccaagcctttcccagacagctggtcagggagctccagaggctttcctgaggaaggggagctgtcgctggcacctgaaggtcctgtagagagacgagggaagaagcatctagacaaaggccctgggtgggaggtcagtgttgacggagcagagagggagccaggcgccatctcagggaaccctcagtgggattctctccactaggatctggtgccatagcaggaagaaccctgtcgcatgtgggcaggaacgagctgctggctcccatcagctacttggcagtcacacgccaccctccctcccacagagtcttccgaggagtggccagaagctcaaacacagccgtgtccctctgtgcgtgagccagggactcaggcctcagacagggctctcccttgtagtgagcagagtggccctggcccttatttgaggtggtcacctgggcgctgctactgctaccactccagggctgcttcgcggagccactgtctttgggctttagctcccaccactccttcccagcaggcgtgggttcttagacttcagtggaccacctttaactggaaagcgtgcttccttcccaacagaacaagcggaccaacttgaagaagcccaactcggagcggacggggcacgggctgagagtccggtttaaccccctggcactgctcctagacgcgtctctggaaggagagttcgatctggtgcagaggatcatctatgaggtgagctgcagccggggaccagtgcacgctgctgggggcgaggggatgggcgctcacaggccgtgtgtcctaggtggaagatcccagcaagcccaacgacgaagggatcaccccactgcacaacgccgtctgcgccggccaccatcacatcgtgaagttcctgctggattttggtgtcaacgtgaatgctgctgatagtgatggatggtgaggcccgtaggagtgtggggtggacagatttactttccctgctttgcataaggaaaacaggcgtgttctagacaattaggaagcacggaagagagaattagagcaagaacacccatcatttcatccttgaaagacagctgttgccagggtttccttgcctttttttccagccttttctcttgatgattttgttaaaaacgtggctgtggttatgctctttctgtgcctcgtcattaacattgcagtctaagcattctgtgaatcattccatcttccccttctcatatgttccgtatggactcttcacactctgtgctccgtgtgaaaagcagcctcagcatccccctgggtcaggcatgtaggttgtcgcattgttcattccgtttgccttcgggagctctgctgctgggcgaggcgtgttggtctcctgtgggggttattttgaactttcagacagctgacattgtgctgcatttgaatcgtggtaaaatacacataacataaaatttcacatcttagctatttttaaatgtgtgtttcagtgtgttatgtacattcacatcaccatgcagtgtggcgtgaacatctgtggattggccatttcttaacccattccctgtgcccccttttcaaaatgtatgtatggtctgaaacaattggctcatggaaatcctgcctttaaagaaacaacactgagacttgatggcacaaaggtgaacgccttccgcgagattccttagagggaaatctctgagggccacgtcctacaggacaggcagtgccaggcctgcaccttcacccacgctctattccaggacgccgctgcactgcgctgcctcttgtaacagcgttcacctctgcaaacagctggtggagagtggtgccgccatttttgcctcaaccataagcgacattgaaactgctgcagacaagtgtgaggagatggaggaaggctacatccagtgctcccagtttctatatggtacgcaggggaggcctggggccacagtggtgctgtctgctgtggtactgccatggcaacagtcagccggtgccagagaagcttcagcacagctttctgtttgttttttttaagacaggagacaaggtctcattctgtcacccaggctggagtgcaatgtcgcaatcatggctcactgcagcctcgacctcccgggctcaattgatcctcccacttcagcctcccaagtagctgggactacaggcttgtcccaccacagccagctaattttttgtactttttttttttttttgtagagacagtgtttcgccatgttgcccagggtggtctcgaacttctgggctccagcgatctgcccactttcagcctcctaaagtgctgggatcacaggtgtgagccaccgtgcctggcagcacagcattctcgagctgttccaccttcttcaggggcagccaggatgtctcactcgagtgaaggtcacactgccccttgttttcattcctgaaaacatgtttgaaagtccatgttgttagaaggattctgtgccagattcccaagaaaacaaaatgacttggc

SEQ ID NO: 658 - DNA, 2697 bp, Homo sapiens
atgtgcaggtggggaaacttagggccgaagaggcggtgcagcttgcccagggccacacggcccccgagctgggctgtgagcccagacccctcgccctggagccctcactcgcaccctggcactcagtttccccctgagtgcagggcctggggctcggtcagagcccgtgtctgaactctacccgcctccacagacggactacttccaccttttcatctgcgtggccatcgtggccatctacggggatgacgtcatcgagcagcagctggccacggaccagatgctcctgcacttcggaaacctggccatgcacatgaacggggagctcgttctccggaaggtgaggctgccccagatgtgggccccaccccgccccgcccccaaagccccaccccaccagctcgttctcagaaaggtgaggctgccccagatgtgggccccgcccccagagccccatccccaccatggccccccagcacgtgccctcccccacccatagcactgggggctccccactaaggcctcgtggtcagcacctgtctcggcctggctgtgtcacctcactttcctggggtgccagccctgacacaggagcctccctcgctggctgaggagggaacgaattcaccggggctgacggacaggacaggttccctaccctggggtacctcgcttacaacccagaactgggaacactgagaaggaggctggacctggggacagggtggccagaatactggggaccttgggctttggccccctcccccacttcccagacgcctcctggagatgctgcccgttagctctctggtggtcctcagggcactgagcgggggtcccgaggtcggtggtgtcctctggcacaggacacagatcctgcaggagctgagaggctgctgggggtggggggtggagcaaggtgcgggggaagaagagaggggtgctgccaaagggacaggtgggcttggctggacgccacccggccctgtgctggtgttggtcctgttcaccctcctgaatgaagcccattcaagggccttgttcacctcgagccacctgtgagcacagcccgagtgccttgtgggtcccatcactgcagccacctaagacccagggccccgtggtgccggtgatggtgggagatgcaggcagagccctcagtccaggactcggtgagcccccgaggtgcaggccgttgttgctgctgttgctgtctttggccactcccatggggaccctaggctgccaggctgtcccccggcccctcctcaccccccgtcctctgtctgcaggcgaggagtttgctgtaccagttccgcctcctgccccggatcccctgcagcctgcacgatctgtgtaagctgtgcgggtcaggcatgtgggacagcggctccatgcccgcggtggagtgcaccggccaccatcccggctcggagagctgtccctacgggggcacggtggagatgccttcccccaagtccctgagggaaggcaagaagggcccaaagacgccgcaggacggcttcggcttccgcagataggtcgggcccccgacaccggacaggggttgaggggacctcctcagaggccctgggcacgggagggggtggggctgggcgtgaaggggacaggggacggtagaaacctaaggaaaatgcttttgggcaacatgagaggaaccttttcatattaatgacaaaattagagtctggaagtgacagaagtcagatctacagccacccagaggaaagtcagctcctgaaacgctgcagtggaacgcgcagccaccgcacctgagacgcaggctggctgggctctcctgctggctgccctggaggatttcaacatgtcccaggatttgctccaccctcgagggcagccagacagcgtcgccaggcaatgaggaaagcagagacaggagaggaaggcctcactcacccactgcgtcgagggctgcagaacacagcggggtcctgtccaggcccagggacatctttgcaagccagacacacttcctcttgagacctcgttctctcggagtgagccaaacacacttcccaaaacgtccccagccacagctgggatgccgatggaaaggcatctgccataaaagaaaagcaaaagataaaaagcccaaccgatgtggggatagagaggcggaagagcagtcaggcttgaggagctggcgcttgtaatgtttatccgtttaaacatttcgtcctcctggtacacgaagggaactgtctgcccaggagcctgagcctcaggctgttggagaagcatctgatgcctttttctttgctgggggtcttctacgtgaggttccttggcgttgtttaaggtcaactccaccaaatacagcaaccagctggggcttgaatgggtcgatgtgtgcgtgtgtccctgcgtgcatgcatgcatgcacacgtgcgtgcgtgtttgtgtttgcaagatcctctgacaatgatctgctttgtcccagggacgtggtagtgtattagctgaccaaccaagacaaggacacctggaaatagttagactcttccacttcccttcaggacctgtgaactcagatatgtaagtcagcttctcaggtggtcggacgtgagagcgaccacagtgaaggagccagcactcagggctctctgccttctatgtgggaatgaggtcttcccaacagactctccctcttccaaa

SEQ ID NO: 659 - DNA, 2595 bp, Homo sapiens
tgtgatcctttggaggagaagaggcactctggtttttagaattttcagctcttctgctctggtttctccccatctttgtggttttatctacttttggtctttgatgatggtgacctacagatggggttttggtgtggatctcctttttgttgatgttgatgctattcctttctgtttgttagttttccttctaacagtcagaaccctcagctgcaggtctgttggagtttgctggaggtccactccagaccctgtttgtctgggtatcaccagcggaggctgcagaacagcaaatattgcagaacagcaaatgtcactgcctgatccttcctctggaagcttagtctcagaggggcacctggctgtatgaggtgtcagttggcccctactgggaggtgtctcccagttagggggcatcagggacccacttaagaaggcagtctgtctgttctcagatctcaaactctgtgctgggagatccactgctctcttcaaagctgtcagacagggacctttaagtctgcagaagtttctgctgccttttgtccagctatgccctgcccctggaggtggagtctacagaggcaggcaggccttgttgagctgcggtgggctccacccagttcgagcttccaggctgctttgtttacctactgaagtctcagcaataggggacacccctcccccagccttgctgctgcctcgcagttctatttcggactgctgtgctagcagtgagtaaggctccatgggcatgggacccgccaagccatgtgtgggatataatctcctggtgtgccatttgctaagaccattggaaaagcacagtattggggtggagtgtcccgattttctaggtaccgtccgtcatggcttcccttggctaggaaagagaattccccaaccccttgcacttcccgggcaaggtgatgccctgcccttcttcagctcacattccatgagctgcacccactgtccaaccagtcccagtgagaagaacctggtgcctcagttggaaatgcagaaatcacccgtcttctgcattgctcatgctgggagctgtagactggagctgttcctattcggccatcttgggatatcaagaataaatgtattctgaagggtaattatttggtctcctgatagactctaagccctgatgatatgaatgtattatcatcttcttacatctttgtactgcctaactcaagggtagtctacactttcctctattatcctacatcacatttattactcttgagttgcttagaatttagattccatttccaccagtttattaatgtctttaaaattgctcatactcacaaagaaccattagtatttcttttgttcctctttctttctttctttcttttttctaaatgtgtaagctctccatattgtttagttctggttttttctcctgattggataaaaacagctaatatttaaagaccattcactatgtgccagatattgcactaaaatcatcattagatgctactttgagttctttcccagcccagatgagagcaaggggccctctaggtttggctgaggcagttaaactgattcactttcccttgaaaccaattccaggtgtagttccataatataaaaaagaacagaggagcttgcttccacaaggaaaatcatttcaattattcatattagatgtgttgtttactacagaatcacatttggaaattatatgagaaaggaacgtctttcataacaaagtatatgcccttgactgttattaatatttgcctctttttttccccttcagctcagtgtgaagtggatttttggtcatcaggcaaagaaatacttttggcttgagttatctacttatctgtccaactggtaatattaaccaagcaattatctttgtgttgtgtagacctgacttaaaaatactttaagaagcatcatgaaaagttttgctattccactgatagagggaaatttattagaggaattcaaagaccacaaatatggaaggtgtaaaaatgataacaaaagacttttcttgtgtgtccacttcagtgtgcccaaggtttgaattggaagaaagtagagacagaaggggtgaattgacattctacccaaagacatgtggggcttattccaggataatattttaactcagcgtttcatcttctgccctctcttgcctccaagtttcagaattctccgtcttctttcttccttttatctttctcccatcttccttttccctttcctccattttgcttttcactgtcactgaagtcagagcagagccagagtgttatgacaataggctagaaagagagaagagagatacaccggtgtttttattccaactctatatcttttttcactctcccttccagcaagtgttgaatgttaactatggaaaagacacacatacacacacacacacacacacacacacacacacacacacatgcacagccttattctgtgccagagcagaactctgaaaattgctgccaagtggccgtcacccaagagaccatagaattcctggcaccaggcagaatctgtggctgtggccaagtgattgttgctgaacttacctgtgtcgaa

SEQ ID NO: 660 - DNA, 2586 bp, Homo sapiens
cacagcataactttgcatgcttcttactcttgtttttaattacctctttatttcttggtattttcctgtggttttttttttgttttttttgtttttttttgttttatgtaaggtctcatgctgtcacccaggttgaagtagattggtgccctcatggctcaatgtggccctgaattcctgggccgaaccaaccacctcagcctcctaagtagctaggactacaggtgcacaccactgcaaccagttagttttttattttgtgtagagatggtgtcttgctatgttgccaagtctgatattgaactcacggcttcaatgatcctcctggtgtggccttccaaagtgttgggattacaggtgtgagccatcgtgcccagccttcctttctttattgtgagtcagctaggcatttaaaataatttttgttatattttatctagcatgtctaggtatttgaagagttggaattttcaggttgtcatcatttgccattttgccagaaccaggaccttgttacaagctcatggtaaaaggttcaaataatatacaaggacatatgatgaaacgttagtgtccttatcctcttagatctgcctaggcctcaaatcaccttgtcagtaacaacaacctttatcattttcttaggcatggttctagaagtactttttgcatatacagcatatgtatgtgcacatacgtaatacatgaagatgttttgtgcaagcagaaatatgttttactatctgcactgtacttagcaatgtattgaggagctcagtgcatactggtgcacttagttcttcctcttctttctcatgactgtatagtattctatcatatggatgtatcataatttactaacgtcctgtattattggataattatgttttcagttattttgatcttataaactatcctacaataaacattcctttacatatgtctttgcttgtatatcatttagcataattcacttcgtctgtttccttctctcccctcctccgcctgccaccactatgggttacttgtggtcaaggactttatctttcattgatgatcctagtacctggcatggggcctggcactgagctggcacttaactcacgtttgtttcattaataactgtgctcactacaaagtcagatcagcagtcagactcagtccaaatctccagcaaatgtattttaattgcagtgataacaacagctattgactgttcagttgtccgaggttattgactgagtgcctcctctggactaaacatgagctcatgcaatctttactacaaccctatgagatggtaaatttcatgatcatgctttacagacaaggaaactaaaatgcaggttacctacctgtaagagggagagtccatatatgaacacagttttgtgtgaaattaatgcctggccttttgactactctcttaattaacaattgtactggcatagccaacatgggacatatttccattgttcattcttttgtgtattcattcattcaatcaataaacaaacatttactgagagctcacgacgttccaggtagggagtgatatgtcttgataaaaacattcctacctaggtagaatttacagtgtaaagggagtgacagattaagcaaaaaagtgaaaatgtgatgagtggctgaaaagagacataagcaaaggctttaggagcaccaagagcagagagccacgaaggcctccagtgtctgtgataaactggatgagccttgaaggacagcagtgggttgaggggggcacaggaggggtgaagcctaggattccagcatgccccctgttccttgtgtgcgtggcacagtcgaatctttctcttccagccactgccagctctcaggacctctggtgtgagggccagagagcctgtgtccttctgcttttgaaaggtggctcagcactccattagccctttctaattttaaagtagtagctcccttgattgaaatctcaatttgggaacaggcctaggattggcctgtggctcgagattttcaccaataagctgagtgggaggtggggaggtgtccctttaagcagccgggaggcagcccagagagcttggagctcctctccccaggacctgagcgattttcctggatccggagctgcgcacagagcagctgccgccccaggaatgttacctgccttgtgcggagcccctgcagggcccccttcggctccgggcagttggctgccgacgccccgctgggttccttagctgcggccgctacccctgcccctgggtctccaaccccctttccccggctcccccgcagtttcccgggccggcagaggcgccgcagcgtcggagcaatgcaaggctaagccgggtaagtggcccccccatagccggggagcacagagggcggcgcaggggcatgtttgctcctggtttcaggagctcccctgaaaaaggggccttgcagctggaaactaagctctgggagagatgcgctttgccacccagacgctgggaagtcaggagccccgcggtggggacctggtgaactgagggtctgagtgtcagccacctttcgcgcagccactttattaaccagcaatgg

SEQ ID NO: 661 - DNA, 2297 bp, Homo sapiens
tcaagtccttggactgaaaaacaagtttatgagcagcaaggtcacctgattctgatcatgtgtatgctgtttaccctgagatgacaggccggtggccacagaagctttcatgaatgctgcaaagactctactatctctttgaaggctaccagggcctccacatgactaaatgccataaaaaagaacctcatgaatacagcaagaatgtgaaaggaaggaagtcacaaaaacaccacatgctcatgagggaaactccattctggacactaaatttttaaagtaaacttgttacttgtttgcctaaccttctaggtatcaaattacatcatcactaaaaataatccctgctttacccccaacacacccactggccatcaagatctgctgcttagaccagaccatgcccacagtcaggaaataatggcagcccagacccatgcggctccccagctcacatcagcaacaagtgccagccaaaggacctgaactctgaccacagggatcagctccatgatcagggaaagagggtggtcatgaagggcttacccatctcttcctttgctgacaatcttcacttcaaagtaataaatgccacaggcagcaggtatggggtgggtggcacgcactgaggccgcatctttgtgatttttgccatgacctaacaggagagggcaagtaagaaatttcagcagaaggaaatgcaaatggaagcctcatttttctctgcaactcctccatgacaactccactcctctgtggccagaggacgcacttacacaggccgaggaatcattagacaactgaataaacacttaaaccttccacctttgcctcacctcctcctgagaacagcagtcctgcctgagacactgcccatacaaacaaaacaagggtagaggcaatgtgagagatactcaagtgctgctggcagcctctctagaatccaggcagcccacctgggaggccaggggaagaaggatgaggccgacctggaagacaccccccaaactctagcacggaaccccaggctcagtctaggatgcctggcaggtggggaagcccatgagtctcacgctaatggtaggtatgtgaccacccctttcttctaagcagtggcgaaaggtcccgctgccgttggcgccagcctaggataagcacggaggccctggagtggaaggtccggcccagcactgggtttggacacctgttgcggttctcttgacggcaggtgtctcaggacagagaacaggcagtcagccctcggcctgttcagcctcaccaccctggacatcctgaaagggccaagccctaacttggagcacctaggcagggaaagggaggtgatagggcgggggcctggcagcagagccaccccacggacgctctagccttaattccccccagcctgacgggccgatacctttgtagtggacgcggaggttgccctgggagagaccaatgtagttgtatttgtccttggggctccaggagcgcggcagcggagtctcttgctggttgaccgcgggatacaggcgctgcaagcgccggctcagctcctgctccccaggggacggcagcccgcccccagcgcccccgccggaggagtccccaggctgcgggttcccagctcccgggtctgccgtcgctgccgccatcttggagggagctactattgtgtcactgggggcggggaggagcgggaccagatccgccccgctcagccaatggcccgtgagcctccctgggccgcagggaaaccgagtccgagtccggcacccctctttggacactgacacgccttaccacatttcgaactccataccccacaatgcagagctctcgagaggcggagcaactcgggctggtagagaattctgggagatgtagtataaccgtcctcagccataagcctgtcccatcgagacgtcgggacaccgaaaactaccattcccgccggcaaagcggctccggcctctcagcacacttccctccccatggcctctgttcatccccctgcctcagttctggtacctggggtcaaatcggctgtagtggttgactctcagggcacccgctgccgggtcccagtccacctttgctactttgtcctactcccagcccgcgggcgctaggctcgggggcgtggcgcatccctgactccgcccccgccgcgggggggcctctggggcctggtcgccatggcgaccggctgtacgctaccacagcttcccaggccgcgggtgctgattgcccgcctgcccgtgggtcatggcctgccagcagtcgcggtaccacag

SEQ ID NO: 662 - DNA, 2041 bp, Homo sapiens
ctcactcagcttcctctcctgaccagggctccaggagacctgactctgcccttgagggcccaggcaggcactgcggtcacaacctgatgactggtgagggcaaggacagggtgtccctgggagaggccccccttctgctgaggaagcagcttttccagtcaaacaatagcgctattcctggcagatgaccaagctgggccaggccaggccatagcgggagggggcaggagagggaggagcagagcctccctgggagctttcagccttcgcctgggcctggaacatcctgtcctggtacagctggggatactgaggcctagggaggtgaagggtttcaagagactatcagggtaggccactccacttcctgcctccttcccctcagccccatggtttcccactctgtctgcacctgccattgatgagatgggctcagcctttgagaagctcctccttcccctagtcctccaggggataggccaggatgtggtggctacatagtgtttcacaggaatgtgtcaagcccgagagtccagggaggaggcttagcttggcttccatctgcctatggtgggggctccagagcaggcagagggcctgcttaggcctgctgggtcccaatcaggcctgaggcctgctttagtctacttggttcaaagcctcacatctgaggcctcagggtgctcaggccaggcaagggtcccctggagcattctcagccctgcatggagccaacatggacatgctgatgcctgcttagccttgggggggtcttagacctgtgaaggcctgataagatctggggtgtctgccagtgccgggggcctccttgaacctgaagcaagtttagatgtgcacaggctagctaagggctgcaggctttggggctcaagtttcaggcttgaggtctgagtactcactgaacctcagctgcaagggcctcccccaccaaagtctgagcactgggcattactggctcaagcacttccgggttttgttggtatcgagggacctcaagccttaggccttggccacctgcagccccctaacccaaagtatgtcgctcaggcagaggtggctaggattctacctctgtgtgcccctggtgaggagccttctattttgaaagttggatgaaaggaacaagtggggctaccaggccaggtttcaatttgtcagccccctcgcaagcggggaagggtaggtatcaatcgcaatcctgtgttggcggccctgccccctgcagccatgagaggcaggagagcgaaaggcgcccgggggacagcgctgcacagcagacctgtgcctctcattgctccggggatttgggggcagcgttctggtcctagccgagctccagtttgtttcgtgtcccttctgtctcaaggacttcaatcatgaaacccacgtgtgtgccagaaggacagaaacgtcccctccgggatgctcccaccggctgcgcagctggctttccgcggaaagggcggagcccagggagggggcgcgtcaggggcggggcctggaggagtcagacggggtggggtctatccccgagccagtactaaaaaaggcggagccgttcggggcggtctcggtgggctggctggaaagcgggatgaggttctggcgttaggaggaggcgtgaccacccaataggcttctcttcccgcggggcgtggccgtcaaggagccggacgccgcgcctggctgggcgggtcagcctcgcagcgggcggcgtggacgcggcagcgcagcggctcctttaaggctcgggcaccacccccgccgccccgcctcccgtgcggcctgggtctagttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccggtgcgcgcccgggttcgggagcgcagataggggctgggggctctgctctcgctccgggccagggtcggaggattaggatc

SEQ ID NO: 663 - DNA, 1798 bp, Homo sapiens
catacctagaacgtttgcctgctgcagatatacagacaagatatctccctacctcatagccaccttcacccctgtcccacaacccaacacccagcccaccttcttggacgatggaggtagtcgttaatttcttggtatcattgctagctcttagccttacccttggtctttcaaggaaaaaaaaatgcctgatactgtcgttaacagtttaatttatgactatttgcaaaatgtggaggcctgtgtggagaatgcaaatcgcctcacaaagagataaaggttcctgttatctgattcagagggagacacacagttccgaggatgccgagggaaggagtcctgtgcaaacagatcttttagttcctgtccacagacacctctacattctgtagacatgcagagtcctagatatacatatgaggaggttgcatgtgtgttctggttcttggggtggaggtggtggtggagattttcgaatatctgttttaatgactcacaatatgcatatgttaaccccagtcttgtatggggagccctgaaaggtcaggtcacaacctgaaccgcctttaccaagaagcttctcatttcaaaggcacttactgtattttcacgtatcaaaaaagaaaagtgttttcctgaagataacagggaggggggatgcttctcggagggacctgggttttaaaaaataaaggggggtaggagaaaaagggagagagaagaaaaagggggaaaagaaacagctcaaatgaacagagagatcacggtttgcatggctgcccttcaataggctaaactgacaagatcagttttaaagggccacttaaatcagtttcaaagactggagaaaaatgagtcgccctctttggggggaatctgaggctggatcgtggacgccattactcgggactgggccaggttgtccacccccaacccccaacccctatataattataagccaaactattatttacagaggaggaggggagagagtgctggtagttttggtttcttctgtttactgacttgggccagacagacccaatgcacttttgcttgggcctctcaatgacccaggctaaggactcgggcagtgaaagcctgtagcacactgagctatgttttattttaaagcaaacacttcctcaggaccatctcttgctctttcttcccccaccccgcctcccccccttaagttttcagtacatagacatttgctccaactccggttggggcagtttgacagagctctgtgcacacacctcatgtgacccaattcaaacctcttaatctgatgactgaattcttcttcttcttcttcttcttctttttcttcttcttcttcttctgtttttaaactttcttccagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttca

SEQ ID NO: 664 - DNA, 1792 bp, Homo sapiens
accaccattctcggcttatttttgtatttttagtagagacggggttttgccatattggccaggctgatcttgaacttctgacctcaggtgatccgcccaccttggcctcccaaagtcctgggattacaggtgtgagccaccatgcccagcttcaattacgtttttttagctgatttagtgtactgtgtgtgtgtcccctctttccctgcctgtgcctgtcataggaagacccaagcccaccttccacccaagacttggaaaacagcttttctggatgtcactcatgtttgctgtcctctggctttaccttatccagcagcacagcagtgtggagcaataaaggaaagtgataaatcagcatagagagcgttatccccaacctcagatcacacagtccttgcaaccttaaagccagacaaaatctgagaaatcatcttgtacttctaaagcaaaatcctttccatggcgtctctaagagctggctctccggcctcatccagactctgcttgcatacttccattcgtagagatcttcatatttctccattcagtcactggcagcctaccttgtgccaggagctgtgtcagttactttctcatatataatttaatcctcacaacacactgtgagggtgccatgccatagccatatcacattcttctccatttgacagaccagaaaaccgatcattcataagtgtcatgatgttagatcatctgactccaagctagaagggatgggaagcagaatgagggctccagccccagcatcttttcctccagggcacgacttaggaatatagtcttaaagtactttgaaataatcttcttttaaatctctgaaagagcagaagtttagaggtcaggcagacctggtgttgaatcccctagcagcttgtaagcacctgaatgtctggattctgtcgtctctgtatccttccctgctgggcctggcattgctcctggcagtcagttgatgctttttgattgagtaataagatatgaataatgctgtatacatgtgtggtacataaactttcccaagttattctttcgacacatagcccacttattaatgcattcaaagtactagacactatgcagagggctataggaggcataaatatgaattatagaagacttgcccttaggagctttatatctagaaggtaagctataaataagatacgtatcacaatgtgatcttcgcagtaaccccattggattggtaaagccagaattattatccccatcttataagtggagaaactgagccccagcaaagtgcagtgactgccatgagtggagtggctgagaggcagggccaaaccagagccagggaacctgcctcccagctcagctgttcatctggaggttgtaactacatagcattattagttaaaggaaagaacaggttttgcaaaccctcactgttctatagattatggtctgaaagtctacctgatattgcttttcccttcttcaaaccccatccccatcttcctgtcctctcaaggatacagtatacttgctccatcgcagcgccctcgagctcacttacattttatttatttacacgtatttctctctcctttctcctccaggttgtgatcaattattcaatcgtgaaagggctgaagtacaatcaggccacgccaaccttccaccagtggcgagatgcccgccaggtctacggcttaaactttgcaagtaaagaagaggcaaccacgttctccaatgcaatgctgtttgccctgaacatcatgaattcccaagaaggaggtaagtaggg

SEQ ID NO: 665 - DNA, 1790 bp, Homo sapiens
aaaccaaagtcagcttcttgtcgctgtgcaggacgtcatgaagcctagggcaaaagaagggctcagccaggcaggtccgcctgacagacgtccagtgtcagcccccgcctcccccaagcggccacaccggcaaggagcacccgcctcccgcacacctgacgatgttcttgtgcttcagctccttgagtaggcagatctcccggagggcggaactcggcacaccctgcatatgtgagggggccggtgggcagcagtcagatcccacccagcccaggccctcaaacccctccccaggccgtatcccactccccagtcctacctcatcatcgtcatccagcctcacccgtttcagagccacgatctcatgagtctcccggtttttggccttgaacacagttccgtaggtgcctaggggaaggaggtcaggggtcagggtgaggatgcggcactcttccctaagccaggaaatgcctcctgagagaggtgaaggcagcgtctcagtatgcaagggaagggattcagggtgaaggtaggttggtgagctttgtgagtgaggatgtggcaggtggggagggaggagaaggtgcccaccgaggctccaggggctcggcaggaggggcgagtgcggttgccagggcaaggatgtctaaaatgaaggcggtgctccggaagggtctggaaatagtgaggaggggtctgggagaggactgaggggctgcagaaatattgaggttggaggtctgcagcaagaaacgaggctgggggtcggggtgaggttgtccaagtgctgctgaggctggggtgagaaatttcaggaagtgtcgcggttgggaggtcgggtctactgggaacgctaaggttggagtgagagccctgcgggaaatgctaacacggggaagactggtgtctgcacggagtgctgagctagggggccagggctgcagccgctgctgagatcggagcctgtaggcattgctgacggtaagggagccagggcttcaaggaatgccgaaggatctgcagaggagctcttgcaggaacatctcgagattccattaccttccccaatcttttccagtttctcgtatttctgcatcgcggcggccgcggggacccctgcgggccctcggttttaagactctggccccggcgttgcagaggaggcggcacctgagcctccagccccgccccgtctgcccgcgcagggccttctggggcttgtagtcctaaaacgactaggtctccccgcaatgcccgagaccgaggacaagaagactacaacccccagccgtctgcgctcacgctctctgcagcactcgactccagggctccgtttctaccgcggaggcaaaccttggacttcaagtcccaggaagcaacgcgtgtccgttttccgggcgccccgccgcggcgccgtggttcccagtgtgccccgctgttgttattccttttatgtgctcccagccctcttgaaaagggccgctccgggactacgcgttccagaatgcagcggaaatgggggcggagcgctctcggttaggggtttggggtttggcggcctagatcccgggcactggcggcccagcgctgacctggttggtggcattgtgttcccaacggcctcttgacgacctcagcacgggtttccacctctccccaagccacctagtgaccccagaattgactggggaatgcctgtgagcgatgatgacctcacagggaacagctgaccgcagggctgggagaacagctgtgccccttcgaggctggattttagtggagggacacac

SEQ ID NO: 666 - DNA, 1717 bp, Homo sapiens
aattccttggggtgatgttttctcagattacattaaagtcatcctggactacaacaccgcccacaacaaagtggctctgtcagagtgctatacagtagcttctgtggctgagatgcctcagaactaccggccgcatccccagaggttcacatactgctctcaggtgctgggcctgcactgctacaagaaggggatccactactgggaggtggagctgcagaagaacaacttctgtggggtaggcatctgctacggaagcatgaaccggcagggcccagaaagcaggctcggccgcaacagcgcctcctggtgcgtggagtggttcaacaccaagatctctgcctggcacaataacgtggagaaaaccctgccctccaccaaggccacgcgggtgggcgtgcttctcaactgtgaccacggctttgtcatcttcttcgctgttgccgacaaggtccacctgatgtataagttcagggtggactttactgaggctttgtacccggctttctgggtattttctgctggtgccacactctccatctgctcccccaagtaggcaggctgtaggcacttgggctgactgcctgcagaagtcccaagaccctagtgaaaatacagcaggcagaactctccttggataattccccaagaggtcccaaggattgggagcatgggaggggagctggcgggagggtgggaggtgggatttagccaggaaaggggtgagagtgattgtgttgtgggcgaggaggcgtttccaccccctggtgcctatcagggcagggtgacctactccccattgttctggaaatctccaggctgctgggcagctgggcagagctctgggaagtgaagtcatgagtgcccgattcctcttagagaaaatccatagctactgtaggttctgtcttgggccacttggatctgaaggctgcccctttgctctctggggtagccttcagatcttggtgttttgaattcttactatagatgtttttaaagttccaaagtcattgagtttcaatgttacataaactccattacccgcatgttggggcttgatctcctggttattatctgtgcttgaggaaacacccacagcagtctctacccagaacagtttcctaaagaggcataccctcttcctccactggaaaatagtgcgttcccttcctaccctgcacacccatcgcccccacattgatggttttcaaacagcaaacttttcagctaaagcttcaaaccatgattggaatcagcctgtgttggatttgtgattcagggtcatggtgaccctgatccagtttgggtggaaatccttcctaagtatcataagaagcatcttggcagagatgctttggtggcagccatgagctttgctggaggccttgcttcccatagccttggctgtggggcaaggaactctgccaggcgagggggatgctgccctggatcaacagaagcctggtgggtttgctcgtgttagagtgtcctgccttcttactgacaactcttctcggtgatagcctctcttccctggattgtgacatatggaatgacagtgcaggtaccaccgaggctagcacagtcaagcctccagctaagctggatccctgaagcctgctatcatgcagacaggctatgcggctgcctcggaccatgctaggccacttgctggggtgtcaacctaccaccaaaggggtcttttagcaaacct

SEQ ID NO: 667 - DNA, 1643 bp, Homo sapiens
ctgatggctacttccaacttgcttgagggccacaacggcgttgtccccatttgagatgtgtggatgggtggtgtctgtggatacctagcgatcaactttctgataggaggtttagagacagagctcttgtggcatcaggtcagtaccaccctctcccagaggggagaagttaggaagaacgggcagccaaccaggcattgggctctgtcctggtcttccagtgagtgtgcttttactcttcttaggcaagggcttagcctggcctctgtctccccctggcggtagacacagaacttgctcagcattcccggactgctctcagccctggccctaagagaaggatgggaggggaggaacccccactcctctctctgccattgatctcctttctagcccttcctccctgatccggagaagtaagcttggttcttaagacagagcaggtttgaatgtcaggaggccgacataggtgtgaatctttcacttgaccgtgtgacctcctggggcaagtcacggtaaaatgacaggaagcgtcccgtcctgcctcatccgtgaaactgacagaaaaaaaaccatcttgaaggattggtgtgcagtataaataacctaatactgtatggaacgtgctttgtaaagggtctagtatgcagtacttcttcaataaatagtatttgttatgttgttattatcctattaatagcttgtcctgctgtggtcagggaaggtctgcattgtgggaaagacctgggttctgagagagaaaggagggtgggagtagcaaccgctctcccagatctagaggtggtcttcacggggaacagcgcatcaggagcccaggaatctaccccggctcctgattccggggtggtcggctgcagcctgcgtcattaatcccgcaaccccacccggtaccagcttgcccgctctcgctccagcagccccatccagaggtggtgtcacacctggcgcctcatacccagcggctcccaagcgcctgttttgctctgaggtcattagctccatggctctctgggctggctggccacaccgaaccgagagcgaggagaccgcacccccttgtccctcagcccccgtcacaatggagacattctagctgtgtctaatctagcgcacggctgaaataaggtttccttctctccgcccccttcccacagcaacagaacctacccctaagaaacggaggcggggccaagccggaatggggcggggcagaggccggggacccgtgggccggttcctggggtggcccagagcaagggcaagtttcgcccgggacccgcccagctggccgggagccagtagcagggaagggccggctggcgcgagcaccgcccacgcggagccatgggggcggggcctgggcgggggcggggccgcggccgagggcggggcagggaggcagcatgctaaaccgggtgcgctcggccgtggcgcacctggtgagctccgggggcgctccgcctccgcgccccaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctg

SEQ ID NO: 668 - DNA, 1585 bp, Homo sapiens
atgaggctgacctaccaattcaatgtttccaagagcaaatagcagtaaaattacaaaacgttatttgttatgttgatgtgtgcaaacaaaaatgttctattttatagtacatttcaagttcaatctgaccctcatatctaaactatgtcatataaataatgtcatataaacagtgtcgaacagatcaggaacaaagctcttttcaaaaacaaaagtaggctccatgcagtggcagttaaagaaggggaagttctggtgtctccagagttagccgatgggcacaacggcagttgaaagagaccatgttacacaagtcattcaggttctggccaacatctgctttgaacaggtcgcattcccaggagctccaggctcccttaccccagggaaatgctggggtggtggcttgtcttacagaagtggtagccaaggggaccagaaggcacacccggtgctaaaacatgcctaaaacttcctctaatgtttacagctcttccaatgacatttggggaactaaagtatggatagcctcttcattgctagaaccgctataatatgataagttaagaatttgatttaatatttataaagaacttagaaagagcccagcgcatagtaagggctatgtaagtgtttggtaaataaaaaaaggcacctcccagattggctgggtgaagtctcaatctggtgagaagggagagaatcaaaatacacaacagtctatttttcactttgacaaaagatttagaaattacagtgctctgtatttattttgcacccaagtgcacactaagtagtctctggtgcaggactgaaattctactcatggttcagaagtcactgtgcacaactcaatgaaagcgttttaagtttcaagagatgattcctttctcttttctctttccaagtaacgatgactaaaaatgacagaatctaaaaatctcaaagcacttcttgtgggtacattccaaagctaaaactgtgagaattaatagggccagattcacttgaagagacgtaagggttcaaattacagagaacttaaaagacgcaacgtattaaggtcttttactacagatccgctgacaacaggttaaacgattccatccaccccactctggcggctgccccctccccgaccctcgcaggtgacctgcacccactttcgacctcagatagggtctccctgctcggcgttcccagttcctccaggctcggcggctgcgtgggggttaacaaggtccagccaccgacgccccttgggcgtttaggaatctcgaggcaggatctgaattcacctcgtggaaacaaagaccacaaactctccgggagccgggggctgggcggaggtacggctttttccgaggacaggcagcggccgaggcccgggcagccctcgccccgccccgtctcctcccgccccgggccgccgtcggagtcccgggcgcgcggaccctcccgccggccccgcacctacctggccccgcggtgctgctcccggcgcggcgggcgcggagccgaacgcactgcgcttcctccttcccggcagggccgccgggcgccggcgtttcctccttgacgcgtc

SEQ ID NO: 669 - DNA, 1191 bp, Homo sapiens
agggtgcatgtgaggaacaaatgcatggacacggtgaagtgccacttcttcatttctagttcaacacaattcaattaaaaattactgggaggaggctacgtcttgaattaaactcagcattccacatctttgaggtggcggaatgactgaggggagggggtctgtctagccacatccaaatcttcctgagacagagggagatccctcatttgttgcagtgtattttccttggtcgcatctgacacaggggttctgtgggttgaacagaaagggactttgctggaggggaggcactctgcatagaaggaaagtagggacatctggcagaagcaggcgctccgagaataaacagtcaaagcagctcgcaatagtcccaaaaagctacccctcaccgaacctggcgtgcctgtcgccgcttgccccgctcccagggctcattggctcccagtctcgacgtcagacccgtagcctctcacctattgggccagccaggacctgaggcggagtgcagaagcgagggcctggagacagccgagagccgccttcaaggagggctgggggcggggctagaggaggggctgggggcgggtttcccgatgaaggggcggccatggcagctgcgcagaggcaacgcaggctgctacggagcgcgcgcccggctttgaatgagcggggctgggagtgagcgggcggagcgcgagctcgaggaagagacaggcagcgcgcgtgagcgcgccttgtgtgcgcgcgcggcccgcggcagctcggagcctccgccgggcgggcggggagggggaggggcaggtgagtgtgtgcggttcgcgcgtgcctgggaggggctttcctctccctacccccatcccgaccccagccctagcctctggggcattgtctgcccttcgccgtcggccctccgcctagccgcgcacttcccgccctcccaccttcctttcgcccttccaccagacctccctcgacgcccgacagctgctctgggtactgtttccgggtcagggtgacctctggggtgaggaaactgcgactgggagcgggacccaggcgtgcagcattcgccatgctccgctcacgcgtgggagactgggctgtggggtaccggcccggaaagcacgcagcctccaaagccgccttcctcagggaaatttgcgtgaccttactgccctccgtctacag

SEQ ID NO: 670 - DNA, 1183 bp, Homo sapiens
gctatgatctcacctccttcctggcttctgcatatgctgttccctctacctggaacactttctcctgccttacctaaacttcctatgcatcatttactcttcactcagttcagggatactcatgggtcacccaactcaccttctgtgggacctggaaccccccaaccggatccctacagcccgatatcctacaaacactgccaatgtgacgtatgtcttccctgccacattgggagccgggggcctgggtctgactatcctctagcctcacagttgtctgcgaatgaagcagcatgcctgcgtgcagcacgggaaactactgccttcaggcagccagttgagctctcgagaacgtccctcttcccgcccagtcccgcgagcccgggtggcacctgataggtgatcttgggtcccagcgtggggtggaactcgctgaagaatatgcattcgatgcggcagccgctgcccatggcaataaccgggcccaggcccgtagctcctcgttcctcgcgcagaggcgtccccacctcctgtgaacacttgtcagagacagcctcgaggcctgtgtcgctggggcacgcaagcttgccaatccctctgcccaatggcgcctgcgcagcgcgactcagaggcgtggctggggcgggggacggctcgtcccaggaagtcctgggtgggtagacgtcgcacccggaagtaaagcggctccgtgacggagcggcggtgcgcgcggcagggcccggagtatcccgctttctttggaggaaaccaccgcatcagatctgcgctgcggcagaggcaggcaagtccctagcgtggaggggcagcatgctggcagcacttggggaggcggtgcgctaagggattcacgctgtaactgggaccgcagcagggaactacaatttccatagtgctccgcgccctcccagctggctctactgccggcgacggcgtggtacacgctgggatttgtagtcttacatggctttgcgcctcctacctggaaggcgggccagcgattggtaccagttcagacatgggtacacgttgacaggccgccggccgtcgactggcatgttgtgaccattcctggtgctggtcttggtactgttctttcctaccataacttattggaagagggtggcattcctgccttgcagccttttctccagtgaggagtgaa

SEQ ID NO: 671 - DNA, 1180 bp, Homo sapiens
gtagagttgggggttctcgctatgttgcctaggctggtcttgaacttctggtctcaagtgatctgcccacctcagactcccaaagtattgggattgcaggcgtgagccacagcgcccagccaaaacacattttgatggtgtcataaacgtgcttctttaaccattagatagcaagatctggtcgtggcccaataactgtgataattttgaagatataatgaatctaaacagtatatagaggcatttgtgacagctgtgataggaagttatcttctattttgatttgtgacaaagccacaggtattgctaattctgctgtggtttgttgcctaatttatagtgaaaggaaaggtggaatatcagttacagattagagacagatgtgatctcttcctatccaagtttcaggtgcagggaagtgggtgttgctgtgtggtgagggtgaagaggttttctggaaatttgggtttaggaagaggaaatgttcctaaaagaggggacaatgatccacatgcgtggtgggccaagagggtgggcggatcctgccagagcctcctcccacctggaggggtcccagcgtccaccttccctgccccagcccccctcctcgaggtactgggaggctggataaagtcttcggctgggccacaccccaccccaaattctccctgtcccaccctagtggcccaggccaccccggcctgctcccttccgcaaggcacctcaccttctgtgcccagaccattagccaacgcggtgaccttgaccccggcccaggccctgctaatgaagaggaaagcccgtacgcactcggcctgacccacggcgaccctctgtgaccaatcatactaccaacctcttaaacagagctccaccgacgcaatgcccaggcataaaaaggccaggccggagagaccgccaccagtcacggaccctggacccagcgcacccgcaccatggccggccccagcctcgcttgctgtctgctcggcctcctggcgctgacctccgcctgctacatccagaactgccccctgggaggcaagagggccgcgccggacctcgacgtgcgcaaggtgagtccccagccctggtcccgcggcgctccggggagggagggacccgcagccacaggggcgcgccccgctccggcctcgcctgagaactccaggagctgagc

SEQ ID NO: 672 - DNA, 1158 bp, Homo sapiens
gggagagatctcagcgaccttatggtctctctaactccctcgagatactgccgagaaatccacgaccccaaaaggagaaaaaatggcacgaatcttagttccccattcctcctacccaccctagatgttctaacggttagcacccggcagaggaagagcagaagttcacaagaagggtctgaatagaaccgggcagggctactttgggcacactgcctatggggtggccctgctctgcaaggagcagtgaaaaaagagaaccgggcagggagagagagaaagagagaggaaagaagagaaagagaaagagaaggagaacgagagagagagagagagagaaagaaacaggggccgctggccggactcccatcccaggaaaggtcacacagagaaagtttagggctagtcctgattcgggacagtttgctggggataaaaaagcagcagcagagtcgggtgggggagctctccctcgggctcaactgttcccgttgagactctccagttccccaaacacacccaaacacatggaaaagcaaagggaagggagtacccaatatctgatacctgatgcaggaatctggctcttcctggcagtcaaggttgcacatgaagcgctcccagtgcagccagcccatggtaggcgtccttgccaatccattgtccagtgctctagccccagggatgtcccaggaaacgagggccaggaagcgaagcgcaagcgcgcagcccagatgtagttctgggttcctcagctgcattgtcacggtgaccggacagcataaatttccgcgggtaacctgggcttttaagattaacctcaggggcggaccaatcaccgatgacttattaaataatgacgttattgtttctctggcaactgggacggttatccccagaggtagaccaataatcagtcacgtaagacgttccgctaaccaatcaccctcttcctttcttgatattgacccgccctatttccataccagaaggaagtgcggcaccttagtgatcccgagtttaagccgagagttgctcacgtgaccgagatctcacatgacgtaggcgctcacgtgattactcgcttacgtgagcagaagtagttctggtcgtcgtctaccgtctcgctatagccgtttgagggaagaaggaggaaaa

SEQ ID NO: 673 - DNA, 1139 bp, Homo sapiens
tgacctaacttttgtcaccttggatatctattgaatgttaaacatctctaataaagatggccaccacttaatgtgtggaaagtgatggccttctcgtgggccacgcgtttgggtgtgagtatggccttgaccaagggtcttggtgctttattcacttttagagatagggtcagttgcccaggctcgagtgcagtggtgcagtcatagctcactgcagcctcgacatcctgggctcaagcagtcctccagcctcagcctcccaagtagctaggaccataggcacatgccaccaaacccagctatttttttaaaacaattttgtagagacaggatctcactgtgttgcccaagctggtcttgaactcctgggctcaagcaatcctcctgcctcagcctcccaaagtgctgggattacaggtgtgagccactgtgccaggcccttggttcttttaaaaaattaatcctgtcatgtaggatgtccttacagaatgaaaaacctagcaagcttattccccaacagaacctaataccttggttggattctattgctaattgaaatgagaattcggttctatggtcattggttcagggtgtatgtattgtgagctgctggagacagaacggtgaacaggcatgcctcccggagagccatatgcaaagcacggagagccacatgcaaagcacgtgttggcaacatagcacatgctgctgctcaccaggctcacctgggatgacggtgtggatctgagtcgctggccacgtggcgacgtctgccctgccctagtgtccaaggacggtgaagggtcgggtgtcaccaacacctgcagccttctcaccgggcgaggcttgggttgtgggaagtgggggacagctggccctggtccccagccctgatggacatccggcattttgctggtgcaggctgtcctgaagccagaccctcccgagactgctgtctgggaggagagcgagccagcggcccagatgccttggtcgtggggaggtgcctgtgtgtaccgtgagtttcccagcctccggcggcaagtgggaaagccggtacaggaagagtggtgcctgcaggtgctcccggtcaccaccaccccttccagacgccatccccagagctcacatctgtgctg

SEQ ID NO: 674 - DNA, 953 bp, Homo sapiens
gcggagtcaccacactttcttatgttattaaatagcctaacccaggaagggttacagctgtaatcccaacaactctaaaggccaaggtgagaagatcacttgaacccaggacgaaactggcctgggcaacatagcgagacccccatctctacaaaaaatacaaaaattaggccaggggtgcaccgcgcccggctaatttttgtatcttttgtagggacggggtttcgtcatgttgcccaagccatccatcctcacgcctcggcctcccaaaatgctgggattacagggcccagtcagcctcatgttttctttaagcagtccctccctattgcacacttggatagttttcttttttatttttttagacagagtttacctcagtctcgcaggctggggtgatgtagtgggaacatagctcattggagccatgaaccttggagttcaagtagctgggaagctgaggtgggacttcagagatggggtcgcgccatgttgcccaggctgctcttgactgcctggcctgaagggatcctcccacctccgccgcgcctgaacatagtttcctatttttgaccaacataaacactgtgctgagttggagtttgtcagctacccttctccagcaacaacaggacctggcggggaggtcccggttaccaggctgcactccaaggagaagacagccctgctccaggcactgtaccgccactgtgacgtcgtcgaaggtccgcctctgtggcgtcgccgaaggcacccccaccttcacgcggagcccatcggaactcgaggcggggctgctgggtcttccaggagcgcccagacgcgggcaggtggccgccggtggccacaggcctgggcaggatggaagcgcccgcagagcgggcgcttccacgtctgcaggctctggctcggccgccgccacccataagctacgaggaggagctttacgactg

SEQ ID NO: 675 - DNA, 1027 bp, Homo sapiens
atttctgcaaccactgatgatcccaatattctgtcaaatactaggtaacagttattcattattttagaatatggatctgaattatgaaataattttgcattctaaggtcttatgtagtaagatttggattaacttcccaattatcaacacaattgtaggaaatctcctgagaaaaaatatttctaacgattgtgtatcttataatttaaaaaataaacgtgacttggaaaatgcaaggactactgttcttcttgggtggtgcattaaaggtgatcagaattctaatgacgctggacagtaggattttcagaatcagtttcctagggttcaagaagtcaaacggcaaataacccaaggtccttggttgatctgaccatctcagctatctcaagatatataagatgacctaactggcgcatctctaggatgggtgggtcatttaaaatgttctgcccttgaggctgggattttgtgcgtgtaaacggtggggagacggcggtgacacatttttctccctcccgtagtgccacccggcgcagggccgctgcggcggcggcagctcccacgtggcaagttcagattgtgcagcgcctggccgggggcggtgggcgggaccgcagacccctccctccgctctccggcccttccctctggccggcccgggcgcccgcttggtcctccaccgccagggggcgggcgcggcttcccggcggcgggggcccattggtcgcggccgggaagcgtgggaggaggcccagcggcgagctggctttctcctggccacttgccggggtgaggggcagccggaggagtccgagaggaagcggaggcgcgagctggaggcggcggctcccgtcggcctccggcaggactgagcgctgggaggccggaaggcgggcgcgcgcggcggagaggcgggcgggaggccggtgagacggctgggaggcggacggagccggggctcaggttcggggagggatggaggaggccggggaagccagacgcccacctacgacttcagcctccg

SEQ ID NO: 676 - DNA, 1091 bp, Homo sapiens
ctgaaaacagcacctcagagtgagggctagatttggggtcgggtgtccagcctgtaccctcctgtcaccttctgtggtgcccccgtgccctgctcctcagcttgtcactagggagtcagcctgcggctccgctcctgacccatggagcgtcaatcagctgcagcctggctatgtgtgcccaggtgcacggcctccctgcctgtgagtaactcctgccctgagggcacactagcccggcagggagaatggagaccttacttcagaaatggtcaccagccaatggcgtgcccagaggggttgtggagctcctgcgataatgccaggctgagtcgcgaagcctgggtggtctttgcagctcttccgatagttcaccgcagacagcctcaccttactgtggcccagtttcctccaccctaatgtgtgaactggtaacgtggaatgtagtccagtagaatcaaagccccgagagggcagggacctgcctattgtgttgcttgtcaccacagcccaggtgccccctcaccgggcatgttgggtccttcatacactgtcgctgagtgaatgacggggcgtggtctgctggccctgcagcctgcacatacttgcggtgtgatggggctttcccttctgtgctcacctatgtttgtctgtctttcaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtga

SEQ ID NO: 677 - DNA, 939 bp, Homo sapiens
gtggggatttacatccgctacttcaagcagatggaggtgaaagagtcctacatcactctggcccctctctacagtgagacagcagatgggtacttcgagaccatcgtttctgccctggatgagctggacatccccttccggaagcctggctgggtggtggggctggggacggatggctcagccatgttgagctgcagaggaggccttgtggaaaagttccaggaggtcatcccgcagctgctgcctgtccactgcgtggcccaccggctgcacctggctgtggtggacgcctgcgggagcatcgatctggtgaagaagtgtgaccggcacatccgcaccgtcttcaagttttatcagtcctcaaacaagaggctgaacgagctgcaggaaggtgcggcgcctctggagcaggagatcatccgcctgaaggatctgaatgcggtccgctgggtggccagcaggaggcgcacgctgcacgcgctgctcgtgagctggcccgccctggccaggcacctccagagggtggcagaggctgggggccagattgggcaccgggccaaagggatgctgaagctcatgcgcggcttccactttgtcaagttctgccacttcctgttggacttcctgagcatctacaggcctctgtccgaggtgtgccagaaggagatcgtgctgattacagaggtgaacgccacgctgggccgcgcctacgtggcactggagagcctccgtcaccaggcagggcccaaagaggaagaattcaacgccagcttcaaggatgggcggctccacggcatctgcttggacaaactggaggtagcggaacagcggttccaggcggatagggagaggacagtcctgacggggattgagtacctccagcagaggtttgacgcagaccgacccccacagctgaagaacatggaggtgtttgacacc

SEQ ID NO: 678 - DNA, 916 bp, Homo sapiens
cccaaaagaatgtgtgtgtgattaaaatttaagttagagacagtctcactatgttgcccaggctggtctcaaactcctggcctcaagtgatcctcctgcctcggcctcccaaagtgctaggattacaagggctaagaattctagtcattcattcactcactcattcattcattcatgaataaacagtttgccctgcttgtgtacctgtccccctcctgggcggatacggcaggcaaacggtgcaagggcggctgccgggagaaggtgggcagctggagtgggactgggggagacaggatcaatgtgacctgcggtggtccccaggtggccgggatgcagtacctgcacggcgtcctgggccccatcatcaacaaggtgtttgaggagaagtacgtggagctggaccccagcaaagtggaagttaaggatgtagggtgaggccgggggtaactccgggggggtgcggggcgcagcggcagcgggttgggatcaggccctgtcagcatgtgtgtttgtgcttctgcccacccgtgtattgtcccctgtgtccgtgtcccggctgctgtgagagccactgttcctgtcgtggccctggcgctgaccgtgacctcctctgccaacccgccccgttccacgcaggtgttccgggctgcaccgcccgcagaccgaggccgaggtgctggagcagagcgcgcagacgctgcgcgcccacctgggggccctgctgagcgcgctcagccgctcggttcccgcgtgccccgccgtggtgcgcgccaccttccgccagctcttccggcgcgtgcgcgagcgcttccccggcgcccagcacgaggtgcgccctccacccgctgggctaggctgggccgggttggactgggctggggcgaggggcgggcgaagagcggtggggaaccag

SEQ ID NO: 679 - DNA, 1022 bp, Homo sapiens
ctcccgactgacaaaattctccgtctttgttttaaaaccaaaggacaggccaaccttgagcccggccgtcacccctgtcgcgcttttgttggcgcaggctcggccccctacaccgggctggtgcagctcccgcgatcagacggtctctctcaattcggcgttgaacccggttcttcccaaattctggtattgctggccgcttggacacgttctccccttatccctcccccagcggggaaagaaaaagccaggatcctttccttggcgcggccacccgagccactccacccgtcgcgccaaccgcctttccaggtggggaccaaagcccccactctccgctggcatctcattgaagggcacccccccgagggattgccagcttctgctgccagctgagaggccgtgtggctgggcgtcttaagcgccggtttccgcaggtcccgtgtctggcgggcgcggctaaaacccggagaggctgtgcccgggaaagccacgttcgccgtcccctcgctgcgacaggcccagccgcgatacagcgccaagtctaggtcgggccaacccagccaggagctgcccggacctgcctgaaagaccagggacgcggcgccagcgccccacaccccaccgagaccagggcgcaaggcgggcagaattcggactgatgcgccaggcccagccccgatggattccagctcctctcggccccgcctccggccctggcctcttcctccagccggggtcgggtcctccactccactgtttggctgggaaaggaccgagacgcgctcagtgcacagggggccggctgcggccataaatctccgggcgggccctccttcccgctgctcacgccggggtgctccgggccggtctcgtgtcccgggccacgccgcgcaccctgctcaccccatcacggcctggggacccggagactgcgcagggaaccacgccaggagcttctccgttcaccaaagagagggaacggcctcgttcctcggtgtcaacaccatccatctctgagg

SEQ ID NO: 680 - DNA, 991 bp, Homo sapiens
gaagactttgtgatttcgttgggcaaaaaagaactacacacaaaggtcttgaatgataagtgatggctctgcctagggttcggttcagtgtggaggttccattcaagaggaaggaggccagcacagcgaatctctgtccctctctggaagtggagagcctctaacaagttaccctctcccagatcagctcagggtaccgggcggccagcctccagcccctgtcacccttctcacccactcgccacccgtccctcaggggctttcttggaggcacgggggttattgaggggggcaagagaatctcaaccccgatacgtttatgtttcgacttccccgaatttccttgtgcctgcgttttgctgcctgggatccctagcgtgagaagggctcctttacactcagaggtgccgtaatggagccaagggacggcatcctcggggctcccgagccccgagtggagaagcttggggcagagggacggcgggggcggcccctggtgccgggctgtgcctggaagcgcgcccccgccccggcccccgctcccgcctccccacccgcgaaggcgggaccgcgcacggtgcgccggggggcgcgcacgcagggggctggcctgcccgcggcgcgggggaaagttgagttgggagaagttgggagcggcgggggcgcgccccggggtgggcacggggcagtcgtcgggagcgcgcgagtgcgccggaggacggggagagaccccgagacccccggggcacgaagtccagagcgagcgggtaggcggagaggtggtggcgggggacggccagggccgcagagggaggaagggagggggaaggagaggggggaactcgggactcgagcggggagggagtggaagtggaggaaagggcggagactggggcgcggggaaccgcggtcttggggagaaggatggggaggcggatggagtgctggtcggaagcgggcattccggggtccccttctcagagttccctaa

SEQ ID NO: 681 - DNA, 1019 bp, Homo sapiens
cctcgtaggcaaatcagtcaaagcccgtcccggttctggtgtctccccgggttactcgtggctgaggtctcccgctgggtgacaaagttttcttccttttgcaaagctaagaaacattttccaccctctcggctcctcccacagattcccagaggtaatctgaaaggcaggtgcaattaaaaccagcaatttggaaaacaagcctcctatgcctgtgcccaagtggggaatctggaaccagtaagcccgttcgtgcataaatgtaatcctcggccgcagaataaaccagctcggagcctgcagctgggtccgtcctcctttctgggcgagagggagggcggcgggggaagaggaggtgcaaggcgagccctctgcgcaattaggctacgggcggccgctggcagaagttctggcggcggcgctcgcggccctgcgcgccggagggggcgcccggagtccagcgggccaagaagggcagggcgcccgctcctcgccccccgccgcgccgcggccccaggggaccgcaaggggacagtgaggggccgggcctggcaccgacgcaagctcggggagcgcgggtggtgggaggcggcgcgtgttgaacaggaagtgcgcggcgtgcagcgccaccgtcccgctccccgtcgccccacgccgccctcgtcgccgcgcccagacccctgcggcggccgcagccgcttgggactcgctgcgagctggtttcggatccatcccgcctcccggcgtctcactgtgtgccctaccctttgaaacacgcccccgcgcccgccctgccgtagaccaggcagcgaggaagcccacagtctccgggggcgctgcgcgcgaagtagcacgtgcttctcgaaacaccgcagcccccgggtcccgccccgcccggcgcgcgcactcgaacccgcccagagagcggtgcgtggcgctgggtgcgagcagggtctagccacccccaccctcaccccaccccaccccaccctgcttttttcaggttcatcaaggtttgc

SEQ ID NO: 682 - DNA, 1033 bp, Homo sapiens
cttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccc

SEQ ID NO: 683 - DNA, 994 bp, Homo sapiens
gcacctgaggaggtgtagaaatcattcaaactctttgattacaatgacaaactagtcagtaacttactaaatattgtactatatattactaagtattttactcttcaacatagctttttaaagacacaaagcttttcaaaattcctgcttacctgggggtaaaatttggggaagcagatttctccagtgtttaaagaagccaatttggcagtgtaccagagttgaatacatttttcccatcacaagggaatacatttttcccatctaagttaagttgtttttctctggtaaaggaggaaatcaacacccatctgtacggagataaacgtttcagagtgtttttatattaaataattagtatactagtctagtaagtgataatccacgaataagttaagaagagctaagaaagaaaaagaaaagcatccatccatcctttggttgcaaataatacttacattagcgtatggcaaaatttaattttgtacagagtaatttaacccaggattgctgactttttaagagctgagaaagcatagctatggagcgcaaggccccacccagcagggtctaagtattccgtctgcaaaactggcaggccaccaacggccgcgtcccagggcggcctgaaggatgctgataaccgggagccccgccctgggttcggctatcccgggcaccccgggccggcggggcgaggctctccaattgctgggccagagcgggacccttcctttccgcaccctcctgggtatctccggtcttcaggcctccttcggagagccctgctccgagcccattgggcttccaatcttggcctgcctagcgccgagcagccaatcagaaggcagtcctcccgagggggcgggacgagggggtggtgctgattggctgagcctgaagtcgccacggactcggggcaacaggcagatttgcctgctgagggtggagacccacgagccgaggcctcctgcagtgttctgcacagcaaacc

SEQ ID NO: 684 - DNA, 949 bp, Homo sapiens
catgagtcttccatgtgcttgtcctctcctcccccatttctccaacttgtttatcctcacataatccctgccccactgggcccatccatagtccctgtcacctgacagggggtgggtaaacagacaggtatatagccccttcctctccagccagggcaggcacagacaccaaggacagagacgctggctaggtaagataaggaggcaagatgtgtgagcagcatccaaagaggcctgggcttcagttgtggagagggagagagccaggttggaatgggcagcaggtagggagatccctggggaggagctgaagcccatttggcttcagtgtcccccaaacccccaccaccctcttcctaggccgccctccccactgttaccaacatgaagctgctcgcagcaactgtgctactcctcaccatctgcagccttgaaggtgggtgtgatatggagagggggccaaaagggagaatgtgctggtggttatagctacctatctgcctgtgctcttatatccaggtctggcaaccaaagggctcaaaaggaagatcattccctctctaaagcccagaaagcccatccaaagatctggctggatacctttttggggagggggcagagagctggggtgggtactggcagaggtatggcaggaggccaggattcactgctgtggacccagctgaaaagagtgtgtgtgtgtgtgtgtgtgtgtgtgtgtgtgtgtgtgggcaggagctttggttcggagacaggcaaaggagccatgtgtggagagcctggtttctcagtacttccagaccgtgactgactatggcaaggacctgatggagaaggtcaagagcccagagcttcaggccgaggccaagtaagtctcagggcaaggggttcaggggctgtggaactgtggagagaaagaagggaagatgagaggtcccacagaagtctg

SEQ ID NO: 685 - DNA, 3405 bp, Homo sapiens
agtcaggaaacaacagaagctggataagatgtggagaaataggaacacttttacattgttggtgggagtgtaaagtagttcaaccactgtggaagacagtgttgtgattcctcaaggatctagaactagaaatagcatttgacccagtgatcccattacggggtatatacccaaagattataaacacacatgcacacgtatgtttattgggcactattcacaatagcaaagacttggatccaactcaaatgtcatcaacgatagagtggattaagaaaatgtggcacatatacaccatggaatactatgcaaccataaaaaaggatgagttcatgtcctttgtggggtcatggatgaagctggaaaccattattctgagcaaagtatcacaaggatagaaaaccaaacaccgcatattctcactcataggtgggaattgaagaatgagaatacctggacacagggcagggaacatcacacacaggggcctgtcatggtgttgggggaggggggaaggatagcattaggagaaatacctaatttaaatgatgagttaatgggtgcagcaatccaacctggcacatgtatatccatgtaacaaacctacacgttgtacacatgtaccctagaacttacagtataatttttttaaaaaaagtaacttccaatatttttactattagcactctccgaagaagtgtttgtggtggcggtggtggtggtggggagggtggcctgtgtgtgtggcgaggagagggggcgggtacagggctggaccttgagatagataaggcaaacaggaaggaaatgtgaacatttcattaatattcatttaaaaaatattcattgaacacttactacgtgtaagcaggcactctactaattaacagccatttcagattttcagagtgcaaagggcctcaagaacaaatgatttatttttttgagacatggtctcgttctgtctcacaccctgcagtgcagtggcattatcaccgctcactgtagcctccaccccctgccccacagctcaagtaattctctcacctcagcttccccagtagctgaaaccacaggcttgggcaaccacgtctggctcatatttttattatttgtagagacgggggtcttgcaacattgcccaggctggtctggatctcctggaaccgcctttgcaaaattataactgaggaaattatggcagtgaaagaaatcagacctaacggattccatcttgcttctaacttttgtttttgagactagtctcgctctgtcgcccagggtggagtgcagtggcgtgatctctgctcactgcaagctccgcctcccgggtttaagccattctcctgcctcaacctcaggagtagatgggactacaggcgcccacccccacgcccggctaattttttgtatttgtagtagagacggggttttagccaggatggtctcgatcccctgacctcgtgatccgcccgccttggcctcccaaagtgctgggattacaggcgtgagccaccggccgcttctaacttttaagctgtccttcttcattcctgagcctaggctgaaccaatttagggaggaattcagtttatggtttgactctgaaacaaaattgataatatccctttcccaaaaagaccgcttttttgcctggggaccagtctgcctttgcagaaccaacagattagctacaagattagaaattacagtttagaggtcatgcagcctctggctccaagtttctgaacctccccaaattgctcctggggataacatcactattgtaaaacctaagataagttcttgagatattttgcagaccctgctctccatggatcagttgaaaccacccagattggtaatttggctcaaccagttctgccatcctacccaggaacagaaaacagcaagaaaaactcacgtctacccactatgagtccatctccaacctgacccatcagcactccctacttcccaagcccctaatcgccgaattatctttaaaaactctgaatactgcttggggagactccattgcaagtcccctgtcttgataaatgggctatcggtcagcagcaggcaaagtgaaccacaatattgggtggttacactcctaggatcaagcaatcctgctgtccggcttcccaaagtgctgggattacaggcgtaagccaccgcgtccagctagaacaaatgatttcttaaaagcaactcagatatttaaatattatttaaaactgtttctagacaaatcggagtgactatgggacaagcatatggtcgcaggactttggacgcaggcagtgaggacacctatgagcgatcagtggggtcctacggcagccgtggaactgctctgccttgcaggcgaaagtgtggtcagctatatcggagcgcgatgggggcctgagaggcgcatctgcgcaggcgcccggctcctaagtctacccaggaactgaccctgctctctcctttccctgttagacatggtaagtgtgagtttagcgctgctgtccggatgggttggtagcagacagggtggagtagggttaagcacactggtcaccttaggattggtttcctggtgctggagaatggttaggacacaggccttggaaggttttttgagtgtgaaatattactcagcgttttctgcagacctcgcgggcaatgccgcttctaattttatccaggccttcttctgtagggagggcctgttaagagttgagcagcccgatttctgaacccctctaaaaagctgtggctgattggtggcttttttttttcttggagagggggtgtcaaagatttctttaaaatcgttagtgatgtggtctcgctttaagatttttaatgggatcagaagaaaattcggtacttaatcacttccggtaatcttcatgacctgttatagtgactgcagtgtactctcaatgaggaagatatagatacgaaaagaactagagccgcatcacatggggacttctgcaaatacagagactcggattaaaggtggagaagatggagctaaaggaactgcttatttaatacatttgaacaacttttggggtacttagaaggtgctttgaaacctgcatttgattaagcaagaattcgcttgcaagttaagggttagatttttttattttttaaaaatatgctttctgccacatgtaaaccgtaagttgtcctgaaatgataagctttgatattctatggtgtttattttttacttatctttttgaatgaaaagtgaacaacaagaaatgctggtggtaattttttgggtcaatgatgagttggcatgtattctgaatctaaagttgattattactactttagctctagaattactctgagacctgaaaattacctgaatcgtgactaagacgaagcctgaat

SEQ ID NO: 686 - DNA, 2412 bp, Homo sapiens
cataagggtgaattctcagccacagccaggtgtgggctgtgccaggacatactgaccttatttcctcttattctctttcttatcttcccatttgcagctgttcctttaactgagtgcagccactagtctcctggttcctgccaaggaggaaattcagaggctgaggagggaggatcgcttgagctgaggagttcaaggctgcagtgagctatgatggtgccactgcacaccagcctaggtgagagagtgagactctgtcttaaaaaaaaaaaaaaaaaagacattcaggaaagcttggaccaccagtatactcaattagaccattaaatcttaaatcgtcacatggccttgagaaagccacatagcatctctgaaatatagcatatcatagcatctctgaaacatagcatatctgaaaataaatacaccctctttgcttacctcacaggttcttgggggaatattaaatgatatattatgtacgtgctttataagcagtaaaatattacataatgctgtggtaaccctcacagggttgataagctagggagccttaagcatcacctattaccccgtatttattgtgtactgggccttcttctaggcacttcaccgatcttaagcccttgaatctgctgagcatcccaatggggcaggtactgaacagggaagttaagtggcttgtctagggtcacacagtaagtggcagagctgacattcaaggccaggtagtcaggttccagaacacacattgttaaacaccagaccaagctgcctcctgtgtgccccactgacacttcctgtgtcctcctccatgagcccctggcagagatgacaattgcttgccttaacaatagataagctaccagaagtcagggcctgtgcctcattcacacacgtccacagtgcctgccacatagctagagttcagtagatatttgttgaatgaacaaataccctccagggagggatacaataagtctgatacaactactgtatttttccttcattttttcttggctaaccacactcatttccttcagttgtttccaaaaggaggttggcatctctcactgtcctcattgacctcctttgcactttctccacgtcaacagtgacccatctaaagccgactactgtgacatgaacactgcacttgaagagcctgaccagcgctgggctcagtagaactatcctttcttctcccatggtgtatcctcactgtccaggactctcttctcagaagcccactccttcccctgtgctgtttatatgcttaatgaaaccaagtacccaaagtgaccgttcaactgttactaggcagctaagtagactccattaaaccttttccttccttcctccccttctttctttctctcccattcttctttcattcttctcgtccttccttctatcctttcttccttcctgcctccttttcttcctctcctctgccctttctttcaggtcttttttgtggtaggaactggtaagaaaaggaaaggaattccctaagattttaaggaaacaacaacaaaaaccaggttatgtttggtgagagagttggggcaagaaactgcatcttctaatatggaatccaggtaatttatcagttttttttcatagcatgactacggtgagatttcttgtaagaaaaaaaaaaaaataccagcatcgctggcctcatatattggattatacttaaggggatcaagggataagatgtttgaatttggagatgtcttgaaaaatcctgtggtgagcacaaatgtttgcagtgtctctgctggactcctcaaattgggaaaaaagagactctggttctcatcatagactcaaaacctgaggaaaagcgagatgcgattattagataaactggcaatgacacgcacaaaaatgtgtctattccagccagggcttttcttttcagttgtttgttttggttagagatgactttggggaactgcatgtcccactggacattccaagctgcgttgtcggagtcgcgggtcgcggcctccagtcagcggagccgccgcccccagggtccgccacccagaagtcggcggaggggggcccgccggcgggagcgcgcgccccggtcgccgtctgcgggtagaagcagaggaaagacggtggcctgggagcgcgcgaggccgcacgtgcgcgcgcccgcccgcccgccagccagtccgctcgcccacgcgcccacgcacgcgcccgcccgcccgttggcccgggaagtctcgcgatgccgtagccggctgctcccgctgcgggtggctcgggctgttgctgtggtttcctgagttgctgctgctgcggcggcggcagcggcgtctgtgcttgtggaggtgtcggcctctgggcggatgttgacattgtgttgttgttattgctgatggtaatggc

SEQ ID NO: 687 - DNA, 2393 bp, Homo sapiens
acgtgtcagtgcacagtatccaggcccttgggcaggtctaagctcccctgtgttctatgtccccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcagggggtgagtaccagccgcacgggcggcaggaggggtatgggggcgctgcagggtggcctcagagcgagcatgggaagccctgagggtgtagcctggacaccctgagatgcactgaggcttgagagcacaggctctgccctgggatgaggggtgcagccgaaatccccaccgcccgcctgtgcacggtgcccgctggccagccaggcggctcccaggagcagctactcagagaaccttcctggagggtggtggggacccacagcctgcagcaggctggagcgaagcgggcagcgagcccagctcacatagaccccagcctagcctgccgtcagtctcaagcccaggctgtgcctccacccttccctgtgtggcctccagtcgaggaggagtcgggtgtttctcctgccagaggtcatctgagctgagctgccaccccagggagtgaggatttactaaaaatagaagctggggtcactctgtgtccccaggcgaggggctgggggcctccaatctccttgcagaagcatccagagacccatgggttaagaggggggcggaggtgggtttgggctgggaacagccgggagagatggggcttggggctctgcccccaccctcactgggtcctgtaacaccaggcctcagcctggcccagcctcgggttccctgggcagggggacatggagcctcaccatagggacctcggggtgggcgcttggctcccggggcacccaggtgcactcctggtctccggtggggtcctggtgatgggatgggcatggcatcccttggccagacaccccacccagcgccccaggcggccccagctgctctccagccctgcccccgcccactctcgttgcagtgcgccccggagaacaccttgcccactcccatggtcctgcagaggtaaggcccgcaggggtgctcgggacccctgagtccagggggcggggtttccaggttaagacatttgtgaaagacccggagaactgctttggggtcggggaggcaggcaagcctggtgactcagtgaagctcccggtggggccctggtgctcagaggagccccagggtgggggctgggaggggggcatgaagccccttcccccagggccttcacagaccccaggggtcccctgaggggtgcctcttggtgaccacctacccccaccccgtttcccaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggttttttttttcctgtttccacccctccccgttattttttcctttggatggttaaaagcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgacc

SEQ ID NO: 688 - DNA, 2298 bp, Homo sapiens
gctgacactcagtattaaccaacacaccatttttattagtcatgcttgagactaaattaaacattagtgttcttttttttttttttgaggagtcttactctgtcaccaggctggagtgcagtggcgcaatctcggctctctgcaacctccatctccttggttcaagcaattctcctgcctcagcctcctgagtagctgggattacaggaccttagataaacttactatcactttatagcagtagagaaagcacggaaattggcactgtatttgttttctattgcttctataacaaattaccacaaacttggtgacataaaacaacacaaatttattgcttaaagttctgtaggtcacaggtctgacaagtgtctcattgggctaaaatcaagttgtcagcagggctgtgttccttctgggggccttatggaagaatctgtttccatgcctttcccagcttctagaagcctccagattcctaggctcctgggccctttcctccatcttcaaagccagcaagggcagattgaggtcttttcaagtcacatcactctgacctcttctgcctccattttccacttttttttttttttttttgagaacgagtctctctctgttgcccaggctggagtgcagtggcgtggtatcagctcactgcaacctccgcttcccgggttccagcaattctcatgcctaagcctccagagtagctgggactacaggcacccaccaccacgccagactaattttttgtattttagtagcgacagggtttcaccttgttggccaggctggtcttgaactcttgacctcaggtgatccacccaccttggcctcccaaagtgctggaattaaggcctgagccaccgtgcccagcccattttctacttttaaggaccttatgacaacactgggcccacccaactaatccaggataatatccctaatttaatgtcagctgataagcaaccttaatttcatctgtaacctcaattcccctttgccatgtaacctaacctattcagtctccaggaattgggaagtggacatcattggcagggggcattattctgcttgttataggcatacttgcccacaagtctaaatcgagagtttgcatataggaggtaggaggtgtgacaataattggataaaggcttttctggaatgacaaaattctcttcaaatacagggaggccctgcgacatgatatctggcaaatcacttgagtcttagtatccaaacttccgctaaaatggaaattaccatcctttgcttggcatgttaaatgaaatacttatgtaaacggacttagattagaggcctacaaataggactcaagttcttgatgaatcttgatgaggagggtgggcgaagtactctaaatgaaaatgagatagattgcgagatttccggagaggagtgagtgacaagcgcctacccgtgcatgaagctggaggtagaaaattccagcaaaaggaattttcaagtttcactgaagcttttgaatcaaggcttgaaagcccagggttaaaaaaaaggcagtgaagaagctcattaagacaaccccccgccaggtagcagatagcacctgaaatgcagtgggaaatttgtgaggtcttcataggcaaggattaaattttacatctccatcttaagatgtgtcatagttgttcaattacttagtgaccaaaaaagtgaattaaagatgttgtcaagattaaaaaaacaaaaaccaatgcaggttccaccgagatttgaactcggatcgctggattcagagtccagagtgctaaccattacaccatggaaccgccacgcatgtgtagctgccttcggctgtctaatcctcagagaaccccgcccccatccacaaacccaccactcacaggcggtcccgcctggttccagcgagccgcttccggcacggtagctcgagaaatgagcaagcggccactaagactatggtagctaggagttccaggactcagtttcccctttgagcctcctttagcgactaaagcttgaagccccacgcatctcgactctcgcgcacaccgcccttgttgggctcaggggcggggcgccgcccccggaagtacttccccttaaaggctggggcctgccggaaatggcgcagcggcagggaggggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacct

SEQ ID NO: 689 - DNA, 2246 bp, Homo sapiens
gccttttcctttgaggcttatgttacggagctcactgttcattactactgtcttcattacttaattcatttaagactgacacctgttttataatctctccttccaccctagctctgccatcattccagatggatctcatcattcatttaatagcctataatcatagttcatgtagcattcactacacaccaggcacggttctaagcattttacatatattttagttcactcaacccttataatagcacaagctattattacgcccacttctcacataaggaaactgaggcacaaaaaggctatttagacttgcctagagttacccagtcatgaagtggtagagtagggatgaggacaacggagtcaaattgcagagtccagactggcctcccagttccttataactgtaccatcctccacatctactctgcattggtgctgtggaggtgggagagagggagtacctccttcactgagtcactggacatttggaaggtctttggagagaagtcagctgaggatggcctgcattgccccttcctggaactcaatgatttgttgttatcacccatgcaaattcaccaacaaacagataaaagtcaggaagctgggatgcagctgaactgaaaacccagcagcagaaaagcaggttatagattctgctctgggtgctccatacagctccttcctctctgccccaataacctccctctctttgggaacattgctgcattcagggcagtctgtcttccctccctatgggctgtctttagaatgtgtcccttgcctatatccatattcatgctccgtgctcctcagccccctagaaactttgcacaatagattcaaaacctctggtttcctcccttcctctgtctgaaagagtgaaagaaggaagccagggatttcagggggcagccaggcagcagtatcaccacccctaggcaatcacacctagttgcagcttcatcgggaacagctcagctctgaaaacacagacctgggactctccctcccagccttctagctctcgttcctgtgagcagcttttcaacctccacttccagccgctgacaggccctcctggctccacaaggccagctaacatacccaccttccacaatccccagccctgccagacataacctgcaacaggcattcctggatcaatgcaaactccgacttctgttccaggagtctgcctctgttagaagaatctcacacaagtgtgcgtgctgtgccattgtaaatgctgtataaggtggccaggcccaatcagtccctgcaagacaccgaacagtaagaactatctatggagtgtttactatgtgccaagcaccgtcctttgcaagcactattaaccctcaaaataccaccaccgtgagattgagaccatcatgattcccgttctacagaaggaaacactgagacttcaggaggtcaggacctttccagggtcacaactgcgtaactaagttgcagagctcaacccagtggcacttccatctcacacgcagctgtctgatggtcaagagcccaaccagtcccccggtcgtttctaccgcactaaaccgctgtgtcaagctggagcagcgggctcagcagtgaaaatgaaagaacagaaggaggttacagagaagagaacggtcacggtaaattccggagaggaggcaaggacgtacacaccgagatacttcccggtcaccgttactcagcactttgtggggttcacgtggctgggggggccggggcgtggcggcccttttcgaggaatccagccctgcctgggcggtccccatctcgagcgtgggcgtgttcgattcaggcccggcggacgcatccccaggtgacccgggagggaccttgtgtctctgggggtgactgtccgtctccccgcctcccaccgtcacgcgcagtgctgatccccacttccagctggagtgcgagctgggcttggggttacaggagccgaagccctggagctccgccccacgcttgcgccagccccgccccgatcccggctcgcaggctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagag

SEQ ID NO: 690 - DNA, 2225 bp, Homo sapiens
agctcaacaattccaaaaccaaaattgtgagtcagtttgttctttctttccttctttcctttctttttctttttctttctttctttctttctttcttttctttctttctttcttttctttctcttttctctttctctttctctcccttccttctttccttccttcctgcctcccttctctctctctctctttctccttccttttttttttgagactgagtcttactcactccctcgcccacgctagagtgcagtggcacaatctgggctcactgcgctgcaacttccacctcccaggttcaagcggttttcctgcctcaccctcccgagtagctgggactacaggcgtgcaccagcacacctggctagtttttgtatttttagtagagatggggtttcaccatgttggccaggctactctcgaatccctgacctcaagtgatccacccgccttgacctcccaaattgctgggattacagacgtaagccaccacgcctggcccaaaattatgagtcttttcaaaaattttatatcaaaaaggtgatatttaatgtggaatttgagtgcatttaaataagatagtgacttcgtagaatagggactgcagagtaagagtgttcagacccattcgagtttaatatagccctacctctaagaatcctttctgttcctcactcaaatgaactaattgctgtctttcagttcctctaaaaaccttggggtccgtggcagggtgtgggcttaggactcacctgattacttgtcttcccaggtggtctctgggctctatcaggaacaagccaggtatgatcatccttttccccagtccttagcgtggggtctggtatacacacgcacacacaacttcagtaaatggtgaatgaaacgaaaggcagtcaagatccacctgttgaatgaacgtctatcaggagcactgtcatccttcttgcttccttcttttgcatatgttgtttgagctgctcattcaaccaaggagagagcatactctaccttgggcagtgtgccagccttgcacagagggacagatgattcagcttgatcaggctgtgacagagaaaagctcagggtctgagagcacacaggatgcgactaacccagactggagggtcaggagagtctccccaggggaaatgaagttgcatccagaaggattcctgagaataatgattagcctgatgagaagcagaaaggttgggagtggagggaagtgggtttctgtgagagaaacaatatggacaaaggccccaggcagaggcaatagtattccagataacgaaaagcattttagagagtctagtttagaatttgtgaaggaggtgacaatgctgctaatgagattgaaagggagtcagatttgtaaaccatttaaggattgtcttaaggacagccttgaggagacactgaaggttttaacaggagaatgacatgatccgatttaaattttaaaaagataactctgtcaactgtgccaacagtgaattggatgtgggcaatgatgaactcaggaacagctgagagtctattgcagaagccaaggtgagagatgatggtggcttggactttggtgctgggactggaaagaaatgaacaatctgatatacaactggaagaataatctctctggctgtgatgtggaaggataaggacgtgattggacaggcagggatggttcagtaacgagctaggactttattgtgaagggataaaggggaagcttttaacattttaatcatgggactgatccattccgatatgggtttatataaatagaccgcttggcggagggtggtgagaagactgtcaggcagtgcacaggtaagaactgagccctagacggggcaggagcaatgaatgtggggaggcgcgggagacgggagattggtttcggagccaggtacggagccaagcagtcagagagaagcaaaaattgacgcagcaccgagaacagctgctagtggagagggggatgggcgccgccggagccgccctcgcctcctggcgccgggggcgggaccagagcacgcacggcgcgatgacgcagtgcccgagccggcctcgttctggctgccgccgtctcgctgaggcggagtaggatgaggcccgcggccgtggctccggcgtcggcgggggcagcagcagctgaggcagcagctgaggcagccgcgacggccgcgcccccccccgctgacctggattaggcccag

SEQ ID NO: 691 - DNA, 2206 bp, Homo sapiens
tcacacctcttcctctgaactccatttttttcatccacaaaaggacattataaaacaccctgctggtgtttaatctatgtgtctatcaaatcagtcatatgaagtctctaacatgcacgcaataaacactatgtaatgttgttgtattgtttccagaccagtaatggctggctccatggaggcagctttatcagtcccagcattttccataaggcaagcactaactatttattggacacatgaatgaattaatgaatgaccaatgaatgaacatgtggctggccatgggcaaattacttaatatctgtgtgccctagtttctgtgtgtgtgtgtgtgtgtgtgtgtgtgtgtgtgtgtgtactcacccaggatggagtgcagtggtgcgatctacactcactgtaacctctgcctcctgggttcaagcaattctcgtgcctcagcctcccaagtagggggaattacaggtgagcagcaccatgccctgctcattttttttttttttttttgagacggagtctcactctgtcgcccaggtgggagtgcagtggtgcgatcttggctcactgcaacctccacctcctgggttcaagcgattcttctgcctcagcctcctgagtagctgggactacaggcatgcaccaccatgcccagctaatttttgtatttttagtagaaacagggtttcaccatattggtcaggctggtcttggattcctgacctggtgatccacccgcatcggcctcccaaagtgctgggattgcatttttttttttttttttgagacagagtctcacttgttgcccaggctggagtgcagtgcaatctcagctcactgcaacccttgcctcccaggttcaagcgattctcctgtctcagcctcctgagtagctgggactacaggcatgtaccaccacacccggctaatttttgtatttttagtagagacagggtttcgccatgttggcctggctggtctcgaactcctgacctcatgtgatccacccaccttggcctcccaaagtcattttcgtatttttattagaaacgaggtttcaccattttggccaggctggtcttgaactcctagcctcaagtgatccgcccgcctcgcctcccaaagtgctagaatcacaggtgtgagccatgcacctgacccagaaatttattttaaacagataatatatacatatggcaaatagaaagttaaaagagaacaaagaaccaaagttcacaatgaaaagtaagcctgcatgcctaccctaccttttcttcaggtattcaatgcacaagcatacgatgcatagatagctctattatttttccaattttacacatgaagaagcagaagcactgaaaggttatagaacttagactgtgctaagatttatcagtcaggagttttgtttcatttgtgtatatcagggcttcacaacctttacgctattcggcattttttgcagggttttttttgggggggtagtggcagggctgggggtggaaagggtgtcctatgcaccgcagaatgtttagcagcattccaggcctctactcactagatgccagtatcgcctctccacttccccagttatgacaaccaaaaatgtcttcagagattgccaaatgtcgtggtggtggagggatgtcagggcaaaatccctgataaatggagagaatgtggtatatccacaaaaactccctccaaaaccactggtgtgtatgactatacatcagaccacccctttcttttttctgtgttttacacaaacagtagcacgaatacaccccgctgcgggtctacttttcttttcttacaccactttttggtgatcattccacttcattgcttacaggcagaaaggaacttctcttaaacagaactgaccgggagaagtggtgagctgcccgtcctaggggtaagccagcgagcagacaggggcttccagggcggcggggcggggttcccggggcgagcctccgggaaacttcccgaccagcctctgctcacctcgcggtcccgaggcgcagtggaggggatggggcggggcggggcggggccgcgtatcgggcccgcccccgtacgtcacgtcgccgcggccccgcccccgcgcgggcacctcccccttccccggctggggcggctggagagccgggagtcgctgggtgcgtggggctgcctcgccgcgtctcgccacggtaggtgg

SEQ ID NO: 692 - DNA, 2047 bp, Homo sapiens
gattcctttgctcacatgtttcctgctgaccttctccccaccatcaccctgttgccctgccacactcccctcgccaagatagtaaaaatagtgatcaataaatactgagggaactcagagaccagcgctggtgcgggtccttgcacattgagcgccagtctcctgggcccactgttctttctatatactttgtctctgtgtcttatttcttttctcagtctctcggctccacctgatgagaaatacccacaggtgtggagggtcagacccccttcaaaaagctcatatacctctctaaacagttctacaggaataaatggaggtggctgccaatatcccttaagccacctcaaaaaccaagttgacaaggtgtatgcttttttcttttctctcgggaaaaataccagtgccctctggtgtccaaagtgcaccttgagtagtaccacgtagatcagtttatcttcaaagaataatgtactaattcaatgttagagataattttttaaaataaattttggaggctgggcacggtggctcacgcctgtaattccagcactttgggaggccgaggcaggcggatcacttgaggtcaggagttcgagaccaacctggccaacatggtgcaacaccgtctctactaaatacaaaaattagcttagcatggtggcacacctgtagtcccagttacttgggaagctgaaagaggagaatcacttgaacccaggaggcggaagttgcagtgagccgagactgcaccagcctgtcagggcaagactctgtctcataaataaataaataaataaataaatattggagcattaaattctgggcagcaatatacaagcatgctattgtcctacaaatcacaatataaaatactctttattttcatgtttttgagagcaatgaacacacaaaatataatctctggaggagactaaaattcttttttcaatccaccgttttctaaggcttcacatctctagtccaacttcattggatcacagataatcccccgccaactgagcatggtggctcacgcttgtaatcccaggactttgggaggccgaggagggccaatcacttgagtccaggagttcgagaccagcctgggctgctgaaacccatctctaccaaaggaaaaagaaaagaaaagaaagaaagaaaaattagttgagtgtgattgtgtgcacctgtaatcccagctactcggaaggctgaggtgggaggatctcttgagcccaggaagtcaaggctgcagtgagcggtgatcgctccactgcactccagccagggcaacagagcaaggccctgtcttaaaaaagaaaataataagaatcccattcattatcttctaatgcaaacaatcaatggagtttctaaagacctagacataggtggtgtcaggacctgcttctgtaacttttccatcctttgcattaggcagcgcggaaccccctaggcgaccccgcgctggccgggagcactctttcttcagccaaaggtacgttccattaccgcccctcgggggcgcgctaggcagcgggccggccaagctgccgccgcccagggcgccctgtcccgttcgcttttgtgccgacctggaaacactctgtggtgctctagattgttacaaagttcggggtggtgcagccccagcgcgccccgctccccggcctgcaggtggcatacaagtctcttcgctgtcgggattcgggactgaatctctgccgggcggcaaccccttcccccaccgggatcaccgggaaagtggcaccatggattctccatctttgactgtggccacgcccctctcgctgactccgcccatcccacgggaattggcgtgtggcgattggaggcgtgtcgggggcggggctgggggaggtgggctgaggaggcggggcctgggaggggacaaagccgggaagaggaaaagctcggacctaccctgtggtcccgggtttctgcagagtctacttcagaagcggaggcactgggagtccggtttgggattgccaggctgtggttgtgagtctgagcttgt

SEQ ID NO: 693 - DNA, 1797 bp, Homo sapiens
tacacaattgacccagtttgcaggtgggaaatgggaagccagttctgcaaattggcctttctgttctgtgaagtgccatctgtcggtgaggagagattagggtctgcagcgtgaaaatctggaccatactctgggtaatcaagggagaggttatcggctaatgacaaattaaaggcttactttttagctggcaactgaatcaccataacattttatgttaccagttccaaaattttggggggaattcactcaagcttgggagaggagagatcataactttaagagtataagaggtttaaacggtccactacgaaataaatagagaaggaaaagttatcagctggtaaatatcgtagaaggtagagcggtccagggactcacaggtctcactaaagaaaagtctagcgtaggttcacggcacggagagattttaaggctgcctaagactaaagccaaatacgaagtccacatctgcggtccgcaccttatctctccgcgcggcaggcgcgacgagggcgagaaactccctctccagtggtcgcaccacacgacaccagggaaggggcccctctctccagaccctcatatctccaggtccaggccccattttcctccgctgacagctcagcagcgtgcgcttccgctggattcaggccaggaccagcgaagccgcaccttacacccaccgaggaggaaacaagcctggccacccgaggctaccccgctaggccgcgggtagtgggggagggggcgctgaggcaggaggtcagcacccgggcgcgggctcccgccccacgaaaagcgcgcgctccaagccccgccgccggagatgcggttccggtccggacgcctgcgcactacggctctccccgcagcctctggccctccttccccctcccccagtcagggcgcacccttgcgcctgcgctgtgtgtgttcctggtctgcggcagccatgctgaactcgtatggagaggcgagtgggggggacagagtccaggactgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtggccgcgcggccccgatgctctccccacccccccagcccgttcgggaagggaggggctgggggctacgccccctcccccagcacggcttcgttttctgggggggggttgacaccccggattacataccccgtaccaagccgagggcaactttggaggccccctggaaggctttaggatccaggtgagaaggggcccttgtggggcggagatgtcagtcaagtgcttaaccaatggtggggagtccgggagggggattcttggggttcaggaaagaatcctgagagtgggaagatttgtccttcaaaccttttacagccaatgggagcgtggagggggggcgagcgggagagggccatggggggggaggggaatggccagcctcatgcctccgtacccattggagggcaaaggggttagggggcggtgtggccccccctattccattcgtcccctgggggtacagcagccgggagccaggtgagaagggatccatcggcggccgagggaggggtgacctggcggtgggctgaggagtggtggctgtggcccctacccgtggatgtgaatgctttaggagttggc

SEQ ID NO: 694 - DNA, 1796 bp, Homo sapiens
ctcctgcaacaggaaaccagtatagacccagaggacacagtagagaggaacccacggacatatacacatagagaggttcaggtgcacacaccgagaaagtgcaggcaggtagacagcaagaagataactgcccacagagaggacgggcactgtcgcaaaagggacaggtgaacacgcacagagggatctggcttggttacccccaggggctcaggtgggcagggtgggtcaggaaggcttacctctctgttattcctctccaaaaatgctacggctgttgggctgaccatatggtccttcatttcctggaggtaaggacagcattagggaggaaagacactcaggctgggcgcggtggctcacgcctgtaatcctagcactttgagagaccaagccgggtggatcacctgaggtcaggagttcgagaccagcctgatcaacatggtgaaaccccgtctctactaaaaacacaaaacttagccgggtatcgtggcaggcacctgtagtcccagctactcaggagactgagacacaagaatcgcttgagcctgggaggcggaggttgcagtgagccgagattgcaacactgtactccagcctgggcgacagagcgaggctctgtctcaaaaaaaaaaaaaaaaaagaaagaaagaaagaaaaaaaaacacactcaaaccttcccccactccccgcctgcaggacctttcctgacctggactgcctctcgcatccgctccacgaacacctttctctcctgcaggtccccggctgggagcttgaacttgcctgggttggcttccactatacgtgggctgagagtcaagggtcaaggccggagccagatatcatccccgtccctaggggtccagccctacccgaaggtgggctgccaccgcaatgggctctcccatgccaccctctgccacaaagccccaggatatcgatggtctcttccaggtcctcgaggtcccactcgatgctgcgcaggccattccgcagctcattggtcgtccagtccagctcctcgcgtccgaccgccgcgctttcctgcaggagctcgcaccagcgctggtacagcccgcgggccgtgttcaccgccttctgcacctcgctgcgggcaggggcacggcgggcgcggctgggggcaggcggtcctcccgcctgcctctgcccccgactgcaaacccaaacgcatgggggactccggagacccctatatacccctgcgtgcgcctcccactctgcaccccgacggccttgcccagcccgccgggcacgctggggccggcacccgggcactggctggcttgggtacagagcaccctccgccctcccccgtcgttgtcactcaccctcggactacaaaaaaggggtcttcgagagacatgtcagtcccttcccccccaggccgaacccccctcccggcctgggttcgcgggctggttccctcccaaccgaggagaacgcgccgccacccccgcccccgtcacgccaccatcgagagccggaccgccaggggagaaagagaagcctcggaggcccgacgtgcggacacttccgccctctcctcagccatcttggttgtgggcagaggcagcttccggtgcacatgcccccgccccttagccctctcgtgccgcaccgtagggggcggtgtcggagttctgtctgggcctattcgggtccgagttcggaatttcggttcaaggcccagttcctcggattgttcctgcgcaacttcagtttcccttccaggcacgggcaatgtaaataatgatagcctccctcatctctgg

SEQ ID NO: 695 - DNA, 1793 bp, Homo sapiens
ctcaggaacgtaccctgactttggtagacacaggcattggcatgaccaaagctgatctcataaataatttgggaaccattgccaagtctggtactaaagcattcatggaggctcttcaggtattgcagttctgtaggcattcatacttatctgtgttctttggttttttgcttctttaaaacttgtgattgactttaaacttgttggcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtaagttagcttttctgttacaaggtagttgggttaggattttctgggctcacaccagtagcagaaattttgggcatcctgtctgtaaagcagttcttcacagcagttctgctgatacttactaattgctggtctcaactgcatatactttttaccctgttacacgcttgtaattgactcttctaggtgagcccattggcaggggtaccaaagtgatcctccatcttaaagaagatcagacagagtacctagaagagaggcgggtcaaagaagtagtgaagaagcattctcagttcataggctatcccatcaccctttatgtgagtatggacttttaaatcttttacacttaacgtgcaggatgtttcctgttctggagaatctcattgtccctggcttttgctttccctggtagtgttttgtactccaaggctaacttctgtttttgttacttagttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaaggtgtgagaagcctttgcatgttggctcaacatgcacatatggagaggaatgagttaggtggaagagtgttgggtaatagacacacggaacttgtccaactgataacagaaatgtgatagccatgtgatttcacttactgattaccctgtcatagtgaagtgccatcatttctaatgacctcactttctcttcttatggaaatctgggtaatgtctattggcagccttacacatccagggttctgatcagaggggactgttttctacatacagctagtacccatctagatcgtggagggcattaaggctcagttttctcaggagctgcttgttgtgtgtgctctatcccttaggcttagggaggatcattgttccacttttagataatttggtgttggggctaaaaggtcctcttttgaaatgtaccacttatttttggtttctttcagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcagtgagtatctccttggcctaatttagttgggtgaagtcttggga

SEQ ID NO: 696 - DNA, 1710 bp, Homo sapiens
tcccagaaagacctctgagtgagcacaggggccctagaagaagtttccttgtgtccttcccgttttagggtctgtgacctgaacccctgggcttctgcctcaggcctcctgtgctctgctctctgcctgctgggtcccctcaccaggcttctgtctggttcccaggctacctgcctggagggtcacaccaggaggatttcaaacaggtttcaagtggggtcacttgccatcactgtgccccacgaggtacactgttgtgggcggcagggctggcctttctcatctgggacatgccacgttgctgttcccaaggggagtggtgagtgggtctgtcctggtgtgcctggcctggggactgccagtgtccttacttggacactcaatgaaaaggccacatgaatccctggggcgtccagagcatgggtgaccagcacgggctcaccacatgaggccaaggggctgcaccatacagcctctcctttggccacccgtgactacccccaactccgggccatggggcttccctacccctgggtgtcctctaagccagctgggagacaacagcctgagtccgtgtctgcttctgtattttgtgtggttttagaggatccctgggctgcctggggaagcacccagggccagggagtgtgaccctgcaggctccacacaggactgccagaggcacacacctgctctgtctacccgagggcaccagagggcacgagaaggctggctccctggcgctgacacgtcaggcaactgaggcacaaggctggcatttctgaaccttgcccctctgcaaacacaagggggcgatggtggcactccaagcaaaggggcgtgtgggtgctgcaggaggagcacagagcactggcgcccctcccctcccgccctgcagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggtggggtccgggccagcaggtgctcagctctgggacagggacccaggaccaggcatcaaagcccttacaggagaagctgttatcaccccatttccagggggctgggaaccctgggatatgcccagatagggctggggggctcctctggagtcccagggtgccagggtccctgatgacccctgcaggccctgctgcctgctgccccaggacaacaggcccccacactcacagggtctgacggtggtgcagttccccttgaactctgttctggccaccatgggacctgcctggggaccagtcagacaggttctcctgggcccgcctcccgcttgaacttcagcctggggcacaggatgtgttaccgggctcacggagtgactcagggaactagtgccgccccagggccccaaggtgggcggttcggtgattcagagagggcagctctgtgttaggacacactggggccagccaggaagggtggaaaagatagggaccagcgtgagcatagaggctaagggaccat

SEQ ID NO: 697 - DNA, 1688 bp, Homo sapiens
ctgagcttcagcacagtagaccaaaccaaaacagagttactcaaggtgaatttctacccaaccacgcctaaacgaaattgtttatctgaccttctgagaaatcatcaaatccccaaactggtcagttttaccccacataaggaagtccattctgcttaaacctttacaagaaaagtaattttgaaatgactaatctgctttttgttctctgtttctactttttaaaaaaaagtttagacagggtctccctctctgtcactcatactggagtgcactggcacgatcgtatctcactgcaacctccaactgctgggctcaggtgatcctcccacctcagtttcctgagtagctagaactacaggtgtgcagccacagccactatgcttggctaatttttttttctttctctcttttaaattaaagttagttttattcaaactattttattcagagcccagctaatttttgtatttttaatagggtcgggattttgctatgttggccaggctggtcttgaactcctggcctcaagtgatctgccccctcctcagactcccaaagggctggaattacaggtgtgagccaccacgcccggctgcccaactaattttttaaaaaatatttttattctttagagacaggggtctcgctatattccccaggctggtctggaactcctggcctccaaggatccttccacctctgcctcccaaagtgttgggattacacgcatgaaacactgcttatggcctgtttccgcctctgtctcctgggtaatggggaccacaggtgcgcaccgccacgccaggctaaagaaataaagtgatgtactgtatgaagaagtgccgtaaagtgatattaaatgtaaggtattgtcattattaacgttattattattattcctaatatgagatagactaaaggccataaatcaattggtattaacgctagaataagaaccataaattggccgggcgcggtggctcacgtctgtaatcccagcactttgggaggccgaggtgggcagatcacgaggtcaggagatcaagaccatcctggctaacacggtgaaaccgtgtctctactaaaaatacagaaaattagccgggcgtggtggcgggcgcctgtggtcccagctactcgggaggctgaggcaggagaatggcgtgaacccgggaggcggagcttgcagtcagcccagatcgcgccactgcactctagcctgggcgacagagcgactccgcctcaaaaaaaaaaaaaaagaaccataaatcaaacgagtctataaaggagttccacaggtattccaatgtttggctacattattatcagtgtatattattattgttactgtatttttagtgtactaagtgaaaaacctggacttggagcaactgcaagtcccattattttgaatgccctcacagtggggttggggcggaggtgggggaggaaataaaaaaaacaaaaccaaaacaaacaaacaaacaaaaaccaaaaaacaaaccacgagacccggatgtaggcaaaaactacatttcccagaatacctcaccccctctccactatatatacagtccatccgggttctttgagatgctgtttggcgactcgtcgccattcccggagcaggtcggcctcggcccaggggcgagtatccgttgctgtgtcggagacactagtccccg

SEQ ID NO: 698 - DNA, 1498 bp, Homo sapiens
taaatgggtaattcgctgtttggaagtaacttgggccttgcggtgaggtcgcacctcctcagcccctgccctccccccagccaccttcgcacattcactgccgaaccagccagatttagtttctagacagactctgccaggggagtttcgagggggcaatgcggagagtgcgcagcgaaccgcgggccgacaaatgtgtgtgtgtccgagtgtgtggatccttggctgcgtgtgtgtgcgtgtgtgtttgtgtgtgtaggggagttgttctcgggtccaggacgtagtagccttcgtctcctccaccccccgaccctctcaacggaagaccctccccaggaggcccggcccaagagtcccctgtcttctcctcccctcccccgtgcgctccggtgctcaaggggttagcactatgcgcgcagaactcggagccatccccgcggccttttcttccccgcggtgcggtgccggctgccccctgttggccgccttgaggtaggactcctgcgagcctcggttccttggggcgggcgggcgggcagctgctcccctctccctcccacccctgctcccttcatccctcccgaccaccagaccccactctcccagcaggggccctcggaggcccccagaggaccagtttcgctgcgccgccggccgctgcaatacggaaggggccacgggtccagcccagcaaatgggactcggccagctggacacagggttggtacctcttcttctgggcttgggaaggagagtgtcgccctaggaggcctcgggtctggcctcagctgcctcccaactctctatgatcgagaacaagtgttgctttcccgcttttcgcctcactttaatcgtctattaaaaagtgggagagaaactacctttaaagagtgggggttggactatcatttcattttcttcctctgtccaaggactctgctccacctctggacaaagttgatcctctgccgagagggctagacatcctatgtgagaaggtgtgagtggtgtgtgtgtgtgtgtgtgtgtgtgtgtgtgtgtgtgtgtgtgtgtgtatcctggggcctggaaagcccagtctaagggatggacgagggggcaggaaacagaggagaaccaggccagaccgttcttcccctggggcctctctatacccgaacctggaacctgctgtcagtgttgaggcctgggcggctctcttttgtcatactgattctggctcaaggtgtaacctccgccttctctatctggcaattccctcctcccctaccccgctccgcgcgcgccaacacacatattgctgtggacacaacccttgcgcccaggcgtgaggcttagggagtagtggctcctttgtctgctcccctaaagcggacctcctacccgcctgggccggcccattctttagctcctcgcgccgctccccgcattctccagggcaggacgtcccaagtttttggctgcaactgagtgctctcctgctagtttctgcatc

SEQ ID NO: 699 - DNA, 1493 bp, Homo sapiens
atggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaagctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagtacgtttccgcgagccgcgtgtgggaaggggatgttgcagggcggcggcacaggggtgtggggcgccgtgttgggagtactgagcggccccggcgcgctgctgttgcggcgcagctgtcgactcggtcgcgcggagggaattgagcgacggttttggaacggtggtggcggctcggctactgctcgtggaggggaatacaggttgtcaatttatacgctattaatgccgccgtggcccagtcttaaccgagtcaggcagagctagtttgacggtggagtggagtgaggttgaacagcaggtttggcgtttggtgggtctggtatctagcggcggtctgttag

SEQ ID NO: 700 - DNA, 1487 bp, Homo sapiens
tatctcacagatgaggaaaccgaggcacagagaggttaagtggcttgtctaagagctcacaaaaagagcgatggagctaaggcttggccccagatattagatcccgaacccacgccttaaccagtgacctgcactgactctcaaagaaggaagctggtgcctgggaaggagggtgcatagtgagggtgtgcatggggtgtgtgtgtttgtggggtggccagcactctccgggggcactttgccaatgagttcagctcccatgaagtccactgttgttctcctgaccagccactcagtcttgatttacttggcccagggccactggcacacctcacccccttacccgattccttgctgcagaccccaaatctcgactctcacatccctatccagcccataccacgaggctcccatctccaggcagggccctgtggtggggcagggcctcccccagatgccccttactcatgaccagctcacaggatcttcccatgatgcatttcctctggggggatcagcccagatgctgcaatagacaattgtggaagtaaccaggtggacaagactttccccctcatgtcctggggttcctgggggcacagtatccttgtgaatggccactgagtactcccacccctcccaccacaacccccgggattttgtcctggtgcgtttttccagattatcctagcccttcctcccaggatggatgtccagagcagggcgggggctgagcctagagccctgccaaaagagcaggaccccaaattctgagccccttacttgcctcacctgctcccacccatgctttcttcattcctcctccaaaagccccagctccccactgcaatcccttctgcacccagccaggtcctatgacacacacctccccagtgcacacagacctgcccaactgtggggctgcccactgggcatttcataggtggctcagtcctcttccctctgcagctggccccagaaacctgccagttattggtgccaggtctgtgccaggagggcgaggcctgtcatttctagtaatcctctgggcagtgtgactgtacctcttgcggcaactcaaagggagagggtgacttgtcccgggtcacagagctgaaagggcaggtacaacaggtgacatgccgggctgtctgagtttatgagggcccagtcttgtgtctgccgggcaatgagcaaggctccttcctgtccaagctccccgcccctccccagcctactgcctccacccgaagtctacttcctgggtgggcaggaactgggcactgtgcccagggcatgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttg

SEQ ID NO: 701 - DNA, 1478 bp, Homo sapiens
tttcttaggagcacgtggagttctcctaggtgggcttgcactcggggtcgcccagccgttctttgagggttcgagtgggtaggcttcccctgtaggacgggcttccccgtaggtttccacgtggggccacagaggcaggaaaaggggaagtgggcactgacacctggggtgaaaaagggtgggggtgcggctttgtgaggaaagaatttgcagagactgctaaactggggtctgctaggataccccactccccaccccctgcctcgggcgccctcagccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccgggcgcggggcttctataaaaggcgcccgaagcgggggcgcgcgccccagagacgtgaactgtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccggtgagagcggccccgacttcccgcccctaggctgtggccccccgccctctgctggggatgccacgtccggctgccctgtcctgtggcctcctcccgctgacggctgcgatcgctcggccggtcacctcccccagggctgtggtctccccttccctgccccgccgacgcgggcgcccctctgttgcccagtagccgtcagtaatcagcagcctgaccttgggcgagtcatttcaccctccaagcctgtttctcccccagcggccaggcaactcggtgttcctaattgggcttgcatccaatggctagaagtaagaaaacatccgtgctgcaaaatgaggtttctgaacgcagcctctctgcagggagaggagcgggcaggtgccacccggggccgtggcttgagaaacctggggaccgcccagacactgtggacggaaggccccacacccagaagcaggacgtggctcttctcctccctggccaccttccgccgtgcccctccctgtcgcactggaccgagcagccattgccgagtcccggggtggagccccgtgcactttctgaccaagagcgactgagaagggaagcaggcaggagtcgccttcagtctggttttaggacggcagcctctccattattagcaag

SEQ ID NO: 702 - DNA, 1459 bp, Homo sapiens
acctggagctaacgtgtgtttgtgcgtgtatgtgttcacacgcacacacacgcacccacatgcacaataaggggggctgggggacctggttttctgtccccccattgccaagagtcagggcaatgccaggtgctgggctgggttctggctgggaattccccacaggcttccccccaatgccccgggggtggctgaggccaggcctcccagcccctgtggcctgagagctgtggccttgcaggcaggggccctccagcttcaggtcagtggggctccagcccctcttgagctcagggcctggttgggggatggtgggatgggctgtgcgaagcttctggaaacccctgcagaagaggagaccacagtccacccagcaggggaacccccactccttgtgtgccccaggcccggggcctggggagcactttgaaccaggatgctgtgggatgggggactggcagctcaggacaggctgattctatctaagcctggtttggggccccagccaaaatgggactgtgttttacttcctgtcctggcgaccatccaccccttgggctctttcccagtgggtctcaggtcccagttctccctgaaatgctattcgaggacagaggaagggtccttcacagacctcggtccccaccctctactctggttcctgccaaccacaaagcaaactcggggagctcagtgctccccaggcagggtggcccaggggaagaagaaagtaggtggcggtggctggtcccccagcactagaagggagtggctgggactccaagcgtgctggtggtgcacgagggggactgctggagccagcactggagaactgcaagagggagccatggcaggttctagagcgagggcatgaaccaagggagtcggggtatactaggcctgggttgacaggccaagggagttgccctgtgtggggccaggcggtaggacacggcccagggcctcgcaggtcccacgggccccgcgagcctcaggcggcaaaaacaggccagctccgggcgcgccgcagggtcgctgcctaggttccgcaccgagacccccgtgcgccgcactgcgcaggcgtgcgctagccgtttcggacacgccccaccgccggagcgcgcagccgcactgggttcccggagagcgccctcttctggctccgcccacgtcgtgcgcagggggtgaggccgggcggagcctgcgtcgggggcggggccagagcaggtccgggcctataaaggtggcggcggcggcgacgcgcccggctcctctcagcggcggtggcccaggtagaggggtccgcgctggcggcggcggcggcgctgttccccgcgcggtccgcggagcggggtccgggctgcgcgacgtggggcggcggcggcactgcggccccggcccaagcccgaccccggtgagtgcgaaccccagggcggccccgaggacaccgacccggtag

SEQ ID NO: 703 - DNA, 1387 bp, Homo sapiens
gactgatggggtgtctgattttctgctataaagaggagagtgctgtatcaaacacactcctctggctcctagctctctctgttccactttgtttatccaatttccctactcctccttcgtaactgcaccatgtggattcaaaattgcagcttagtgcagacaaagggaaaacggaattctgaatgaccccaaagggaaaactgaactctgaatgacccctgtgggtttgagagaagagaagcaggaacttgagagaggaggaagagagaaagtaattaaaatgtatcgttttaacttaatatttaaccgaatgatagcaaaatcttatctgaaattggaaaagtcaaggttttgagtgctggttcggtgcccatttctttatgatttgatagtctgagaagaatacgacgggtgtggcttaaaaacctagatcacgtgtgtagttggaattgggtgttatatgagcaaacaaaataaatacctgtgcaacatacctgctttatgcactcaagcagagaagaaatccacaagtactcaccagcctcctggtctgcagagaagacagaatcaatatgagcacagcaggaaaagtaagcaaaaaatatattactgttgataatatattctcttcaatataacaaataaaggaatacagtattaataatgaataatttaaaatttaaaattcatatctaaattagatgatgaataatttaaaattcatatctaaattagaaatgatacactggaatatgatatgcaatatatgctataatatgtaatgtatactgaactacagtggaaataagctattcctaaataccttcaaaaagaatatatagaatctgtatctattgtctttatttcctacattaaataaatttgccgtaaagtgatagtttattccaagctaatcatgactgatttgtaaacctaaagttagaaaagtctttaatcagaagctatctttatattaagaaagcataatttaaatgtgttattatttgtattcatattttttgtgaacacaagaagtctgacaaaacttttatgagagggatttgagaagattttgaaatatacttttaatcttactataaaatatcttacaaaatactcattgatctcacagcattagaatcatcaaggttaagcaagacatcacattcaaattccgtttaaagggggcccattatgacacaattcaggcaatttccacagaaatcttatggaacagtatctcccctatataaaagtcaatatgatcttacagaaaaataataatgcaatttgaatcacttattagcactcagaacacaaatatttgttttttcttctataaatttatacttatttttcaatgtgtttacaggtgcacagaaatgca

SEQ ID NO: 704 - DNA, 1364 bp, Homo sapiens
aataaaaatcaagtcggggttcgggggagccccctgaagttgggaggtgggacttccggggagaggggtctcaggggcgggacttataaatgaagaccggaagtggggtcccgggagaggggttccggggtgaaagagtgagtcacctaaggagaaaaaagtcaagactcaccagggcctcatggagtctccgcaccgcaccgcgggccgatttggtgccggatcacgccactgccagcttaggttaccgctccaactttctccccgggccctgcctccctggagaaactttattacactcacttccggcctcactaacccctgaccctctacctcagggtccctccttcacgcttcccactttcccgagttagccaatggcagcgcgagatcgcgcacaaaggcagtggtggccaataagacgcctacttttgacccacgctcgttcttgagaagcgtgagaactgccctccaataaggatccgaagagaagtaaatctaagccaatcggaggcttgaaagtagaggtgtcccgcctcgagccaaacggaccaataggaagtgcgggcggcgtgtttgaaagcgaggccaaagtgggtgggagcgcgtgctgttgggagttgcttggaggttggcggcgcggggctgaaggctagcaaaccgagcgatcatgtcgcacaaacaaatttactattcggacaaatacgacgacgaggagtttgagtatcggttagtgctggcgcgggagcaatagcgagggtcgtgagctttggccgctgagggcacaaggaattagtaacaggaactgaggcgatagaattggcgcatgcgtacgaggtgcgaacgggcaatggtgtgatattgtggaaggcgtaaggcgcatgcgcggaggtgggaggcgctcgtaaaacaaagtggttgcgaatttggagtcgcctctcagtagagaggagagaggggtgggcgtggttagggtactgaccaccctcacccatgaggctttctggatcattctctgaactttatcgggcaaacttaacttgccttgtagagactgtttcacagtaatcttgtcgaatccagtgggagaacgtagcaaaagcggagctggaagtttcctggcgtccctaacaggagagtagcgctgagagagttgaatattgcttattaactcgtgaaaaagacaaggggcgtggttgtctggcttgtgtaaggaaggggatcgcttgggactgcaatggaataaaactggctaggagcattgagaaaatacttaatatgggtctaatagatgccctttaaatatcaaagggaacagttacggaatacttaacaggtttcaggtgttctgctaaagtgcaagg

SEQ ID NO: 705 - DNA, 1200 bp, Homo sapiens
gtcaactgggcatcactaaggtcttcagcaatggggctgacctctccggggtcacagaggaggcacccctgaagctctccaaggtgagatcaccctgacgaccttgttgcaccctggtatctgtagggaagaatgtgtgggggctgcagctctgtcctgaggctgaggaaggggccgagggaaacaaatgaagacccaggctgagctcctgaagatgcccgtgattcactgacacgggacgtggtcaaacagcaaagccaggcaggggactgctgtgcagctggcactttcggggcctcccttgaggttgtgtcactgaccctgaatttcaactttgcccaagaccttctagacattgggccttgatttatccatactgacacagaaaggtttgggctaagttgtttcaaaggaatttctgactccttcgatctgtgagatttggtgtctgaattaatgaatgatttcagctaaagatgacacttattttggaaaactaaaggcgaccaatgaacaactgcagttccatgaatggctgcattatcttggggtctgggcactgtgaaggtcactgccagggtccgtgtcctcaaggagcttcaagccgtgtactagaaaggagagagccctggaggcagacgtggagtgacgatgctcttccctgttctgagttgtgggtgcacctgagcagggggagaggcgcttgtcaggaagatggacagaggggagccagccccatcagccaaagccttgaggaggagcaaggcctatgtgacagggagggagaggatgtgcagggccagggccgtccagggggagtgagcgcttcctgggaggtgtccacgtgagccttgctcgaggcctgggatcagccttacaacgtgtctctgcttctctcccctccaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcatgtgactgtaaatc

SEQ ID NO: 706 - DNA, 1200 bp, Homo sapiens
tacgcctggctgatttttgtatttttaatagagacggggtttcactatgttggccaggatggtctcgatctcttgaccttgtgatccgccttcctcggccccccaaagtgctgggattacaggcgtgagccaccgcacccagcctaatttttgtatttttaatagagacagggtttcaccacgttgtccaggctggtctctaactcctgacctcaggtaatctgcctgcctcagcctcccgacgtgctgggattacaggcatgagccaccgtgcctggccaggagtttattaaccttcatgcccaccacgtcaaccacaaaccacgtgtggctgcagagccctcgaaatgtggctgctgtggctgaggaactgaatttcaagtctttatctattttaatttcagaacagatactcattcccattcttggaaaacttttaagtgtgtgtacaacagtttgggtgtgtggatatactttgttcaactatcaattttatgaaatctctgtacagattagccatttctactgagaatttagcatccaaattgagatgtgctgaaagtagttttaccctgggtttcaaggactaagtaattaaaaaaaaaagactataaactatctcagtaatgtttatattgattgatgataatattttatatatattgagttaaataaaatgttattaaatttacttctgtaacatagctactggaaaactgagaatttgaagtgtgtctcacactgcatttctattgggtggcgctgttacaaactacaggaaggagctagaattctgtggaaggttttaggcaggggctgacatcctctggccaaaatgacaagagggaattccagagaccagggcaagtctggccacagggagactgcatggcctaggagacctgagccacagccgccaagagaagccctgattccccagagaggaggtgcccgctgccagtccacaggtgagcaacaagactggatccagaagagggaggagcctttaggagaggcaggcccatcgcaaggctgactgatccttcaaaggagcctcccagctaaaagccagcaggagagagaccttggccaccaagggtctgccagctcctggtggtccccactccagccacctgccagctcgagcctgaccctcgcctccaccctggctgctgcctgtaccgctctcaggtttgaaac

SEQ ID NO: 707 - DNA, 1194 bp, Homo sapiens
cagctcagatggcgacttgtgcgttttcagcggcatctcccggagaaaaagccatgcgcgcctgattgttctgtggccccaaagctgcagcgggggtgtgtgtgttggggtgtgtgtctgtgtgtgtacagagacgtccacactaactcgcggctgcaggatcagcgtctggaagcagacgtttcggctacagacccagagaggaggagctggagatcaggaggcgtgagccgccaagagtttgcagaatctgtggtgtgaatgaactgggggcacctgggcgcacagatcgccccccttcccccgccccgggccacagttgagtagtggtacatttttttcaccctcttgtgaagaatttctttttattattatttgtcgtaaggtcttttgcacaatcacgcccacatttggggttggaaagccctaattaccgccgtcgctgatggacgttggaaacggagcgcctctccgtggaacagttgcctgcgcgccctcgccggaccggcggctccctagttgcgccccgaccaggccctgcccttgctgccggctcgcgcgcgtccgcgccccctccattcctgggcgcatcccagctctgccccaactcgggagtccaggcccgggcgccagtgcccgcttcagctccggttcactgcgcccgccggacgcgcgccggaggactccgcagccctgctcctgaccgtccccccaggcttaacccggtcgctccgctcggattcctcggctgcgctcgctcgggtggcgacttcctccccgcgccccctccccctcgccatgaaggtaggtgttcagtgcgctgccactttttttctttacttccccccaccccctgttggaagttaactgagttcccttcgcctcttcctatccctccatttccccaaccgcctgaagaagctggaactccagcgtcgctggcaggaacccctaccccttcgccctccacgccgggcgcactgcctcagtgtcccaggagatcacttctggtcgcaccacccgttctgcaaacaattttgatttttgagaaaaagtggggaagagcgatagtagacaaactgagtgcggttcactgacgactttccttttgctctgagaacatcgagtgtaatttactatgtatatttcagtaacaggataatgattcaattcaacaaatatttaccaagcgcc

SEQ ID NO: 708 - DNA, 1190 bp, Homo sapiens
ttggacaaaatgcacaaacaaagcaagaaaggaatgaaggattttattgaaaatgaaagtacactccacagtgtgggagcgagcatgagcataggggctcaaaggccctgttacattttgtgagtttaaataccctctacttggggtacaccctatgtaaatgaagaggatgaagtaaagttacagttacaaagttattaatggcgggcatacgccctatggagaggatatttcccgttataactgaagtgtgaattggccttatgttccctgtctctagaccctattctcctgcttcctgtgaaagcagagggttttgtttgttttttgctttttgttttttgagacggagtcttgctctgttgcccaggctggagtgcagtggtgcactcggctcactgcaacttccgccttcccgggttcaagcgattctcctggctcagcctccggagtagctaggactacaggcgcgtgtcaccatgtcccagctaatctttctttatttttagtagagacgtgttagccaggtttcaccgtgttaccgtgttaccgtattccagccgggctccgcccctggattcggtggacagaccagctttacctccagagactccccctgtcttccctgcaccggctgactatacctacacacttcggtggcacaatctttgtttagatatgctgatgccttccttcgctgggaacggtccagtcctgcccgcctggcgctcagctctgcggatctcaggggatggagtggcaatctcattgctcccgcctctcctgacccctctcgccttctcctcgagacccgggttaagtgggcagagggctccgagggtcctctcccgccgtgggattgcacagagggctgggtccgcaggctggctaaaaggacctagcccaggattgcgaggcagcgccctccctgcagctggacagactcgggcgcccggcccaaagcccggcaggggcgtgtccgcgcgctcacctgctattggccaggtggggctgtcggctgccagcagtgcttatgctttaagtgcggagcgggtggctgcggagccaggcgcggcgcaggatggtggacagcgtgtaccggacccgctccctgggggtggcggccgaagggctcccggaccagtacgcggacggggaggcggcgcgcgtgtggcagctgtatatcggag

SEQ ID NO: 709 - DNA, 1176 bp, Homo sapiens
tagtatttcttggagagacggcgcgtagcggagggtagggcggagattttctatctgctctgtctctgcattgctgggtttccagctcccaacctaaccccgcctccccgaacgcggagacggaactcggcccccttgtttggggggcggcagccacgtgttcacggggactgtcgtgcgcgccgggttcgcagccgtgcgagctctgaacccacccgtggagctcctgtcgcgggaaactgcgggggaatggcttggtacgaatcacgggaacccgtagcccggggcgggtcaccgcctacaagcaagggctggcgtacgctagagaccgaagagctggaggccccagtggccccctttcacagcagtagcaaatattgtttgtttagtaaatattggcctagtgactctgccttggtttccccacttgaaggaagcagatagaacagtatcctccgaggagtggaggctggggatcggtgaattattgataaaaggagagctcttaacctagcctggcacgttgtaagcgctgttagcatgattattggtgcagaaaacactcattagacacacctggtaaatgctaagaacagtggccacaggggatgttcaggctggaaccagggtcttcccctgtgtgaagggaaacttgctgcccacgacccactggggcctccagacgggagcatgtgggtaggccgtgagctccacccccggcccccctcccttgggccaaggcgctgatgcatcggcggggctcagagaaaggagcccacccagaaagctcagcgtggagtcgggggacgctcctcctcgccagggttcccgtcccctttccctgctgggtaaatcgcattctgtctctttaaggagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcac

SEQ ID NO: 710 - DNA, 1173 bp, Homo sapiens
tgttgtagtgtgaaagcagccatagctgatagttaaattagtgtatctgtgttctagtaaagttttatgaacaatgaaatttcaatttcacataatttttacatcataaaatattcttttgctttttttctcaaccatttagaaatgtgaaccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttagaaggggaacatcacactctggggactgttgtggggtggggggaggggggagggatagcactgggagatatacctaatgctagatgacgagttagtgggtgcagcacaccagcatggcacatgtatacgtatgtaactaacctgcacaatgtgcacatgtaccctaaaacttaaagtataataataaataaataaataaataaaaatgcaggaaaaaaaatattatcatgaaaaaaaaaaaagaaatgtgaaccaaaaaaaaaaaaaaccaaaaacacctgtcttagtttacaaaccataccaaaacagatacaaatggaaatttgtttgagggaagtggattgattcatattttgactgagaattaaataaggccactgtaccttggagggattttagataagacatctaaaatagtaggtcatggtaaagggtgggagagaacagaatgaaccactgaatgggggtggctgtagggaatgcctttaaggaaacaccttctccctgctatgtgacccaccagaattgaacatggggaaatgatgagggtagcaggtcattttgaaatggaccttcgggtagtatttggggtggaaaaatcccctttctccaaccacattttggccaccccagcaacaccacccccacagaggtatcagcgctttgtgatgtccaagccaccccaagactaccattggatggggtgccccattctgaccaaacaaagctgaagggtagggctcctcattacccaggggtgggtatacataaggaggtcaggagcataggg

SEQ ID NO: 711 - DNA, 1171 bp, Homo sapiens
gtatgtgctgggcactgaaaacacaaccgtgaacagaggctgtcacggttcctgaactcatggagctttcattccagtggaggagacataatttcagtgataatgctacgacggggcacaatgtgggagaaaataagagggaggtggccaggcgcgatggctcctcactcctgtaatcccagcactttgggaggccaaggcgggtgaatcacgaggtcaggagtttgagaccagcccggccaacatcgtgaaaccccgtctctactaaatagacaaaaattagccgggcgtggtggcgtgtgcgtgtaatcccagctactagggaggctgaggcaggagcattgcttgaacctgggaggcgaaggttgcagtgagctgagatcgggccactgcactccagcctgggtgacagagcgagactccgtctcaaaaaaaaaaaaaaaaagaaagaaaaagaaaagggggaggtaattttagaatggtcagagaaggtttttttgaaaagataacattaatcaaacgaataaatgaatgaaaagccactcgctagcggattcattatttgctatacttatttagagtttgtcagtcacgagactgttacggctctgatgctgagtatcttttgaatcctatgttgatgatgcccaaaaggcaagtgcagagatgaagcataatgaagaatccttttcaatttcttttcagtcctctgaccttgcctctgccgtcacggtcacactcccccactgacactcccattcttctgtttccggacacttgcggcctggaagcgcatgtgcaagagaaaccgtcattcctggtgaagggcgagcccccggcagaacgcatgcgcctctgtcccttaagccccgccccgacctcagcgccccctcgcgagcgcctgccgtttctcggggcgggacgggggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccag

SEQ ID NO: 712 - DNA, 1162 bp, Homo sapiens
gcattgctatttattcctcgtcgggctccctttgacctttttgagaacaagaagaaaaagaacaacatcaaactctatgtccgccgtgtgttcatcatggacagctgtgatgagttgataccagagtatctcagtgagtatctccttggcctaatttagttgggtgaagtcttgggaggttttaggcattctgctaggatattctaaggtaacagttttctgcaatacatagtaggtgtaagggttcaggaggctattagagccttctgtttgaatctggggaccaggtctggtctagctgttttttactgagctttctcaccctggttgatggcagattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaaggtaaaaaggcaaataatgcttattccctttaccactttcttagtaataacaataaattattccattcacattgaaagtgaagttattgtagttaagctggattgtttttcctcttcccacccttcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgcgttgactctgattgaagcctttttggaggagtggggagcacaattagggcttcctgggaactggcagtatgaggcattttagtcactgagttcatttaattaccctacaggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaaga

SEQ ID NO: 713 - DNA, 1156 bp, Homo sapiens
aaaatacttttgggtgctcgcttcggcagcacatatagttggaatgatagagaagatttgcatggcccctgcgcaagatgacatacaaattcgtgaagtgttccatatttaaaaaaacaaaaaatacttttgggcctggcactgtggctcatgcctgtaatccaaacactttgggaggctgaggcgggcggattgcttgaacccaggagttggagaccagcctggacaacatggtgaaatcccgtctctataaaaaaatacaaaaattaaccaggtgtggtggtgcacgcctgtaatccaaggtacttgggaggctgaggcgggaggatcgcttgagccaggaggttgggcctgggtaacagagaccgtctcaaaaaaatttaaaaattaaaaaaaaaactttctgcaagatgaagtgacaatacctggaaaatacatgtgacttgaccaaaaattactataggtgaaaataaatttagcaaagttgctttcctaaatacaacccaaaatagactgggaacagctacatactgttaatggttccctctatgtgacattctagaaaaggcagaactatagggagggaaaacatctgtggttgcccaggagctaggggtgggaagagggaatttactacaaagaggcacgaagaaacttgtgggccagagctattttggtctccgttttggtgatgtatatacgtttgccagagttcacagaactgcacactgaagaaagatggatttcacggaatgtgaattatatctcaacaaacttgacttcaaaaaacagatcgagaaaagatgattctattcccaaaaagggggaggggggaagatcattatataggtgagtgttcatttaaatcagagtacgagatttatccgtgaaaatcgcagtggagcgaacaagggggatgctgataccgacctcctggttggaaagcctgtagagcagcgcggatgacagtggaacagcgggtcaggcggtgggcgcctgagcgaggggctagagcgggatgggcgggcggagcaagcctgccagcctgggcggggcctcggcacaggagctggctgcgggagcccgccgtcctgagtcgcaggccgaggagacagtgagtgcgcgccctgagtcgcaggccgaggagacagtgagt

SEQ ID NO: 714 - DNA, 1151 bp, Homo sapiens
gagtggtgtgtgtgtgtgtgtgtgtgtgtgtgtgtgtgtgtgtgtgtgtgtgtatcctggggcctggaaagcccagtctaagggatggacgagggggcaggaaacagaggagaaccaggccagaccgttcttcccctggggcctctctatacccgaacctggaacctgctgtcagtgttgaggcctgggcggctctcttttgtcatactgattctggctcaaggtgtaacctccgccttctctatctggcaattccctcctcccctaccccgctccgcgcgcgccaacacacatattgctgtggacacaacccttgcgcccaggcgtgaggcttagggagtagtggctcctttgtctgctcccctaaagcggacctcctacccgcctgggccggcccattctttagctcctcgcgccgctccccgcattctccagggcaggacgtcccaagtttttggctgcaactgagtgctctcctgctagtttctgcatctctctccttgctttagggagagatcagagtggggaaaacagctttctttttccaccaagagtggagattctttttggagtttcccatcctccccttcgctgccataagcctgggtcaaatgggcttcttccgcctatttggcgtccctcatcgtttcactcccagaaacttggggcctaaacgtagagagtctagcagaaggggatgcctagactgaatgtggcagtgccccggggccgaggggagaggatctttgcttggcctttttatctattctcttaagggactgcctgcggaggaggagttgggtgttgcgagactttaggtgtgcatccggctgctccccgcgccctccgaacgtcctctgaacaattttgctactgaggtttcctctccctcatccctcatcacgcctggcccgcaccgtggttggtaaagaaggatcaagaacacctttaatccgacgcgaaggctttgagggatacatagaaagggagccacgtcgttgagctgctctggattgaagaggaggacgcgggaacgccctcctccacctcactcctctggtgcgctgagcccctcaaacgcccccagtcctcctccccgtggcacgcgaggaagattctcagtgtccttacagagtcatcttccctgagcc

SEQ ID NO: 715 - DNA, 1129 bp, Homo sapiens
tattgcctttattccttggccttctttgcaagggtatcaaagaacactgctgcagtacttcctgttctacatagtcatgtgacttaagcaagagcatctgccagccagtgaggccccttgagagcctggttaaacatgggactgaagggttaagtgaatcactttttattcatgttgaaatatgaatgctgaagtttggaaaattttatatataacattttaataactaaaaaaacttgacttaggaatagtgcttatattaaaatcagtgtttgtcattgtttcatgaagtttttacaaatctaagaggcttaagagggatataatagtccactttgctttagttgtgttttacttgatattactgattgctttaactttgaaacacagaacaatgctatagtaagaatgtagtatactactctattaacccaaaacataatatagataggtttattgtatatttgtggagaaaagtttattctaacgttctttttacaaatagtaaaaatgctatttgtaggatgctctgatttttactttttgtaaaaagaacattgtctttttaccccaacagaaaatggcaagcgttcagctttctttgggaatccaaaatctcttatgaggcatattaggtatcacatgtgacataagcaaaagcctgtgatccttagcatgttggaaagttgctactctttaggataaggttgtccatgatgtctaggtcattccattcagctgcataaacaattcctttgatggatggctggttttctacaaccccagcattattttagcaggagaaggtagtatttgatgtgttgcaatttgtgttacatgcccatggaacatctctggacattacctcaggaggaggggttaagagaaggaggagctgtggctgaagacatttaatggcagaatgaatggaaattcaaagatcgctgtgcagtcagccttaaacactgactgcacccctcccagatttcttttacattaactaaaaagtcttatcacacaatctcataaaatttatgtaatttcatttaattttagccacaaatcatcaaaatgacgaggattttgacagctttcaaagtggtgaggacactgaagactggttttggct

SEQ ID NO: 716 - DNA, 1100 bp, Homo sapiens
tctgagacttgctctccctgtcttttggccccttgacattctgttctccagctcccatttcagcgtctcagcgggtccctagtcctggtctaggcatcccatggtgctaactggagagccaggccaggatttctcttcacaagaaacactggcttttcacaggcagccatcactcattggctagacacccatgacttcctctgtctgcagggctgaggcccaccccaccctcctctctgcctgtgcagtccctggcgtctgtggaggggagagggatgtaaacaaagagagtgtaattgattctctgcatgtcccctgtgtgctgatggcagtggggcagtaagtgggcctgcccgtgtgggtctctgctcctgccagaccttacaggactgctttgcggctgctgtttgggcacagtgtgcagtgggccccgtgtgctgtcttggatgtgacgttagtggctgtcttggcctctgccgcagtaattagatggctagggtaggcctatgatttgggtgttctcaagaacactgtgttgattgaatgttcgtgcatgctggtgtgtgtgtgtgtgtgtgtatacgtgtacatgcacatgagtgcgcatgtgcttgtctcaagcttggcctgtggggccgggggctgcaggtctcaaattcctctgctatttttaggagccatatcagcccagctgtcccggagctggggtgtgtgtccataggcaagtctcaccctccctgtccttgccctaaccccctaacactgcctgccccccaccccaatggctttaccctaagagccttctccttcccttccacacacactgctgtatcaccctctccctcctggcatacctgatacccgaagtcctccgggctgctggctccaactagggctgggcagctcgggacgggaggggccggggagagggcgggaactgggcggggccacagcctgtgctattttgagctgctaacggagccagagcagcatcagagcggagtctccttgctctgggctgctccaggccaggccatgcgggtgagtgtccctctgaccccccaccccggaaatgtcccaggctcctcatgctatttcct

SEQ ID NO: 717 - DNA, 1097 bp, Homo sapiens
agggagagtccctgaggaggggccggggtgcttccggcctgggtggccggaggaggaggcagggagagccctgcggctgaacagggcagcgccccccgcatccggagggacaggcccggccccgtctccagtcccgcctcccgcctcagccgcagaacctcggtggttccttcagctcctgaagcggtccgcaaacaggtcgagggcgctgacgaggccgttttctgggctaagcagcgacggcgctaggcgactccgcttgtccttcgtttccgctgtcagctcagcaggtgacttattcccagtgctgctcttctcacagacacaaaaccaacagttccggtctcttccgatagttctggcagagacggctgcggggagacacgggcggaggcgggtccgggcgggccccacgtcgcgcagcctcagcgtgttgcgcctcccgcggctgcggccagagacttccgcaaacctcggggcctcaatcgacagaacgtgtcacctcaggcccaggagagcagggtccggggcgcgtcctcagaagccggcagggcgggctcctcgctgagccgcagggcgagcccggcttgggcctcttcccgcgggaggaggccgccgcgttccttccccggttctccagccgaccccgccgcctccgtctcccacacgcagggaccctctcccgacaccggcctgcctggaacgtgccagaatcgtctccctaacccggcggccgtggatgagcaaacctgcacccgcggcagcctgaactgccgtttgtcgcgtagtcctcgagtctcggagcgcaggggtcccgagggcaccccgggccgccgtcctgcggcccccccacagtgtgccgggactcggggtctctcaccacgagcagacctcggcgctgctatccggactcctcgagccccttacaggccacatggccaggggcgaccctcccgtcacaactgtgactctgtgagctcacagggctggcctccacattcttgctggtggaagaccacaagcaacgggatgccttggaaagcatcgttctgcagcaggactgctcaaccggccaatcagaacacagggaaccatga

SEQ ID NO: 718 - DNA, 1089 bp, Homo sapiens
ctaatgtgaccccaggaaatcagagttctaggaagaaaaactaaggcgctcggcaccagccttccccaccagccggggccgccttccccagcgccgcgagggcgcggccggcgggaccagttcccgaggcaggcaggcactcgggtgcaacctgaggaatctgggggcgtggaaggcgcgcgggggagggcaggcttccaagagtgggaccctcgcgtctcctgccgactgggtaggaaacgggggcttcccccttgccctctcagagcgggcgatcccaaagagacaggttaagccgcaggttgagagggcagctccgcgccggtgccccgcggatcctgcaggctcccgggtcccaggagaagggcgggctgggctgggctggggtggggagggcggtgaatgcaaggatattgccgcaggcaggagtccacctcgccctcgtcgggcccggcctggccgtcgcccccatcttcttcgtccacgaacttgttctcgtcatattcatccacgtccaccttccggaagcgggccgacgacactgtgttcttcgacatcccaatcccgaccagcggcaaaggcctcttcttggcgctgcctctacctcagcaagcccagcccagcaacccactacccggcgcctgattcacttccctcttccgctctgaggcgtcgccgactgccgcggctcggaccgttctgggcctgcgcgctagccccgtttcttcctcctcaggttcgcgctcccttggcgcctcccacgctgcccctgctcttccacggagagcgcgcgcgagggaaggagcgcgcaggacacagcgcgcaggcgcgggctctccgcaggcaaggggcggggctgggcgaaggaggcgggggcgagagggagggccaaaagctggaccgcgggcagaggtaagaagcgattggtcgtccgattgcgtcacgtgattctcggtgggggggttcccatagaaacgcttttctgcggtccagtctagggggtctcagattggcggggatgggcagcagcggcaggtggccttggcttttgctgcagccgtcaacgacctatcatcggggtcctgcgta

SEQ ID NO: 719 - DNA, 1087 bp, Homo sapiens
agagacggaggacccagctataccatggagggcgggtgcagaggggccaggcgagagggccaggcaggcacagagacagaggacgcagctttgccagggagggcaggtgcagagacagaggacccagctatgccagggagggcgggtgcagagacagaggacccagctatgccagggagggcaggtgcagagacagaggacccagctatgccagggagggcgggtgcagaggggtcaagcgctgacagtgagggggtctttccagtggcttcccctctggagctcacacacacttactttaatccttataaggccctgtgaggcaggcaccgtaataattgctccataaccagctggcgagaaaatccaagctcgtaattagtaatcatcacgaaacagctttcttggctgacagcacataaaccaaaacagtagatgtgctggttccggctgctgagggccagggtctgcagacctgccctgtgaagcttacgtggcctgccagacttcatgctcggcaggtcccgtggcctcctggggctgtttctttgaggtgaaaagagggtggaccagatgcagttgtttcaaattgctttctgagggtctccctcctgggctggactaagtcagggggctttcatcctccatcaatcaggccaacaagtctattctataaaccggggtccacattcaattttatttgaacaaaatgttctatcagcctgaaaactgctaggaaggtctctaaggccatctggctctgagcctgcgattccaatgcttgttagcggatttgtttgtccagctgttggtgtctcttcttcctggctttgccgctcagccctgggctttccagagctttctaggggtctcctaagagggcaagcgggtggtactttctgtattttaatattgtgttagaatctgggacatctgattgctgaaatgagatgttagttggtacagggaggggtttccaggacccgcacgcccttgcggagtgcctgctggagggagccggtgtgtccaggacacccttgcggagtgtctgctggagggagccagtgtgtcagtgagatggctatgc

SEQ ID NO: 720 - DNA, 1086 bp, Homo sapiens
ttttcattcagcaaatcctttccacctggaaggaaattgtggggccggacaacaggccctgctcttagctgggcgggaaggcagatgactgcgcagagaattccagaacagagagtaagtccggggactcggcgctcctcacacagcctctgagaactcttcctggaggaaggggtacgtgagctgagtcccaagggtgcctaggaccgcactgggcgccacaaggaaggaacagccggcacagtggacaagcggggttgtggggcctctggagggcctggcgggtccagacctcatcctagggaccacggggagggccagtgggaggacagcggcgggtctgagagcagctctcccacctccttgagtcccaggaagccgccgcgtcccctgccccacacacctggccccagtttcctagaatcccaggaagcagccgcgtcccctgccccacacacctggccccagtttcctagaatcccaggaagcagccgcgtcccctgccccacacacctggtgccagcctcctagaatcccaggaagctgcctcgtcccctgccccacacacctggtcccagcctcctagaatcccaggaagccgccccgtcccctgccgcacacacctggcctcagcctcctagaatcccaggaagccgccgcgtcccctgccccgcacgcctggtcccagcttccacccacagtggtgccctggggtccccgggcctgcaccaccccaggtgggcaccccagtaccctggcgcaccgactccccagcccactcaccctggcctctgcgatgcagacttgctccctggcagggcccggcctaggcagctcccacgccaggctcacagctgggctggccctacccggccacctgctgcccctcccaggcccctcctcaggaaggtgaaactgccccatttcctgcaggaaccctgtgttctctgaaagtagaaagaggagggaaatggaggaggggaggggaaggttggagagaaagggccaggggtcggaaggaagggctgcaggagggagagaggaggagggagagaggaggagggaactttgctccaggagatggct

SEQ ID NO: 721 - DNA, 1081 bp, Homo sapiens
ctttgctcctgtgggagtcatacctctttcccaggcaggagaaggggcaggcccagggcaagggaatacacatgacataaaatatccccagtggccaggcacggtggctcatgcctgtcatcccaacactttgggaggccgggcgggtggatcacctgaggtcaggagttcaagaccagcctggccgatatggtgaaaccccgtctctactaaaaatacaagaatgagctgggcgtggtggtgggcccctgtaatcccagctactcaggaggctgaggcacgagaattgcttgaacctgggaggcagaggttgcagtgagccaggattgcaccactgcactccagcctgggtgacagagtgagactctatctggaaaaaaaaaaaaaaaatccccagtggcttcgtggggatgtccagcttattctttttctaatatgctaactgcaccctggaccaaatgagaagaatcccagaacacactgtgctgagaacataagcgtgtccaattttgcccagaaatggccagtgttgtacctgggaagaggcagagcccttctcctcacacctaaaccctctggtgaatggagaaaagctcgggtcagccaacctcagaccatccggggccagccacagtctgacaggtcctaagataggacttctgtgctgactccagacagtgcagtcagcacaggctctgaggctgctgtgtgccttaggccaccaaagtgtcgggcagagtgacagccacaaaccccaggggaggggcacagaggtaccgagaaaggaccagaagcctgacaggaagtaggcaccgagagtgagggcccctgacactcctgcttgagctgtgacagcatttaagggttttctgcctctgcagggcccgatccagatgagaagggtggctgcagtagggctgggcgggctgactcagtggcagccgcaggccttgaccaccatgttgcggtgcttgcgcaggatgacgttgttgctgctgtcatagtagagcacagaggtggcgctcagcttggtgggtgcacagcacgccttggggactgcgtttggcttcatcaggtgcac

SEQ ID NO: 722 - DNA, 1078 bp, Homo sapiens
ctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccaggtgagagccctgggtgtgagggatgtgaagtcgggaccctgaatcacggggcagtgctggacagcccacctggctcacatcttgtctgcccctgtccccagaaatgggtacagcgtgagatatccaacttcgagtacttgatgcaactcaacaccattgcggggcggacctacaatgacctgtctcagtaccctgtggtgagggtcccactctgcacccctccacccctgcccctctgacctgtcagcccttggttcccccaagtgtaggtacctgccagtgggccaagctctgagcttggtcaagggtagatgtgccaatgaagacctggcctctgttccctgccaacccccagaggtccccagcctcactcccttcccctccctgcctagcctctattcctcaaaaggaatcctgttccaggacactctgtccttctcccctgtgacccctctaagtggtgctcccccaacctgtgggcaggctctgtgcccgccttcttgagggtgtgggcagggcagggtgggctggtaggccatcagggccctcatgcagcccctgctcgggtgggtggccagttcccctgggtcctgcaggactacgtgtccccaaccctggacctcagcaacccagccgtcttccgggacctgtctaagcccatcggtgtggtgaaccccaagcatgcccagctcgtgagggagaagtgagcatgtgggcagggctgggctcagcgggtagggaaaggcgaggggagggcttctgctgacacgtccaactgtggccccaggtatgaaagctttgaggacccagcagggaccattgacaagttccactatggcacccacta

SEQ ID NO: 723 - DNA, 1070 bp, Homo sapiens
cacagacacatgggtatccagaaaggttgcaacccaagattatgttacgtaaagcagaatgtctggtggccctggggagactgcaggaggcaagccagaccatcagtgatcttgaaaggaacttcacagccacaccagccctagcagatgtcctccctcagactctgcagagaaacctccatcgtctgaaaatgaagatgcaagaaaaggacagtctcacagaaagcttcccagcagctctggccaaaacccttgaggatgcagcgctgagggaggagaatgaacaactttccaatgcctcatcatccatcggcttatgcgtagatcctttaaaaggtcgctgtctcgttgccacaaaagatattctcccaggagagctcctggtgcaggaggatgcttttgtgagtgttctcaacccaggagaactgccaccaccgcatcacggcctagacagcaaatgggacaccagagtcaccaatggggacctctattgtcaccgatgtttgaagcacactttggccacagttccgtgtgacggatgcagttatgccaagtattgcagccaggagtgtttgcagcaggcctgggagctctaccacaggacagaatgtcctctgggagggctgcttctcacactgggtgtcttttgccacattgccctgaggttgactcttttggtgggatttgaggatgttcgcaaaatcataacgaagctttgtgataagattagtaacaaggacatctgtttacctgaaagcaacaatcaggtcaagacacttaattatggcctaggggagagtgagaaaaatggcaacatcgttgagaccccaattcctggatgcgatattaatgggaagtatgaaaataattataatgctgtcttcaaccttttgccccacactgaaaaccatagcccagagcacaaattcctctgtgctctctgtgtttctgcactgtgcagacagctagaagcagccagtttacaggccatcccaactgagaggattgtgaactcctctcagcttaaagcagcagtgacacctgaattgtgtcctgacgtgactatttgg

SEQ ID NO: 724 - DNA, 1066 bp, Homo sapiens
ccttgcaaaactttccagagctacagagtcccccagagaccacgatcacgcagggctaggtcaaggggcaacaaagaactccacatttcaagagccccccaggggtccaaggggcctctccagctgagaaccgggaggcgaggctggcatcctaggcaccgaacacagcgtagcctgggaaggatgtgttaggtctggactctgaacactgtcacctatgccctggcctggccagaacacagagagccccggtgaggaaggggagcaggctttgtcgccagatggcctgcgtctcccctcccacgtgcaggggctactgcctcaagcacaatgctcggacaggccaggggtgcagcacagatagtctgttctcgttccctgcaataaatatttctgcgctaaatcttaaacacatcgaatgttagaagcagcattcacatctcccccagtgccctcctagcggcccaactgtgccttctacgagaccatgcctatgggccccccagctgcccccagatgggctcttatctatcgtacccctgttgtgctacagagcccagagctgcccaagcctggggtggggggtgaggacagcaggaccttgcccctcggcggcccacttcactcctgccgccgcagccgaaggcgacgttaggttttccagcagctgagacaacagccctgccctgacctgaagcatcagtggtgtcagtggtaccccggccacctgtgtgtctcgtgtcctctgtatgtgggggccgctgcagcctggctagtagaagcgagtcccatcggtcagagtcttagagttccaggctgttccaattgtcggtgctcacagagacacgggcagctgagtcccctgttttgcgtatgaggaaacagggtgcactctttccccttggcaccagccgatccgactcttccacgggctcctgacccccatggcttttcgctttgactttgtcacatccaactcaccatgtttctcaggaatgctgaaccagtcggttcttttagccagctatgtaagagcatctgctctctttgattcgaaacacctgct

SEQ ID NO: 725 - DNA, 1062 bp, Homo sapiens
cctataaaagctcaatgaatggggcggcagtgtcaccactaagcccgaccacgctgctactctgatatccaacttccagcctccagaacagggagaaatacagttctgtttttgatgagctccccaggccgttacagctctttctttgctgtaacagcctgaactagcccagaagtgctattccatcatctgtgtcatattccatcattcagaagggagtcactaacccctcagtgctgtctctgtggacgctgcccaccctaggctgagatgaggcacagggtctgggtctaaataaaatgggaaggcactggaaggtgcaatgtcataggaggaggatgtctgaatttcatttaatctcaacctctactggtgcagcatgaaagatgaggcccagagcaaaagtgtcttttcccgagatcacactgtggaccccaggcccactggagttgcattagacgttacctctcaccccttcttgtatttgttccatttctaagtgtgtgcaatatccacagggaacaccacaccatgagtttttaaatatttatctcaaacataacctcatgagttccctaggaaagagatgctagcataacccccattgtgcatgctggggagaccccaaaacaccaaaggagttctctagggtctcacaactgctaaaataaaggctgtttgacccagcactgtctcctcaaacctgggaccctggttatatccaggtcttcccaaggtgctgaaggggcacactttttcataatggtgactacgtaaggagttgacgggggagggtgagcggtcagaagcccagaggggcctttgagtaggacttatggaaaggaggagcttacaggatggaacctacaagatgtgacctcacttccttgccgacagacccccaacagaacttacaattctggtaactaggcacccacattctagagacagccccatttccagctcacttcgtaggcgatgctcgagagaacaacatgttctcctgctgtatcccgacatgctgccgacctcctcgtcgcacaagaggccaaaatgagagtc

SEQ ID NO: 726 - DNA, 1058 bp, Homo sapiens
ataggggaaatctgatgggtgttggcaaatgattaacacaagaatgaagtggcatgatgaatcaaagatgacttctaagtttttatcttaggtgaaccaaagaatttattcccttgaccagaaataaggcccctaacagggataaataatttagtaggtggaagtggatgagtttggttagagttgatgattctgaggatatgatgagatatcgaggttagaaacatgggcctaggccaggtgctgtggttcatgcctgtaatcccagcactttgggaggctgaggcaggaggattgcttgagtccaggagatgaagaccagtcagggtaacacagtaagatcctgcctctacaaaaattagccagacgttgtggcatgcgcctgtagtcccagctacttgggaagctgaggtggaaggatcacttgcactccggtgggcctagacttctggtgggactgggagtcgtcagagtgtagggtagagttgttagagtatggggtagaccaggacattttggaccaagcatcagaacacatggaaccaaatgtttgacattgagatcaacccatcctgttagatacctgtagtagtggttcatctagacgccttataggagaatcaaggatgccccaggaaagaagagagttagtgagagacagaggattctttcccccaaggatcaggtggaagaatacctccagcaaaggagaagtaaagggatcatggaccagagagaagaactagacttgtgctgtatggtagacctcattgatgagtccctaccacatgcaagactgtgaaagattatagagggcagggtggccatgggatagaggatcctgagggattttatagttcagaggggcaaacagccagttgtcaatggctaaatgtaatactttgaagaataaaaaaatgctgaactggacttcagacaacacattgtggaaatgcagaagcaatagcaattaatcctaacgatggaatgagaggagatacgatcccagagactaaaggacatttttcaaaggcaagggaaatggctaactatggcat

SEQ ID NO: 727 - DNA, 1051 bp, Homo sapiens
gtgctcccatgtaaggatgactctgagacccagctgagtgttccaggagagcccccgggtgggcagtggcctgggcctggccaagcagggtgcaccaggctcctgcccccatccctccaccgctggccctcaggtgggtcctgggtcccctctgggggcagtactggggctgcctcaagatccatcctgggctcctcttggggtggtcccttgtctccctcagagccttcctgggtcccccaggctccttcctgccccacatgccaggatgctggtttgaaggggagagtaggccagctacggcccctggcccgcatcactgctaaggacatggggtccccccatccctggctgtggtccccagcccgcatcactgctaaggacaagggtctctcggtccctggctgtgggccctggcctgcatcactgctgagaacacaggcaaccctggcctccatcactgctgaggacacagggtccccccgtccctggctgtggcccccggcctgcatcactgctgaggacacaggtgttccctgtccctggccatggcccccgaccttcatcactgctgaggacacaggtgtctgttccccatccctggccgttgccccctggctggcatcactgctgaggacacagggtcccccatccctggctgtgacccctggcctccatcattgctaaggacacaggcatttgtccccctctcccttgctgtggccccaagcatctgccctttgcctcccacagggccgagggtgaaactgaatccgggacagtgacacccgggctattttggggctgggctgggccggcctggccggcacagggggtggggtgggggcgggcccaggcttctccagctgacagtgtccgcctgtccttttgtccccgtccagtttgaggagcggccggagtgtgggctgctggtaggcagcctgctggtcctgggccctcggagggaggtgagacccggcagcccctgcctcccagcctgtgcccccagcctgcgtgctgcccagagcccccatagagagaggtgaggaga

SEQ ID NO: 728 - DNA, 1039 bp, Homo sapiens
agcaacagtgggataagattggaaaggtatattgggggcttattcaagaggaacttagaatatggaactgggtatttgtaattcaaaggacattgttaatgtagagatgttcacattagtttaccagagctatcactattctagggaatatacgctaaccaaatgcccccaatctctcttcacatataattttgtcatctataatggatatatatcatttaattatatggctgtaccaacatatatgtaatcattcacctgtcgttgaacctataggttgtttctaatattctgctttgcaataatattataacactcttcttttgctaatttttttgcattgcttctataggctagaatcttagatattaaactgataggataagatataaaataatttaagattgctgatatatgttttaaaattaattatttgctcaagcatttgtgacaatttacagttctaattgaggttttaaatttagtagtttgtaggtattttaagttttgcccctgaattctttataggtgctgataagcctttggtaagttttactccatgaaagactattactgaaaaaaacgtaatctcaataaaagaactttaataagcttgactaaatatttagaaagcacattgtgttcagtgaaactttgtatataatgaatagaataataaaagattatgttggatgactagtctgtaattgcctcaaggaaagcatacaatgaataagttattttggtacttcctcaaaatagccaacacaatagggaaatggagaaaatgtactctgaacaccatgaaaagggaacctgaaaatctaatgtgtaaacttggagaaatgacattagaaaacgaaagcaacaaaagagaacactctccaaaataatctgagatgcatgaaaggcaaacattcactagagctggaatttccctaagtctatgcagggataagtagcatatttgaccttcaccatgattatcaagcacttctttggaactgtgttggtgctgctggcctctaccactatcttc

SEQ ID NO: 729 - DNA, 1038 bp, Homo sapiens
tgacaaagttgttgaggctttgagaaaacttctgatgctacgggaaataattcttttgacttatggtgattgcttttttgaacttttcactcttactcagtaacttaagtttggaggagagaattttgagaagtgatttaaatgagaatgcaaatgataatcatggaaaccaggaacatagagtaccaattaacactattggctcggaagtacaaaaagcaaaaatgttttctcagtgaacatgttaacatcatgatgtgatcaaagtaagttgttaaacatcaaacaaagataatcagtaaacattactccttttccattttattattaataggcccaatttgtgataattatctgtaaatgctggaagaagagaggattagagtgtgctcatcaaagggactaaaggacactgtgttcttcttgaggtctcaagttcctttaaggtgaagctacggtgacacatttagtggggagaggccataggcagaggtttccttatatacgacctccttaaactcttagctgttgagtagcagaggtaggagtgtttatgtaatcgagttattcttattgggctgagaaaacctacacttgtttgaactgctttctgggaacagagaaggggagggaagcccctgtcggctggaaactaaaggaacagagcaaaggcattatttgagtgtcttgggatgttctgtattccatctaacagtgcactaaaaaaagataagttcctgagaacaattctgattttgtagttcagtttagttacttggcgatgaggaactggaataaatgtgaagaacaaactcttgagacaatatagcagagagtagagaattcagaaatgaagacaacatttatgcttgttttcttgctgggcttgcatgtggagtgactatgcctttttcaccttctgattggttggattccaattaaatggtggtgcctatcttaacccctgaatcaagactgaaagacttttgagatggacttttgaaagagtgtttgagggaactgttaatgctggctgta

SEQ ID NO: 730 - DNA, 1027 bp, Homo sapiens
aggattggggcaaatttctacatgtaaaaactcagagggcaaatgaagacaacaggaaatataatctagttggataatgtatatcttcaacaattttgctcatattaaatatgacagggattttcttggttgggtatcacaacatcttaggatgtaggctgataacagtattaagctcagtttaataaaatcaattctattagaggataccaaaaagatatgtttttacaagattctttcatgatttgagtgctttctacttatggtcaagttttatttattaaagaatgaggcatttaagctgaacacattcttcaacaaaaggctaccttatttctggaagcagatatactaccagctgtgtggccacagctgactcattcaacattccttaggttcagcttctttgactttaaaataattttcataacctgaaactgacagctacgttttaatgactagatatcataacatatatggtgaaatggactatttctatttcttctctttagagtagaaatgtgaacctcattcagcaaaagttttgtttgtacttgtcttatgtatatgtctatagaagcagcattctaagaaatatttagagtaattggttcaattgttgattggcatcattgtattatgcagtttgtctatgaaatatgcatagtcttaactcatttattttatagagtggttccctgtgttctggtaaaagctttattttcaagacttctttataaaataaaaatgtaaagaaaaacctagctgtaagacaatgtagcttttgaggccctgtaattggaatgagtccactttaaatcctttaaagaggatccactgtagggcaagtctggtgccaacagctgcggtaattccagctccaatagtgtatattaaagttgctgcagttaaaaagcccgtagttggatctcgggagcaggcgtgaggtccgctgcgaggcgagccaccgcccgtccccacccgttaactctcggcgccccctcgatgctctagccctggatgtact

SEQ ID NO: 731 - DNA, 1023 bp, Homo sapiens
tttaaatgaaggagctcaccagccagcatcttagtatttgagcccctgctttcccaataactgaccttatacctttctctaatccggagcctccctctacccactctcaactccccagtagagttgaattccagagaatatcctggatttcttagaggacattatgttctagcttgcagcaggactctcgttgtttgaggtccagtcaaccagagctgtcttcagatgattaaaatgtgccataaaatgaaactgtttaatttctctggctataagtatgtcttttcttaaagatcagggcaaaagcacaacgttagcatgattaataaaagtagcaaacactcattctgtgtattccatacatccataagtacgtaggcttagcaaaacctttcactttctttcctggccccctggtagccgaaaaccccaaggtgatctgcgcatacgagttcccactttttaaacctgcaaaaacaaatctgacctgctgtggtcttctggggactccaaagttgtaatatttagcccacaggttgcctacattcttccccttcctccatctcttttctagcctgattaaaattgatagcccgagggaaagagagggactctggatttccaccctcctacccagggcgtgttccctgcccgtgactcagcctgtgatttagggcgtctgcagggtgaggtgggtggaaggtgatgcccgccccacctcacaggaattacagagcggtgcgcttacctgcgggactgttatgtgcgctctggcacaggctgactcatgtgtgaagtttaaaggtggggcccctgccgcagacagccttcctcacctgagtcaggcaggcccgggcactgagcaggaagggcaggtataagaggaagaggcagaggttcctgcgcagccagcggacgtccaggaaccgggatgcctccagcagtgaggcggtcagcctgcagcatgggatggctgtggatctttggggcagccctggggcagtgtctgggctacagttcaca

SEQ ID NO: 732 - DNA, 1022 bp, Homo sapiens
cagcataagctctgtgagtgcaggcggccctgggcactggagccttgttgcatggacgtgctccttgcacccttgttgatgaatgagcgaaggtgtgtgggagtgaatcccagagggtgcaggccacggcactgggggaggaccctcccggctgcctcccagtgggcttcaggggctcagatagaccctgccgagcacctctgtcctctgctcccggactggggctgcagagagctctcaaggggccttgggaggcacaagcaggccagggtcccagggaggggaggcaggaggcagcagggccggatggtgggctgcagaggtggaaggaacaggacagtctgttctgggggtgctggctgtgggggacagaggccaggccacaaagcagaatggtgggtgggccaggaggaggtgggagcctttttcaaaaggctttcagggactttttatatttaatgattgaaacaaaagatatccaaaaccgcagttcctgagaaccacttgttctcgccctggttcctctccttgggcttgaccttggcctcctgccgggcctggcagcggacagcagtctccctgcttcccaggctgggcgagggagagcgtgggtccccaggaacgggggaggtggtgcggctggctttaggatgcccattctggaaccttctggtggaagaaagcaggggatcagtatagtatggttgatccacacactccagaccctctcctggctgtgcagctggtctgatctgggctcagaggctgccactgctcagtgctcccctgggtaattttgcaggaggccaggagggttcctggcagttagtgccacccacacggagaaattcagagccatataaacgggtctccagggcctggagggactgcacatcctgggcctgcggcgcagtgtagacctgggaggatgggcggcctgctgctggctgcttttctggctttggtctcggtgcccagggcccaggccgtgtggttgggaagactggaccctgagcaggtac

SEQ ID NO: 733 - DNA, 1018 bp, Homo sapiens
atgatttctgactcctggactggtactttgccacaggcctttccagccctcctcagccccaatccctgaggacagtctgtggctgccccactgggagatgcccagcgttggaattgctgaaggaggcctctccaggaaggcttctccacttgtgtgccctcccatggggccggcctgctcctaccccacccacttccccttctccaggataagcccgctgcaacagctccgtctcccagtgtctcagcctctctggctgctcagcccagcctggtccagctggctatgctggcatggaccctagtctggtggccagttataaatagcccctgcacccacagccttggcagggtgctcctagtgtgggtgcagaggacacttgagaagaggcagccgtgcctgccatcctgaccatgccaggcccagagctgccatggaggcacccaggagcaggcccaaggacacatgggccctatgagctgaggaacctgccctgggcacagggttctgcaggcccaacgtggccggtcagggctggctgtaggcttgaggcatcactttatctcatgactggggatagagcatgggagggtggcgacccagagggcctgtgaggcttggggctggaggcagaacaaagtgggcctgtttgcctgcctgattgcttcctttgagcccaactcattagagggcagctgggcaaatcctctgattccagggagggatgaagggagggagaaggcagggccaagaatgtcctaccataggatctgcagcccatcggagatcactgtagccctcagcccccggcccagggaggagcatgtttagtggaggagcactgtggtggagtcggaagactccgttcaaacaccaccagtgatacagtgttactgtgcacagttcatgtgacttttttctcacgagtaaaatggaattgataatacctaccttgcaggaccacgacaggattaagtgaggaaaaacccccatgagagtgttttgccattgtcaagtg

SEQ ID NO: 734 - DNA, 1009 bp, Homo sapiens
ccaccaaatctccgttttaagtgtaagttttctaagttttgtacacttgtcattccagagggtccagatatttcatagatgaagcccaggtgggctttgctttgcactgaaactagcaagaaaggacacaaaagactgcagagaatgttggggcagattgctggctgcgtatgccaggtcccttgaggagcaagaacatccagtgccaaataggacactagtttggtctttctccaaaccataaactcttggaaccaagagctggtctttggtgtgttgcaggagagtcctcatcccagcgtagacatcccagctggagctcccagtcagagcctaggctgggccagtagaccatgctgtggcctttcttgcttgccccaagctctgcaaagcatcaggcagggccaggcctgcaccatgaccgccaggtgcttctatcctggtggccgacccctgatagcatgcagaacagaatgagagcggcttgcttaagggccagagtcttacttgttccctggagtgagtagaaaagtaggaaatctcgtcagaacatgagacctttttgcgttcttcctttccattcttctttacttcattccctctttcttcttttttttctgtccttctttccttcttttctcctttcgttcacaaaccacacttggagagcaagggtagaggagcagaacagtttgttctctattgcttctagaagttcagaaagcagtagttgcagatgagccagaactcaggcagagaagggttctgtctcttcatactcagtctcctgggcccgtggaaatggtgtgtttcagagcctggtctgtggtaccgctggagtttttcccatgggacttttcacattcaggaaaagtacagaactgttcacatttttttccctgtgctgaattgtttttgcataaagttcccttcttaactccaggtccctcctgtaacgtgaaataaaaagaaagaaatttgccctgccatgatttgcacctgatattca

SEQ ID NO: 735 - DNA, 998 bp, Homo sapiens
ccagctgagactccttctcaaacaaacaaacaacaacaacaacaacaaaaacatttagaataaaaaccaaatcacttccatcgcccaaaagtcctttcatggtacagctcctgcccagctttctgatcttgtctttccctggctgaggaattctatggctgtgaaatgggtaggacacagtgaacctcagctatgtgccaggtcaggagcctcccacacatcacctgatacagtccttgctacaacccagcaaggtaagtgttattaactctgaatttgttgtgagcattaagtggaagtggatgatgctagtgcataagcagtgatcagcaaatgctggagtccctgcctttccttttgttccagtggtggaggtgggcaggacctgtagcctagaaaagtctacactgcttagggatagaactggaaccagagccggctgtcccttgtcattcatgctcccttatccactagcctgatgacctgtctatagggggagctgagaagcgcgagttctcgctctctggagggacatgtgggttgctgaaggagttaagatgtctcttaccaaaccctggccctccccatccctgcatctgcctttgtggctttaatgagaaatccaggcgcttcataagagactgtacaaataacttctagggcgccactaactcattcagcagaaagggacccagggctgccaatgtttcagggaagataagtgagtggaaaaaaggtggtttttatagcgtcaggcggaccgaaggatttgcgtggttgagcgtgaactccgcccctgcagcagagctgaaaaaaaccaggatccgggttcctcagccccttttcacaatatttgattaggaatttggggcgggaccctggtctggcacaggcacgcacactctcagtagactctttcactcctctctctcttcctctctcacacgttctccaacccaaggaggccagacagagggacgtggtcactctctgaaaag

SEQ ID NO: 736 - DNA, 996 bp, Homo sapiens
tttccccaccctttctttacattgcctggtaactaaattttccactttctcatttttaaaatacttaacactacatctttcctctaagaagcccaaagtactttgtgattggtaatttattaattcttacaaatctctatgagcaaagtagtatcaggcattttttaaaaccatttcatagatgtggatctaagaaaaaaataaaatatcagttgcagttctagggacaagaccaaaaggacatagactcttaactcaaggctttcttctacatggttgaggtcttatttttattagcagcaattgtttagtgaatcagattccctgttttttcactgtggctttttgtttttttctctagattttccatgatgatgatgccatccctggatgggaagggaaaattgtagcttgggtggaagaagaccatggagagaattaatgccaagtatcagattgagggcttatggaacctggtcactccctggctgcttcactcaggaaagggaactaaaaccagaatacactaagaagtttctagtttgtgtgccaaaacagaagcttctccaagcatgatggccacaggtcagtcctctttctgtgcctggcatatctggtacttaaaattctgtccaaatgtagaccatgggttcatctggagttccttgtccgtgggaacacagtgttctattctactctgaggacaacaaaccgaaggccttaaacgatggggatggatgatcccgcctctgtaggggcatggctgctattatctggaaattaggaattggatgcatcattcctgtgtgttacagtattattttaattggcctcaatggttgcagcaatcagagtcccagcgtttgtactcacagacaaggcaaaggtaccagcttttctgtttctttgaacctactgcaaaccaagaataactcatgaggtggtaccaaagatgaaagcccagacttcagtaatcttttgaaccagacgtggatg

SEQ ID NO: 737 - DNA, 980 bp, Homo sapiens
catgaggctgttcattcactcagctgacattgtttgctgggtggcactcgatggtacaagttgcctggggttgcggaagccaagaggacgtgatgtttgctgttgacaaagttccagcctttggaagcaagactcataggcagatcactgcaaccccaggctttgatacagtggaggtgcagtgtgtgtgtgtgtgtgtgtgtgtgtgtttgtgtgtgtgtgttcatgcacatgcacgtgatagaagagaacacagtttaccaggggaattcaaggaacccctcactgattcaaagtccacagactaaccctgggacatgcatctgttctgccatagtgacctgaggcttgataggataagatgggggtggcttgtacaagaagctccctaaccacactcacacctcgtccagtgacttgggggctggccactagctctgggcgtggacacaatgccctcagggactctggcactgcctgacttagcaccttaggcagaggcttgtgcagaagggagaagagggggcattttctgtctttgcctcctgccaccccagtgcagtgaccacggaccaaggaatggtcgagaaaaggcccaagtcatgtttgaaagcatgcaggagctgggacggctgtaaacagtgccactgctggccagggtgatgcaggcagctgcctggcctccagcctctcctctggggccagggccacgcacagggaagctgcagggagcacacggcgaactcctccagggccccatcccgctttctgggcagcctctgccttctggaggcagcggtggcttccagcttgccgctgtgagctgccctgtggtggccgcccctcccagtgggggctcctccctctcaccaggcttcagtgttcacgaaaaccagaggccatttaatctcccagctgggcgccctggaatgcggggagctggggagaaaggccatttccctaattcctctagtcaggcc

SEQ ID NO: 738 - DNA, 980 bp, Homo sapiens
ggcctgctgcactttagataagactgttggcaaggaagccccggccggccccccaggggcacagaaggtggcccgcatcaggcaccagcagcacttgatggccgccgaggtggagcaggggggcattggggctgaggccaagcgcaagtccctggagctggcatccctgggctacagtgggccccacctgcccccatggggtgtccaggcaggccagggcaccgccatggccatcagcgaggagcgcaaggctggcgcctacctggacccctttggcagtggcctgcagcaggcggctcttctgccccaggaactgcctgcgccgccggacgaggtctcagccatgaagaacctgctcaaatacagcagccaggccctggtggtgggccagaaagcacccttggtgggcctgggtggcctcaaggccagctgcatccagcaggaagcaaagttcctgtcctctaagggcccaggccagtcggagaggccggactgtgcccgcagcagggagcacgacaccacgcacggcgacggggaggtgcggcagccccctgtgggcattgcagtggccttggcccggcagaaggacacagtgagccggtctgaggcagcctacggcaccaacactgcgcggcagggccgggccgcccccgccttcaaaggtacaggccctgcacagagagggaggcaggccgggacagtctagggggcccagctggccctgccctgcgccccggctccccagctcccacacctgcccttggcagaccctccgaggccccaggaccaggggatcctcctcagtgcatcaggccccccagctcgaagcggggtcactgcttgccttagctggtggctccctggccgccccaaccctctcccgtctgctgtctcgaccctgtgcaggtggcggtgggccccgttccacacacgcgctggacctggaggctgaggaggagaggacgaggctatgtgatgac

SEQ ID NO: 739 - DNA, 970 bp, Homo sapiens
gcctagaaactgcaaacaagctgaatttattattgtgaaaatagaatgagaggtccaagaaacctgcttcccccctccactttttttttaggagacaggtttccctctttttcaggctagagtgcagtgggatgatcatagcttgctgcagccttgaactcttaggctcaagtgatcctcccacctcagtcccccaagtagctgagagaacaggcatgtgccaccatgcccggataatattttttatttttattttttgtggacacaggatcttgctatgttgcccaggctgatcttgaacttctggcctcccaaagtgctgacatgagtcaccgtgcccagccctcctccctttttaattggaatctgtttatttatttatttctctctgtggcccaggctagattgcagtggcatgatcatagctcactgtaacctcaaactcctggcctcaagcagtcctcccaccttggcctcccaaaaagtgctggaattacaggcatgagccaccttgcctgaccactcctccctttttaactggcccttctctcctcccttcatggctgttatcccacaaatcatgggagggtagaagatgccgaggagttgataccagtgccctagcatttcctgttcccttgctgggaagctgtgtaggatcctatcagggttattccctgatgtctgggtgagctcgaggggagaggctgagccctggcactactctctcctgcagcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccaggtgggttctctctgttctcctcctc

SEQ ID NO: 740 - DNA, 967 bp, Homo sapiens
gcttggtcattctctgtgtttccacttgtaatttgaatggttgattttatcttaaaattccagtttgcctatatagttaaaacatttacatacttttattatcaagcatagatttgattatttaacagtaggtattctattgtgaatgtatgtatgtatataaacatatcacatcatatttgaccagatagttgaaggatgaaatgtccttgagttttgaaaacatctgtatgtgtaatattgactttactttggtgaatttgtttgtaagaaacaaaaagttatttgttctgcaatgtctaatatctccctctccattctaaatggtacaggtagtctgtaattgaatttctaagtagctactcaatcattcggtcaagacgtagttatatgagtacgtactttgttcaaggtgctgtgctgtaaaaagatagtggttattgggaaattaaccgataaaatatagatcctgttcttaagcagattatgacctgagagaggtgataagacaaacatacaaatacctataatagtaattgaatgtgatgagtgctgtgagacaggtcctgaaacagtgctttgaacattcagggagagggaatgattattgtattttcatttgagaaaaatcagggcaagttttatggaggacttggtggtagacaaaagcattgagggcaggggatgatttctttaagaatagagacaaggagaacagtatgttcaggaagattaaatagcaaagatgaaaagacggagtaatgcaggggaaagtgcaaggagtgtggcatcagctgaagtgggagagggaagcatatcgtctaggtgtagtaagaaaacattggtggattttaatggagggaggtggtggggagcagtatgtagtaagtatgtagatatggatgaaaatgagaaatgtcaattttccaaatttacgtggatcttttcttggcaggttttatacccc

SEQ ID NO: 741 - DNA, 961 bp, Homo sapiens
ctttctttgcacatgggcttcagaatgttaaattaaaaaaaaaacttatattttcttttttattaacaacatttgaaagcaggaattatattttttttaaattttagagctgagttacaaggaggaatttttttttgtatgctttgtctttttctttttttttctttaaaagtatttggaaagcagtctcatgaggctggagcatgggtgtttcatttctatcttattttcttcctccagcagcatgagtgtcctcttggcaacatgtatttttctaatttaggagtgtttctctacatgtcaatcttgttcctctggatgtccatggcatggctcattgtgttctccgtatttcaggacgatgctgcaaagcttgagcagtattttatcctccctggactctcagagagacatgggagtattgatgtgctttgtttccaagcttagacaaacatgttgtagtagggaaacaaacatggaaacctactactatttcataatgtcttatttcaaagaagtcttattttttttttaaagtatcactattgagatgtgcacacaatagggctttaagaaggatgtaggctgttaaaatgcagggcagtgaggtgccatgagcagtggttccattgtgccttgctcagtaaacatgctgctgccctgcctcctcaaagggcacaattgatggttattgatgacctttctgtaaaaccacaaccttctgtctttttcctgatttcaggtagatgcgctgagattacgactggaagaaaaagaatctttcctcaataaaaaaacaaaacagctacaggacctcacagaagagaaggggacactggccggtgaaattcgtgacatgaaagatatgttagaagtgaaggaaagaaaaatcaatgttcttcagaaaaaggtgagtagctgacataagaccttcaagtggggtatcatccatgttttgtca

SEQ ID NO: 742 - DNA, 960 bp, Homo sapiens
caaaacatatccagggaggacaaactctgggctggacaatgtatccacaagggggtgtgaacatttccccaagcaggaaactaaataatcagtgtcttagtggggaactcgagcaacaaatctgtgagatatttattccaataaactttctaattctctgtttgattcatatgctatcttgggtgctggagggaactgctgctttctcttagcctagtctggggaaggggaaacagcggagaaggagaaggagcgaggcagggaggccccaacacgtagcacaagggtattactaggtgggtagtgaagcagtaaaagctcttattccaattctggctccaacagtaatttgtgagcaaattactccacacccctgagattcggtttcttcgcctttcaaaatggggactcagaacacagtgaaccagaggatggtttcagagtcctcaacttagtacctaatgcactgtgagagctcggcgagttttagctactactactgtgcgcatgtgacccaaggagggcaagagaaagcccgggaaaagcgaactgtaacacacgccagagcttcctcccacggatcctcggagtccgaaacccgagcgtcgggcctgcccgccccagccctgaccccgaccccaaagagcatcaccccctcaaggctcgccacccgcctccttaccatggccccaccacctgctgccggaagtaaatcccaccggcccccggaacccctaagagcgcatgctcgaatgtacaaggcgggcgtgatctgcgttgcaccctgggagttgcggtccaggaatcgtggctgccgctactcccaggcgttatgggaacggagtcccctcctcttcccgacgtgccctgcgactcagcggccgaacccggaagttccgggccgagttcctcgtgccaacgtgtcttgtaaggtgcggctagaaactggggacatggcag

SEQ ID NO: 743 - DNA, 953 bp, Homo sapiens
ccttgtcatttcagctttggtctgctctaaacttatccatctctgtccattactggaacaactccgcaaagtccttattccctaaaacatcactgataccattaaagccactaacagagactgaactcagaataaaggaaatcatagagaaactagatcagcagatcccacccagacctttcacccatgtgaacaccaccaccagtgccacacacagcacagccaccatcctcaaccctcgagatacatactgcaggggagaccagctggacatcctactggaggtgagggaccacttgggacagaggaagcaatatggtggggatttcctgagggccaggatgtcctccccagcactgacggcaggtgcttcaggaaaggtgatggacttcaacaatggcacctacctggtcagcttcactctgttctgggagggccaggtctccctgtctctgctgctcatccaccccagtgaaggggcgtcggctctctggagggcaaggaaccaaggctatgataaaattattttcaaaggcaaatttgttaatggcacctctcatgtcttcactgaatgtggcctgaccctaaactcaaatgctgaactctgtgaatatctggatgacagagaccaagaagccttctattgtatgaagcctcaacacatgccctgtgaggctctgacctacatgaccacccggaatagagaggtatcttatcttacagacaaggaaaacagccttttccacaggtgagtatacttttcatgtatactgagaagtgtcccctgagaagtgccccagtcagagctacattgcccattgcaacattgagcatgactcagaggcctcctgtactcaaggtaagacatgtggtgtcttcttggggcctctactcaccactctaggccaaagtttgcattttcactatattgtcccattcagtcatgtgttttg

SEQ ID NO: 744 - DNA, 944 bp, Homo sapiens
agttggccttacatttcccatttactgtatgtgctgggagattggatcttaccaaaggaattcttaatggaattaattattaggtgtttgttttacgcatggctttatgttgcatggggcatgaaagccagtgcccatcctggcattataagagcaggagacctggcattttaagtggcccgcagtgaatgagctggactaggacagggagctgtgggaatgagactcactcctcttggcttttgctgacttatattctaaaagacttcgatggcctgaaagttggcaatcaggttttccaagatgaacctgctttttatgcagtgattttttttttttttttaaacagtgcagagttcaaatagctcaacagtattagcagtgaatatccttccttccgggtagttgtctctggctttgtcctggaatggccatacactattctagaatagtaggtggcatggtcaacaacaaagtgttctgttttttgtgcaaaaccattgttgctttcgttctgctgttctgaacatcaggagcatcattttcaatttattattattattatttttaggagtggaaacaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctc

SEQ ID NO: 745 - DNA, 942 bp, Homo sapiens
tgatgtgaggacaacaaggaagagctggaatgtgagggtttaatcacaggctcctcaccctccgctgatgggtaggtgtgttagctccagcatggagcaccaccgcactaggtgggggaagggtgagagggcaatggggcagcctgtgagctggggcaacgtaggcagagaaggaactgtgtcaccacagaaacttctgccttcacccatcccttcagctctgcaggacaggtagagactccaggatcatccactgagcactggacataaggaaggctgcatggggaggactcaggacagtgacatcacaggatacccctcctattaggaaaatcaaggcccagaattcactcggctcttccccaggaggaccaagccctgaatcaggtgcagtgctgcctgccccactgtgccatgggccctgggctcctctgctgggtgctgctttgtctcctgggagcaggtgagtcctgggcacaggacagcagccccattctcagctttcccacccatgtcctccactttaccttggggaggacctccaggctttctgctgtgctcatcctccatctgcttttcccacaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcagcttggcacagcccggcagagtctctgacattctatacataaacttcctgccttagctttgacttgaga

SEQ ID NO: 746 - DNA, 940 bp, Homo sapiens
gccctgtggatttcctagtgttattttccttatagtgatttcctaaggtcacagtttcctaacttctgattttgtagttttgatgtgaaagaacaaaagtgcttcgatttcaaacatattggagatagactcgacgccgggcgggccatgggcattcagcggaaaaccagacagacaaaaagattctgctctcccgaagcttacattgtggtgaatttaaaagttgtttctcaacattagcgctttacccatcagcagccctgcccagggcgaggcgcctcgatgcttgaagttcactgttcaggcgaaggagaacacagtgttcccaaggaccattgtaagctgggcggccaaaatttgaaagaacataaatcgcagggcaacgaaggaggcgggggtctctggaggttacttctattagcgtcaatacgggcgaaatcaggggacctagcaggagcctgaaaacttcaagccaaacaaacagtgagatcacacctcccacccgccacctccctccactgccgccgccgcgagacggctgccccgggggtggcccggggaaggcaggggggctcggagaagacggactctgctttcgctccccctttcttccccatccctaacatgggctttgccctggagcgcttcgcagaagccgtggacccggctctggagtgcaaactgtgcggccaggtgcttgaagagcccctgtgcacgccgtgcgggcacgtcttctgcgccagctgcctgttgccctgggcggtgcggaggcgccggtgcccgctgcagtgccagcccttggcgcccggcgagctgtaccgggtgctgccgctgcgcagcctcatccagaagctgcgagtccagtgcgactaccgcgcccgcggctgcggccactcggtcaggctgcacgagctggaggcgcacgtcgagcactgcgact

SEQ ID NO: 747 - DNA, 933 bp, Homo sapiens
aaactgagtccacgtccacatttgagggtgggagggaacagagggaaactgagtccaggtccacatttgatggtggcttttaatgcactgcagggtgtgtccccttgaccttcacgaattttcaggtagtaagaaagcaatttttcttattggaaaggagaaaactaagtgactgtaaaataatataatttccttaaagcaaaacaacagagaaccaacttttccttttttcacattacccaataattctaagactcagggttttgtcacgttacagcaaatgccattcattgggggaagtcggaagtcagaacagtgtgtgctattcaaattctcgatgaataattaactcaaatgtgttcagagtgctataaaatgaaattaatttatttttagtttaacccaaaatccccaatcacttgccaaatgatcctctatgtatcctacataaaagacagggtctttctggcagaaaaccattgaagtttttatttgcagtaagagaagcatgccttattatcaaacaggtgcatggtccccttgtgggggggtgcccgtcacctgcgtccccgtgcgtcacggcgttgccgcacaccattaacacatcaaaacggaaaaggaaatgtaagcagtgtttgccgtccaaagttcacatcaacaattccttattaggaaggcaattctgagcctttcctcctgcatctgggagctgccagcaacccagttccaggagagaaaatagcttgacacctcctgcggcccatggagtcctcccgttgggacaaggaccccccaggagagagaagaccccagcagagtcaacactggaggtcctgcggggtgggtggtgctggggaggccacacggggagggctgttccctgttcccttcccctcaggagacagctggcccgaggtgacacagcactggatg

SEQ ID NO: 748 - DNA, 929 bp, Homo sapiens
tggcctttgaggtgtttgttttatggtcttaaagaggtaatcagataataacattacgtaatatagttatactgcagtgtagtctgtaagagtctttgaggaagaacagagggtcatggaaattcagaacaaagagatatctctgggccgagggaatcaggagacggttaatgaggaagtgtgcttgaatgatacttggtgaggtttggcatggtagagaggagttcagagtttctctgtaaattctcataggcccctgttttttccctgttacgaacttttggactcactatcctgcattgaaactgcgtgtttgctcagcaaccgcggagcacactgtgggccctcagtaaatgtttaagtgaatgcatgaattcctggtagaagggctgtttctggaaatctttgtgctcagcacttatgaggagtgcatctaatacatccctaacttattttgttatcagagccttaaaagacagcgtatcagaccatgtggttgtatagttaaggttcagtgtttcaaataagagcagtcattgtgggcgcctcgtttttttttctagctactcgtgtcttctccggcagatggtctaacggctggatagaggcatatttttagtttgaatttcctgcgcttacagaatggttttatctaatttgtagctactggggttctttattctctggggccacctgaaggctttcaaacacagtaataagccctcctcgggctgggaaacaggaagctgtgttttaaatgccgtgatcactggattaaaggaaacatggctccactctgttctcttgccaggtggaattatttttttctttatgatggttccaaggtaaaggaagaaggcgatccaacaagagctggcatttgttacttttatccttcccaggtaagccacacagcattttattgttca

SEQ ID NO: 749 - DNA, 926 bp, Homo sapiens
cggagaaattgttctgctctgttacaaaatctgtccccgttccctcttccacacatgtaagcagcaagcacttactgtcagattttgaccctggggaagtcattcatttccactcgaaccagctgtttcaaataacttgtgcatgttgcatttaccaacagaaaattatacctttttttctttgattcactgagggatttttgtttggaaaacatttactagtatctttcagctgctatgctagatttcgcagcaagcttctcattttaaaagaggaacccccacaatgtcccaaccttcaaggtctcttgtggtgtcccgcgaaggggaacatgaagggaggtggaaggggaacaaagtgttctcctggaattagtactcgccaggggctgcttcagagtacaactattaaaaggaagcttgtagagtggggaaacaccagaagaatggagcaataagaataaggttcaaaccttggattcaaaatgttgagttattgaacctttacattgcaccttcataaaatgagaataaagatacgactctataaggtatgtagtatattgtttctaatacacaagaggtgctccaaaattgtagctactaatttaactattttttgaaaaaaagttctgccctttttaagaaggcaaaagtaaaacttaacacatcaccagagatatcattaggacaatatgggatattgtttccatggaggttatagaattgcaccaataaagacagcattatttcacataccacattctcttacaaaatctaacttgtaacagataatttacatttctagagaacaagctctttatggtacatagaaataatcctgtcatacagtgaccattcagtaagtatgcatttaataataaaatgcatagattagtgatacagaccattatgatgacaaacga

SEQ ID NO: 750 - DNA, 926 bp, Homo sapiens
atacataggtctccagtgcccaagaataaccctaaatctggattaatgtgttggacccatttctttctctttccctctccctcttttcccaggttttcttttaattatctaataagccccagaacttggctctgtgtgggtccaaagggacaggatttagactgaaagtttagcctcagtttgcttctttataactctgcatttttttctgaagctaacacttttatctaaagagccgcattgcaggagatgtactaggttcccaggttcctctaggctgggcatccatacgaggcattccagaatgttcagaggatgccctgagtgccaggccttagggagaataaagacataggaaaaatggtctcatacaactaattagagtcctcacagagcacacacgaaccttttgagcaagggtttgttgactgaataaaacacaaacaaaaacagacattgaaagaaggacattgtgtgctcagattctaagtgatgttgggacttgagctgagtcctaaagaaaactggaactcgagtccacaaagaagcgcagcataagtgaaggtcacaggataggaaggtgttgcatgaggtgtgtgtgtgtcggcttaactgtgtcacttaatatctaacattgacgttctgtgtcatcaaatcctgccccagccactgctgagaccctggtcagtgctggtcagtgctgctggaatgatagcatggaacctgggcttttgtctctccctccgcccctccaggctcctagaacattgccggaaacacaaatacctctccagctctggggaggtcttcgccctcctggtcagcagcctcttagagaacctgctggactatagaaccatcatcatgcaagatgagagcaaggagaaccgtatgagctgcactgtgaacgtgctggtatgtgacat

SEQ ID NO: 751 - DNA, 923 bp, Homo sapiens
tgggaggtctggacaactctaagaagcaaaagggaaatgctgcagggaacaaaatcagtcagcttccttcccaggacagacatttcagtctggcaaccttcaacagaagaatccccacagaacacagtgtccttgaatctcatgagagtgaaggaagtttcagtatgaattcaaatgatattacacaacagagcgttgacactagggaaaagctctatgagtgctttgactgtgggaaggccttttgccagagctcaaagctgattagacatcagagaattcatactggagagagaccttatgcatgtaaagaatgtggcaaagccttcagtttgagctcagaccttgttagacatcagagaattcatagtggtgaaaaaccctatgaatgttgtgaatgtggaaaagccttcaggggcagttcagagctcatcaggcatcggagaatccacactggagagaagccttatgaatgtggagaatgtgggaaggccttcagccggagctcagcccttattcagcataagaaaattcacactggagataaaagctatgaatgtattgcatgtggtaaggcttttggtaggagttctatccttattgaacatcaaagaattcacactggagagaaaccttatgaatgtaatgaatgtggaaaatccttcaatcagagctcagccctcacccagcaccagagaattcacactggagagaagccttatgaatgtagtgaatgtagaaaaacatttaggcataggtcaggccttatgcagcatcagagaacacacaccagagtttaactctgtgggtaagagttgtacaattgtgaaatgcaaggagttcactgtaggggtgagactccacagaaaagaaaagtttcctgagagcagaacttctgtccttccctcccagttcggtactat

SEQ ID NO: 752 - DNA, 922 bp, Homo sapiens
aaaaattacccttccccactgtcccctctacaccccctctctatgctcttttcttcctagtaaagcattactttctttctagctcagtgatgccactggatgtgatgtcttctatctccttttgtgttgtcatctttattagagtcaactccttgagggcgaagacttaataaatacatacatttttaaaatacaaaataatatttcagttatatttctaaaaggtctatcatttaaagattaatattgaattaatattgaattaaatcccaaatatttttgggatttaaaaaaatttaacattgataagggaaccgggtggaaatatacaagaaataagactggccataaggtaatcatcatggaaacaggtaataggtatatacaggcccattgtgttctgctcctctacatgtttgaaattgcacacagaaggaaaaataattacaggaaaaatgttaatatttctgttaaggcatttgcaatacagtgcttgtgatctccaacatctctgctggaagaaagtcaggctggaaagaggaaagcactcacagcatgttgataaacagcctagcatgcagaacctttgctgaagacagtgactaacttcaacttcatgaactgagaatgctcttactgtgctgaaatctcgagtcaaagctggaggcaggaacattttccctgactaaaggaagtgaaaaatgccatctcagcatttcataacttttctgatccaggtgtgatctcactatttgtaaagcccagcccttcccaacctgcaagctcaccttccaggactgggcccagcccatgctctctcataatatataagctactgctggagcccgattccttgtcctgcttctcctgcctctcgcctccagcctccaacgctcgccacagccctctcatctcctggaac

SEQ ID NO: 753 - DNA, 920 bp, Homo sapiens
gctgtagtacaatcagatggggcttgtcctgggacatctgcccccagagagacctgtgctgaaagccagctttcccctacgttttatcagctacctcagctcaacacttgaatccttagaagcttcagagtaaaaagtactcagaattaggttggggcatcaggaataaaggcattagaaagaaggttctctaaggttctccacccatacatctcgtaaagccagtgtcccaggattctgatctgatacactccagtccttccatgttatggggctgcacttccttcccagcacaggcatgacttctctgctcatttttagaggggtgtccacagcaccgtgttaaataactgatcccagctataaagacttaattccaagaacctgtttaatctcttgtgatctgaggccttgggaaggaaggaagagctgaaggcacattctgagcacctactgcatgcagacacagtgctaaatgatccacatgtgtgatcttatttttaaatagactttatttttagagcagttttaggtatacagcaaaattgagctgaaggtacagaggtttcccatatacctcctgccccctcatacaagcacagcctccccccatcaacatcccccaccagagggatatgtttgtgatagtcaatgaacctacatagacacactgatcttatttaggccttagttccagctcccctagaagagtgacagttgccttgtggcctgaccctcctgcctggttttgctgcttggtacaaaggcctttagaaattccctggcgtggttgattggctaacaaggtaattgatgcagggccagtgggaggcagaacacagagtaccactgagtaatatctcctctgttcaacattgcagtggggatttctgaacccaaaacatcaaatctgtgtggga

SEQ ID NO: 754 - DNA, 915 bp, Homo sapiens
ttgctaatcactcaaaggatcacacagaactatatgattttaataagcatgtggttgtaattgttccattttttaataatccttaactttcctgtagatttttggaaacattttcagtaaacattgaagaatagggaccaagggtcattgtgggattttctttctgttttcagacgtgtcttaaagacattaacagagcacagacacatgggtatccagaaaggttgcaacccaagattatgttacgtaaagcagaatgtctggtggccctggggagactgcaggaggcaagccagaccatcagtgatcttgaaaggaacttcacagccacaccagccctagcagatgtcctccctcagactctgcagagaaacctccatcgtctgaaaatgaagatgcaagaaaaggacagtctcacagaaagcttcccagcagctctggccaaaacccttgaggatgcagcgctgagggaggagaatgaacaactttccaatgcctcatcatccatcggcttatgcgtagatcctttaaaaggtcgctgtctcgttgccacaaaagatattctcccaggagagctcctggtgcaggaggatgcttttgtgagtgttctcaacccaggagaactgccaccaccgcatcacggcctagacagcaaatgggacaccagagtcaccaatggggacctctattgtcaccgatgtttgaagcacactttggccacagttccgtgtgacggatgcagttatgccaagtattgcagccaggagtgtttgcagcaggcctgggagctctaccacaggacagaatgtcctctgggagggctgcttctcacactgggtgtcttttgccacattgccctgaggttgactcttttggtgggatttgaggatgttcgcaaaatcataacgaagcttt

SEQ ID NO: 755 - DNA, 914 bp, Homo sapiens
taaaagtgctactcttgggccagcatagtatcagaaattagctaattcatatggggcagtttaggctttaactaggaaatgatggttatcttaatgacaaaaaaggtactgacaaaagtccttttttgaacatgtgttcaaaagaaaaagagaaactatcaaactaataactgagtttgttgaacatcgagattgactgatctgagaggcttaaaactgattgccctgaaatagacttgcatgttttggatgatggctttgggtctcccagagcacttggtttcccttggtgctgattttttctctcaggattaaagcccctttatgtgatgttgttacagcagcttattgcaacttcattcagctgcttgaaaaagaagggagactgcctctaggttccatgtgttctttcagggatggtattttgatgttgcgtattctcttgaacatgtattcttccctgagaatttctgtgtgccgtggtagaagaaatacttgccagaaatcgccactcatggtatgcttttgtagtgtcgaagtgtcccctagaggtgacaaggcttgtgatagtgttgattctaacaagcatgaatctttcctttattttagcactgtgtgttacgtgccagtaatttgcagcttatcctttgtttctagctaggtaagctgggaaatagcctagtactttgtctatgtgtttatcttcaaaatgtcccaaatagccctgggaaaaaggtcgtgcagctcaatgggggctttcaacttacaattttctttgttttaggctccataaaaatacagactcaccagttcctgctttgatgtgacatgtgactccccagaatacaccttgcttctgtagaccagctccaacaggattccatggtagctgggatgttagggctcaggtaagt

SEQ ID NO: 756 - DNA, 902 bp, Homo sapiens
aggaggtaaattcgtccctgaaggtgagtgatcacttccctcaaagaagccagcatctctggcacatcctgggcctttctagattgttataaccccctcctcctgccattgttcacctaccgccacctctaggcttcaaagttcgagaaatgcgaggcaaactggccattggcatcacagccaactttgtgaatggacgcaccgtggaggagacacaggtgccggagatcagtggtgtagccaggatctacaaccagagcttcttccagagccttctcaaagccacaggtcagggaccctcttgctgaatttcccctccccctgcctgactgtggcctggctcctgcctctcccttccaaacttgtcctcactgcaaggaactccacacttttctgtttttttggtctcagcagcaaaggagaaggaacctgtcccctcagggattaagcaagcacagccctagttgatcacccagcatgaaaagtcctggaatctctcagagatgaacctgtgtatgggagttttgcttaagtggtacttcaagaaggtgcctctgtttactttggttttgcactgccatgcgaccaggtggtgcaggtctcccaaatgccacccccctccaagcttccctctttgctctaagtcctcaggcctcctgggcctgggacagatggttgtttgtgtcatcaggactcgtggggttctatgcgtggagcactcaccgcagcctaagctgggatcccagctcagaggtcaggccatgttgggatgtttagggaaggtgatgcattatcaggagacatatctactgtcccctgccctgtacccccaggcattgatctggagaacattgtgtactacaaggacgacacccactactttgtgatgacagccaagaagc

SEQ ID NO: 757 - DNA, 901 bp, Homo sapiens
gaacaggttttgccatcaagttcattcattcttggtttttaaatcccaacattaaaataagcaaacattgccacaacaaatgttttctcttgtgaagccataagagaacaggagaatccaagttaagcaaagatagcaaagcttgctcttgtcaattaaaagtgcaattggcctatctatttgaaagtgaaatctttattatggaaagtcagatttcaggaaaaaaatccataacataactgtttcagtaaattactcaggtcctattttcattaagttgtattatcataatagctgagagttcatttgccattgtacccaactcatctaaaattctgaatccccagtgactggattatatttgacttcaaaaagaacactatgtcctgctagccttatgtaatacaaagtaaatcaagtcactgagttttcacccatggatataacattccagttcattttaattacatataaaatgtatattaagtaaatatatatattagcctgccttttgatgaaggcaactgacttatgacaatagcatacagttaatattcgcctttgttcctgaaatatctttgttataaacatagtttctatactttgaaagccaaattcaccaagggaagcatcttctaaatcttactgctgtaagctcattttcctggactgttattatacgtaataagagacttgacttgacagctcctataataacacattctaaattttaaattcgatgtgtgttttttaccttaaactcttgtgatgacaaaaccattttcctcaaagctgattggttatgcaggtctacaacagtgcttaaatggaaccttgctgtgccaagctttctgacaaggaggaatctttttattttgagcctttttgatactgaacatga

SEQ ID NO: 758 - DNA, 900 bp, Homo sapiens
tttcttggtttgtgtctctgctgcaagtccaaggagctggggcaataccttgagtctgggttcttcgtccccagggacctgggggagccccagcaatgctcagggaaaggggagagcaaagtgtggggttggttctctctagtggtcagtgttggaactgcatccagctgactcaggctgacccaggagtcctcagcagaagtggaattcaggactgaatcgtgctcacaacccccacaatctattggctgtgcttggccccttttcccaacacacacattctgtctggtgggtggaggttaaacatgcggggaggaggaaagggataggatagagaatgggatgtggtcggtagggggtctcaaggactggctatcctgacatccttcgccgcgtgcaggttggccaccatggcctgcggccagagggcacccacgtgacccttaaagagaggacaagttgggtggtatctctggctgacactctgtgcacaaccctcacaacactggtgacggtgggaagggaaagatgacaagccagggggcatgatcccagcatgtgtgggaggagcttctaaattatccattagcacaagcccgtcagtggccccatgcataaatgtacacagaaacaggtggggtcaacagtgggagagaaggggccagggtataaaaagggcccacaagagaccagctcaaggatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagta

SEQ ID NO: 759 - DNA, 865 bp, Homo sapiens
agacaggacacagtagcagggacaagctgcataagggataaaaattgcttccctcctttgtttgggtgtgctgttgccattgtttcacctgtgaggagcaccctttctgcagaaagtaaaattgccttgctgaaaacactttttgtctaaatgctgatttttccttgcagtactgaggagcaagcattctgtttctaaataaacactttacttataacaagcccactttaaattatgtattagaacacattgagtccacttggaaaagccgattaagtcttgggctgctgtggttcctgagcatgagctttgttaagctttgtcaagtcttcctaaatactatgccaggagtttcttttgaccagatgattcctgcttattgctttgatcctggcttcatatctagatattatagatgtcctacactttttctgagaacatttgtgtgaattgaaagttggataaatcatatgtaaaatgcatgaggcatgtgtgtagggtaaaagttatagggggtggatgtcagtggcaggaagattcaaagttgagatgtttttcttcttagcaagctaagaatctaccttctataacttctagccattgcatcttctttttcatctagaggaatgtttcctccagagtgtatatgctgcaaagtggtagttctgaagatgtcaataaataccatgtaggaaaaaaaagtgggtgggttctggagttgaataaatgtgggaaaaaactggattcaagaaagataaacaggtttctttaatgctgggctcttggagatgctaatgtgtactgaacatagtaaatctctagggagtatggtttgttcctaaatctaatcgagctcccaaggaac

SEQ ID NO: 760 - DNA, 846 bp, Homo sapiens
cctccgtgtttgacttccttatgaagtagagaccaggtagtttggacactatgttctttcacaaaagggatttcattttgtgaaatatttgaaagcatcgaagtctagcatttcacgttttgcaagctggggaaaagcattcattccctgagaagcagcgttggtctgtcaggcttggagttccccgggttgtgggttttagggaagggaagggaagcgaggaaggacttgtgagaggaagtcctaaaggccacttaagggcacacagaggcccggagctggctttgctcagagcttgtagcggcgccacaatctctgtcctctcaggaacaggaactggcttgacgtccttttcctgccctatccaagcccctgttcttgcagcccttctgaagctcagcctggcaccggccccggcgccccagcccctggccaagcctctgctgtcatttctcctccctcctctcagtctgcagctgcgggacgggccgggctcctcagtttctgctgtgttgtgaccccacgaggcgctcagcacccagggaaggcgcgtgtgtccccgatgctggctcctccctgagccccgacggctctcgaggttctgagcctgtggcctgcacagggaacttcctctccgactgcatttatgcctctgtggatgtgaaggctatttctagaaatctcttcctttgcagaaacacccgaaaccctcctgccaggaagaccagggcctgggaagagggtcgctctccggccattctcccctcaccctcctcaccttcctcacatcctgtgccctgggggaccagcagctgcttccacccaggtgagagatggagggataga

SEQ ID NO: 761 - DNA, 831 bp, Homo sapiens
caaacaaacaaaatccccaaaaagcaaaagtgtctgcatggacttgtgcctaactactcacagtggctacttcttgggggaggtgaaaggggaccctgttaaagaatttttcttctgtattgtttttcttcaactgagtctgcattaattttatatttaatactctccccacccctgatgctcacaggttgctttagctggtggaaggagaacctgcacctctggttttggcaaagtgtagaaggggacaagggcactgctctgcacctgcacaggttcttgcctcctggggtcagtttaatgaatctcagtggtgtttcttgggaagaacacagtggacactcacttgccagtcagtagacaaatcactgaagtccatgtctggcagttctcaatgtcatggggactgtaaggttgtcatgtctcacagttccctgacttagaagattagtggtgacagacacttctcagctctgctcgggagagcagctctgtaatgcgcttgtggtttcagatgtgggcggcctgtgtgaacctgtcgtgcaaagctcacgtcaccaactgctgcagttatctcctgaatcaggctgagggtctttgctgtgcacccagagatagttgggtgacaaatcacctccaggttggggatgcctcagacttgtgatgggactgggcagatgcatctgggaaggtgagtctgtgctttgggcttcccaacctctcaagtcagcatgaaattcagaaggcagagagggacatgtggccctccaactcggggcccagggagccactgtggcatttgagagcgccaccctagctttacctcctctg

SEQ ID NO: 762 - DNA, 1411 bp, Homo sapiens
aatgtccttcatgcacccttagagccattcatttttcccaaatggggtgcatcccacattttaggatacgatttccatcgtttctaggttaatttggactcatcctttagttcgcagattaaaaaataaatccttcagagaagccttccaagactactgcccagctaaattactttccccttacaataggaggcactaaatacacctttattgaaagcctattcccccatactacttcatcgtattcattacattggggcacggtgcatttatgttgtcagatctcctattaactagagaataaattctgagcgtactgtgcctctctgtacacttctgtaacttccagatctttgcacaatgaatacaaatgatgtaaggaatgacaccttcacagttcctgcaaccccaggatggtttagccccaccttccccctcagccaatgacaggcgcccccctctgccgctccggtcgcggacggtgggcggggccacgccgtgacgcatccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggtgagttcggggtcccgagtcctcgccggacctgcggtttgcggggaaaggcctcgagaccagagctgcacgggccttggctccagaggctctcgggatgtcagcaggccctgggctacagagggtctccggggccccagacgcaaatccgcgataccctcaggtccagcttaggcggctcgccctccgggttcctcggggaacggaagaggctaggccgccattgtttacaattcggatggctccgccctgcgaggcttcctgactaggttcctctggagctggagagggaccaaggaatgacagctcccagcgaggggctccggttcctcccgaagcacctcttaaggtgccatcatttagttctaggtggctcaagtaatatttttatcccctagcacgggatttgccaaaactacagagtgtgtggcaaagctggggttttagcggaggcttgtctgcagttcaggtgcaagggaaagaagcccttgtggattgttattcaaaattggaaaccagggcctgaatattttgggactgctgtaagtcatttatccgaggataatcaccccagcattcctctcttcgagaacgattgtgacagtgaagtgaaggtttaatcaccttgtaaactgtaaacattttaaagagaaaattatagggcctataaaagaatatgctgagttccctcatttacccacttcagaggagcgtgattccttgattcctcattc

SEQ ID NO: 763 - DNA, 1319 bp, Homo sapiens
aactcaaagtgtagggagaggggtgcttccgggtcctaggccgatttaaatatgttctgattagcaattggttaagttgttatcaatagaatgtccaggttgtgataaggggttgtggagaccaaagttttattatgcagatgaagcctccaagtaacaggcttcagaaagaatagattgtaaatgtttctcatcagacttaaggtcggccttgatgttaatgacccaccctcacccccacctccttccatcatggcctgaacaagtttttcaggttaactttggaaagcccttggcagagaggaagggtctattcagatggtttggtgttgggttcagaattttattttttggtttacaccattatatccgatcatatataaatacaaacaaaaacttcaccaaatattactttctttttctaatggtgtgtgtgttttgggacaggatctctgtccctcagactggagtgcagtggtgatttctgctcactgcagcctcaaactcccagctcaagcgatcctcccacttcagccttccgagtagctggaaccacaggcacccacatgatgcccagctaatttttgtatttttggtagagatggggtcgcattagattgcccaggctggtctcgacctccctggctcacatgatcctcccgccgcggcctccgagcggctgggatcaggcgttaatcaccgcgcccgggctttatatttcgttttgaaaatgctgagatggacgcaaagggctgagtgctcagtgtcccccagtcaccctcagttgcagcttccgtccaaagaaggaatcgccctctccctgctggggccactaacagcactaacacggtccgaatggcatcggcaaagctcgggaacggcgacagatgggaagacgcgtgggagcctgggggatctcgggagagccgcgcaaactcgcggcggacgcagccagcacccgcagccagcacccgcacactcccacccataccccggcagcccgccaagactctctggcccgcacctctatggtaggaaacccagaaaacaggaagtggcctcgagagggggaagggaggggcggggcctccgccaccacctcagctgcggaccgaggcgagatggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtac

SEQ ID NO: 764 - DNA, 1190 bp, Homo sapiens
gtgaaggtttggctccagatgcggcccacctgggcctcggcaggtgggggctgcctttagaacactctgtgcttttctctgagtacacaatgggagccgctggagggttttgagcaggggagtgccaggatcagtcctgggtgttaccagcctctctgctgccagtctgttgaggctacgtcatagccagggagaaagagctgtggcagtcatccagtgagaggtgggagagtggctggcatcccgatatgctgtgaaggctgagcaggcaggattggatgtggggtgtgtgtgtgtgtgtgtgtgtgtgtgtgtgtgtgtgtgtgagagagagagagagagagagagagagagagagagagagagagagagagagagaacgagaaactccaaggcttgggcctgagcaagtgaacaatagagctgtcatcacctgagactggggaagctgcagaggatgaggctgaggagggatcagaattcagttatggtgaccaatgaagggttttgaatagagggacacagggatgcactggctcaggagtttggtcatcacgttggccgccagagggagaacagaggctgggacagggaaccctgtggagtgtcctctctgtggctacagggagcaacggtcagatctgtggctggtttgaaagtagatccattttgctaaaggtggtatcacagattttggagactacagaatccaggccaggagagcaaagaacgacagaggtcccattcacagcagcgggccatcccgggctcctactagcttttgctgcttgggcctatggggatggtattctagaactttccatcttccaagacatactggaaatgtggatttttataggaaatcttctacttttcaaatattaagaatgacttcaaattaaaagtaataatcattttggggctgcagtaaaacttgttggtggagcaggcctcaggcttcaggttggtgagctgtcctccagtgggggtttctcttccaggctagggccttgtcctcccctgctctcccccactcccagggctggccacccagaatgtgcaggccactcatctctgtgactcgtagaacctgagaatgttggtgatggaaggggtgttcccctagttcccacatgcaaaaagtggggcctggagatggggctgtcttttttctccaaacacttgcccat

SEQ ID NO: 765 - DNA, 1173 bp, Homo sapiens
ttctcattttgtggttttggttgttcttaataccttcataataatttaatttttaaaacataaacatatcttgtattacttgtattcttttataattttatctaaattgctgttgagtatttttaggttcacagaaaattgagcagatagtacagagttcccatatatgcagttcctactcacagtttacttattcatattttgcattagtgtagtacatataattgatgaactaatagtggtatgttatttttaactaaatttatagttgaaattcgagttcgctctttatgttctacagttgtgtgggttttgacaaatgcgcaattttatgtattccaccatgacaggatcacacagaagagtttactgccctaagaaattctattaatcctgcatcccttcctaatccccagacctctggtaaccactgttctttgtactgtctccatagttgtgcctttttcagaatgtcatatagttgtaatcataagatctagccttttagattggcttctttcatttaataatatacatttaagttttgtccatgtgttttcatggcttggtggctgcttccttttttatcgctgaaaaatattccattgtatgaacatgtaagtgtttattcattcaccttttgaagaacatcttgattgcttcctttttttggcatttatgaatagatctgctataaacattcacatacagatttttattcccagttttgtttcactgatctatttgtttattctttcgtgagtaccacattgtcttaattgtcgcagcattatagtcaggtggtcaagtcatatagtgtcagtcctctgactttgttcttcaatgttgtgctggctatgctacgtattttgcctttccatagaaacttaatcatttgattgatagccacaaaataacttgctggggttttggttggaacaatgtgtcctctgttctgtttctctttgtatgttacatgaagagggttgagaacggtgaaatactatgtgcactactttgctaaatgagtttataaagcagtgcaaatggtaatctttgggtacctggctatatttttatcagtataaattctgatttttcaaatatttcgatgtagacagggaaatcattcaaaactgtggattccattccagcagatgtagctaaaatggg

SEQ ID NO: 766 - DNA, 1073 bp, Homo sapiens
ttcagatcacagctgtttacccagagaagggcagagccggtgctgctcgaaggcgggggaaagggcctctcatggccaaggacaaggctgggccccgaggcagggtatgggccgagggtcctctctgttctgggggcagaaaggaccaagcaccgtgggccacgcctggcatggagatgtgatgaggacctgccccaagcctcctccaccccctgcccttgggccggggagacattacagctgttgccgtggctgttgggctctgagccttcacctgcccaccccacagggacttccgagccccaggggtcactacaggaagtcatttctgagcaagtgacacccacagccctaagcccagcagacagacctcccaccagctcccttcctccagggagcaaatgccttcagaccgagatctgccccggggacccccgtgcctccctgccaggctgcgtgcactgggccctgctccagggaaggagacacaggagatcacgtcacatgcaaacaggctttgtttgggctggctcagcctggtgccagagccccagtgacgtgtgggtgggacttggccctggggccatggatggcacagggcagggggattatctcccactcaggccaagcaggggccggatctggagaagcagaggttttagaaagcccactgcttcctggtgacagatggggcttccagctgtccccagccccctctgcctatcccagctgtccaccacagccaggaggccaggcagccatgggtaatctcgccctgcccggtgcactggccatacggggtaagaggcctggcctcaggtcccctgcagccagcttgacagcgtcacctcgggcccccactgtcaggggatctgggcacccaccaaggcccctctcttctgagcctctgcccactgggctctgtaatgtggactggcccctgctccccccacatcccccgccggctgctggtggctgggcagggctctgagaatcgctcccagcctgggaagaagcctcccacgccagggccccggacccaggagaggccatggaaagcctgaaccccagct

SEQ ID NO: 767 - DNA, 1018 bp, Homo sapiens
gtaaatgacatggtttccccaaattaatcatttgccagatcttgcatctgttattttgtaaaatcttaatttttgtacaaaaataaaattaaaggaaaaaattaaacaagaccatagtgtgcagctcagtatattacaagctgtttgtttttattcactcaactcaataatgtacgtagctagcattttaactgtggaatatgttagttttcatatgatttgatcaatatcccattttcttgacctaagtgaataaaaataaacagcttgcaacatatacagtttcagattttggttttgttttggtggttagagaagctggcataaaaatatagcctgaaatgactataaattccacaaccaatttgatcatttaacttaatctgtgtagtaattttatttattttttaaattggcaacacatctcatggatggaaaatcagaagatacaaaagcatgtttggtaaaagactcttttttacctctatacccggttccccatttccacatgcctcaggcaatgttaatgttgattcatctaaactgttgaactaagatatatttcagctaaaacctgattttattttgatgctttatcaaatgacttaaaggaacagggtatgagtatgagtccttgacaaacctacatgaatatccagggaggtgtcttaaatgaaacgcacttaggatgacaaaatacacatccaaaagtagaattccatttttattgtaaagaagagtgctgaaagcgagatctcactatgaaaccataaatcaccccatatactcttttggacttctctgtttctgggtttccagaacagactgttctcttctgactgttgcatatgtattgaagcctggcactatgaatctcttatgatgtaagattgaatttcccattgccattttttcagataacagcccgccgtcagtggaaacatatttatgatgaattaggcggtaatcctgggagcaccagcgctgccacttgtacccgcagacattatgaaaggta

SEQ ID NO: 768 - DNA, 1012 bp, Homo sapiens
ctctcctcacctttccaactcaagatttctaggccattctaatcacatccaaagttaaaccaccccctgcacagggagaggtggaattcagttatgaaaaatctagtctgactaaacctcactttgggtgatgtgggggcagtcagcctaaaacaaaagcagatcctttcccttgtcctccagggcagagggtgtgattttctccccttctctgctcacccttctctctactccccctgtgcacgtgtgcgtacacacacaggcatacagatttctctcagctctacatcctctatctagaggtcgagatttggtttcaaacattcttcccaaataattctgtttacacaaccagttatcagactttcaaaaattttccttaaaaaatcaaaaagaaaaaagtcattgtattttcgtgtttgggatatgcattgctcctctgaaggctggacagattctaggagattccctttgcttatattttaatattatcttcattaattttctctagtggaagcaagtctggcaattcaatcacatctgcaagagagacatataattgactaactgtcatttcaaatgcagttgtattgtttctcatgcagtatttgttctaaagcctttcaaatctttttttttaagttttagagtatcttttttatgttttattttattgggataagaagacaacataagatctaccatcttagcaaatttttaagtgtacaatacagtcttgttgactataggtgcaatgctgtagagcagatctgagagaaaggcagagcatcttattacctctttatggttagattgagctttggaaagaacagaatgtgccactcagagttcccctttccagtagagattcacccctctccatttcatgcagttctcttgggacggtcagtcgtggagctttacctgggcactggcacctgggatgggaatgtgaccaaggattggacaacctgagtatttcatgccctggtagcatgattggttcatgaca

SEQ ID NO: 769 - DNA, 946 bp, Homo sapiens
actggtgcactggaagagagttcagtgaaagctacatctgtcctcagcccaaacgataagccacggtgcctgagccatgccctcatccagcatgacagtgagctttctagccgaagtctgtggtcccaagtcaacgatgagggactcatagcagaaagatctgaggccttgcacatacgcacgttttaaaaacaatgaaacaatgaataaaagttctgtagtgacggccagtagtgacagtccatgaggggacatcctggtactttcccctgtttcatacttttcctgttactataaccatagtctctaccttctctagaaagatgactaaaacatgtttaggacacctgggcagctgtactgagataccagcatgtggcaatccagccattatgggagctgcactactaaagcacaggtgcgtcctgcccattcttaagcccaattaggaggcaggggtctttgatggtggaacagagtggaccctgctgtgcatgatgtacccaggctgtgtcaactgcatttgtggcttgtcccatgaccctttggcccatgctgctgtgagggtggctgttggtcagggttgagaggccagagaggagtgggcaggcagcttcaggccccacgttggtgttggcctgggcacctgttggatcaacacaataactgtaccctggagttcctggaagctgccttctgctcagccaggcctgcttgtgggcggagcccatgccagctacatgtgtcaaggaagccacagcttggctagtgagcaatgcaattctgggaatgttcaggctctctctgttctttcctctcttgcaaaccatgggcacccttgggtcccttggggtcactatgttacacctgctttttatctgtctgggcaagagctgctcaagccacaccttgtgacactgaggtaagagcagaacgttgcagagtg

SEQ ID NO: 770 - DNA, 923 bp, Homo sapiens
gagctcatcaccattgccagccaatctgggcttcagggttttaccctttcagccttctcagaaagcagctgtctgccttccccatcgcagccttgcaatttattgccattaccattaggtagcagtgacattccagagcttttcctgaaagggactcctgaatataagctctggcagagcgagggggtgggggagggagggggaccttgcagagagatggggaggagggggtgagaggtgtatgggctctgccctgctgggtgtatctgctgcaggacacagagttccatcaaatggaccacacagtgtccccatcttaggaggtgaaacctcttggtcaaaataactacccttagcaaattgaactgttcacccacatcagcaaatagtcttagagtagccatttggaaaaagagacatttttgtcacataagaaatatattttcctaattcttccctgcattttccccagttcaattctgttctaacctcagacacagaataacattagggtcaggttggtgtcccaaagtgcctgactcctccctggaattctcccacctgtccaccagggaagactgagaatcctccttttacttgggagccctgtgatggacacctccccgggcttgggctctgcaggcccacacagaggacagagagatgtgccgaggtgcctgcgttatgggccctcttagttggactttcctctgctgctgcaggccctcagccccggcagtggcagcatggtgctccagatctcctcccagcagctagctgctccaccccaccacccttcttgtctgtgactccttggagaggatccaggagccatgcagcaagaagcctgcagacctgtcacctcccacactggagaggctcccgtgaagcccggcctcagcagtcatttcccataccatgat

SEQ ID NO: 771 - DNA, 813 bp, Homo sapiens
taaggtcagtcattcatcctccccccaccacatcaggaccattttggtgcccccactcgttgcctcccctgctcaccaccaccctcacccaagccttcttgacagctccctgaccttcttccctttcagcctggagcagctgtgttctctgtcctacttctaaccaaaacctactctcaggagaagacttggtacctttctttatacttgagaggacattctgtccttttatcttctagttattctatcatcagtcctttccttattatgaattagcaaatacaaaatctttgttccccagggtaaagaaaagaattttaagaagtggtttttcttagccccctcagcaccctagtctatttctaacaccaaaaagacaaaacaagggagaggaaaggagaaggagatggaggaccagttgcaggagagaaaggagaaaaaaatccacagtgggggtggcggaagatctatgacttctaacaacccattctgtggttttcaaagagcgaatataataacagctatgaaagtgtgagcaatgacgaaactggagagatagggttttaacaagatgcaaggacaatctgaggactgagagccatttcaacgtgagcccccagtctgagaacaagaaagaagaacttctgtctcgaggtaaaaaggcctgctggggacctggggtccaggtgaagggatgggatggttgacagaactgctcaggtgaggacaggcttctcatgaggtccctgagaaacttgccttttggagggaaatgtcctctgccctctggagcctggggagaaggttatttct

SEQ ID NO: 772 - DNA, 800 bp, Homo sapiens
cctgcctcagtttccctcccaacacctatatgtcttgttggtatacatgttgtattttcacaacgaaaatgcatgagaaaaaggacacagatggcttatgtgtactgatgtgtagcattctctaagatctgacatcacagagctggacagcacagctgtgcacgcacccccctggctgggaggtggcacatccacacatgagggaaaaacactgccaggacatctcagggcactctcaggaaatgaggaagctgctggagaagtttctagccttgggggaggtcaggacgcagagccatctcctggagcaaagttccctcctcctctctccctcctcctctctccctcctgcagcccttccttccgacccctggccctttctctccaaccttcccctcccctcctccatttccctcctctttctactttcagagaacacagggttcctgcaggaaatggggcagtttcaccttcctgaggaggggcctgggaggggcagcaggtggccgggtagggccagcccagctgtgagcctggcgtgggagctgcctaggccgggccctgccagggagcaagtctgcatcgcagaggccagggtgagtgggctggggagtcggtgcgccagggtactggggtgcccacctggggtggtgcaggcccggggaccccagggcaccactgtgggtggaagctgggaccaggcgtgcggggcaggggacgcggcggcttcctgggattctaggaggctgaggccaggtgtgtgcggcaggggacggggcggcttcctgggattctaggag

SEQ ID NO: 773 - DNA, 2484 bp, Homo sapiens
ggatcattttctcatttagcctgacatcaagagtatttatttggctttctataccattagtttaaattagaacactctatttccatccactagagtagaatagctatgtgttttccctttaaaagataaattaactctgtaagcattaatactttaaaaaatgactagtggtttttcaaatattttagttctaccaaactgatgaatagataaacatgagcagatagatctggatttaaatcttgattccacaatttaccagctctgtgaccatgggcaagctccttaatctttcaaagcctgttttctcattagtaaaattaggataataatagttctttatagggtaatcatcagaagttaaaaatgtacatatgagaaattcagcacagagtctggcacaaagcgattaacaaatatttgctgttattcattcttatcatcattattataaaatgttgggttgagctgggcatgacggtgcatgcctgtaataccagctatttgagaggctgaagcaggaggatttcttgagctcaggagtttgaggctgcagcaagctatgatcgcaccactgcactccagcctgggagacagggtgagatctcttgtctataaaaagaaaattaaaatgttgggttggcaaaagggacatagaaatgagtaagatgctgtccttgtcctcaagaagctcagctctgtggtaggagagacaagacaggtctgcaaacatcatcacaaaacaatgtgataaggcaacagagggacagagaaagcacagaggagggagggatcatttccataggaaagtttcatggaaggcttgcaagaggatgtgaaaattacattgatttttaaagaacgaggaggaattttttaggtagcccaagtgggacaggacatagctggtcctggagaacatgtgtaaaggcacggagaaaggaaactgcatggtgttttgggaggaactataattagtaatgtttggtcagatcatgaggttttggtgggggtgggtaagatggaggtggtaagatagaagattctagaggaagtcaaggcaaggaccagattttgaagtgttttgcatgcggagctgaagagcttgaatttagcaccagcaatagggtgtcagtaaagagttttataagagagatgtgatcagatttgcattttagaaaaatcactttggcaggtttgtgaatgatggaccagaaatgtgtgatggtggagacttggaagccaattaggaggcagtagtccaggtgagaaataatgccccgaacaagggcaaatggcattaggaatggaggggagcaagctgaactcaagagacccttgggaggtaagatgaaaaggatggggaggagggaacttgttgggatctgtatctaagggtacccgaccccttggtctcattccactgttccacaggggttggtgacagtgtgtgggagacaggggtggacagaagtgcgttaaccaagatacagactagagaaggaagcgtcagttcttaggacaggggtcagtttgtagtgtgggaaagaggaggtgagaaagggtagtgaatttcacctggcccttgttgagtatgtgatgcctgtgttcgccatgtgaacagcagaaagcagcaaatataaggatcgagagcacggggtagagagagggctggcgatggacaccatctttagggtaattgcgaaattaggggaagggctgaaatacggaaggctcgccgaagatctctaggtagttaataactatcaaaatgtcacttctttggccttcacttttattatgtaaaagtactcagatcaggccgaatacaattttattctctttatccaatgccggaggctattgtcgaagccacggcctgccatttcataccctttgcaataggtggcgctgacgcctggcagggagaaggcggcagcacatgctgggctcgggggcgatgggcttgtgcgcggacctggcgacgctctagccccgagccgcgtattcgtggccgggtcctccctgggaacagggtgaaggccgagaacctctggcctcaggaagcgcatgcgcaaccggttctccgaaacatggagtcctgtaggcaaggtcttacctgaatcaggtaagaggcgggcggggaaggagtggagcctccccgtgcaccctcgcagcccgctccaggagtgggactagccctccttgggggtgtggctcgtgtgcgtgggccacaccagtcctaggggcaggtaagtgcgcgtggcccaggaggcgtgaggctgtgctggcgaggggagggctcccggggcgcgtgggtgcccatacgaggtgcgccgccgccggtccagaagagggccacgtgggcgagagcctcggtcgtcgcctcccagcacctcggggtcgtagagaacacaaaagtcacacaaccctcgccgaggcttgacccccgcgacagagtttagtcattccgttagctggctc

SEQ ID NO: 774 - DNA, 2269 bp, Homo sapiens
tttcttactgggaggaccaggatcatcatcctattttgcatagaaggttcagtttgttctttcccttaaaataggaagataagggcattatccccctaagtctcgtatgatattccccattctgagtccagaatacctagaaatttggaatttggctattgccgtgtctggactgtgagtatgggaaggggaagcttttctgtctgttgtccccactaccgcccctcacatccgtgattctgaaccccatgataaatgccctttgaacctttttcctccttttgatgccgaatccccttttatgggactccgccagcacgggtgcatttaaccttcctgagcttgcccacctgacgcatgcagccaagaagctttgaaagatggagtgccctggctgagggttccaggtctcagcaaggccacgaggtggtgactgcctcccagaactctgttgggccaccctccgtcctggagacccccaaaacctccatagcaccaactctgcccattcacacacacagtcagccctccctcccgagtccaccgcgggcagagggccagccaccatgcctcccatagccgccatccctgggaaggagccctgaccccgtccttacacccctctacactcactgcctgtggggagagctgctcgctgtcacaagcatccagggggctgggtcgaggggccccctgcatggtgggggaccatgttgtcgtgcatggaatgaaactggccacacataacagatatggtggcgctctggtcggatctaggggagtctgtcctacaggatgaggcttgaactgtcctgagtgaccagacacccagcctctgcttcgagtgctcagttatgattattgtcctgatttagttaactgttcttcaggggctccaggaggacgagtgtgtatcctcccattgctctgtgcagcctctaacctctagagtctaggggtctggggagaagttgggaagtctggccagtggggccggtgcctggtgacctcgggaggtgggatatcatcatcttcagaactgtagttgttactgggataccagctctgggagaccacaggtgcagtcagcacagcaggaccttagacaaggcacccagccccagtttccccacctgggaagggggctacttgtggctagaagcagcccggactcctgagcaagactagaccaagaggccggtatgtggacacccccgcgtgggcacccccacggggacaccctggccaccgccgcgcggacaccctcacgaggacaccccggccgcgcggacacctaccgcggggacgccccgaccccatcctacctgctgcgccccgcgccgcgccccgcaccccgcccgccacggcctgcgtccgccaccggaagcgccctcctaatccccgcagcgccaccgccattgccgccatcgtcgtggggcttctggggcagctagggctgcccgccgcgctgcctgcgccggaccggggcgggtccagtcccgggcgggccgtcgcgggagaggtgagagcgctggctagaccggggccgaatgcggccggattcggggcgggggccttcagacctagggtggaacactgggatagggtgtggggaattcggaccgctgtgaagtgatctgacgttgggtgggagtctccggacttggggtggggaatctggatgggaactggggaattcggaccttgggtggggatctttggaccggggtggggtccccagactccttgtggaaagctgaggttgaagatctgtgctgtgatgaggggctccagatagcggtgagagatcccgcttcaagactgggttgggggtccagaccaggaggataagcctctccctggagtagggcttgacctggtgagggtgtggtagagtcacaggggagggtcccacttggtccttgggctgggatcagactctcagagctggagagttgcaggaggcctgggggagggtctgtggagccccagactcagagggccttggtgacttctccaacaggctccctgttggaggccttggggtaccccagggcctttccctgcaagagagaggctgctccaccaggaaggggcccaggactccccagggtcggggggatgtgtggtgtgcaggaccacgtgggaatgttagagaaaggggaagtcactccgggcctgccctgctaacagacctgctttttggatttttccagccagggatttttgtgtcctgttgctttttattgtttaaagtgaccctccaagc

SEQ ID NO: 775 - DNA, 2228 bp, Homo sapiens
ttccctcaaacagagagttccaggcaggatgaatctgtgctctgatccctgaggcatttaatatgttcttattattagaagctcagatgcaaagagctctcttagcttttaatgttatgaaaaaaatcaggtcttcattagattccccaatccacctcttgatggggctagtagcctttccttaatgatagggtgtttctagagagatatatctggtcaaggtggcctggtactcctccttctccccacagcctcccagacaaggaggagtagctgccttttagtgatcatgtaccctgaatataagtgtatttaaaagaattttatacacatatatttagtgtcaatctgtatatttagtagcactaacacttctcttcattttcaatgaaaaatatagagtttataatattttcttcccacttccccatggatggtctagtcatgcctctcattttggaaagtactgtttctgaaacattaggcaatatattcccaacctggctagtttacagcaatcacctgtggatgctaattaaaacgcaaatcccactgtcacatgcattactccatttgatcataatggaaagtatgttctgtcccatttgccatagtcctcacctatccctgttgtattttatcgggtccaactcaaccatttaaggtatttgccagctcttgtatgcatttaggttttgtttctttgttttttagctcatgaaattaggtacaaagtcagagaggggtctggcatataaaacctcagcagaaataaagaggttttgttgtttggtaagaacataccttgggttggttgggcacggtggctcgtgcctgtaatcccaacactttgggaggccaaggcaggctgatcacttgaagttgggagttcaagaccagcctggccaacatggtgaaatcccgtctctactgaaaatacaaaaattaaccaggcatggtggtgtgtgcctgtagtcccaggaatcacttgaacccaggaggcggaggttgcagtgagctgagatctcaccactgcacactgcactccagcctgggcaatggaatgagattccatcccaaaaaataaaaaaataaaaaaataaagaacataccttgggttgatccacttaggaacctcagataataacatctgccacgtatagagcaattgctatgtcccaggcactctactagacacttcatacagtttagaaaatcagatgggtgtagatcaaggcaggagcaggaaccaaaaagaaaggcataaacataagaaaaaaaatggaaggggtggaaacagagtacaataacatgagtaatttgatgggggctattatgaactgagaaatgaactttgaaaagtatcttggggccaaatcatgtagactcttgagtgatgtgttaaggaatgctatgagtgctgagagggcatcagaagtccttgagagcctccagagaaaggctcttaaaaatgcagcgcaatctccagtgacagaagatactgctagaaatctgctagaaaaaaaacaaaaaaggcatgtatagaggaattatgagggaaagataccaagtcacggtttattcttcaaaatggaggtggcttgttgggaaggtggaagctcatttggccagagtggaaatggaattgggagaaatcgatgaccaaatgtaaacacttggtgcctgatatagcttgacaccaagttagccccaagtgaaataccctggcaatattaatgtgtcttttcccgatattcctcaggtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcagattagtggcacctgc

SEQ ID NO: 776 - DNA, 1943 bp, Homo sapiens
tatccctgggcactgattctttagaagagaaggtgggggaggaagcagccttaggggggcagtagggccggccctgagtgatctagagcctggctgggggagggcgtgtttctggccagagtgactaaggctcctcctgcaccaccctctcaaccagggcccccaaaagaagcatctggagaaggaaacgccggagacctcgggagacttgtaggctgtgtggggtggatgaaccctgaagcgcaccgcactgtctgccccaatgtctaacaaaggccggaggcgactcttcctgcgaggtctcagagcgctgtgtaaccgcccaaggggttcaccttgcctgctgcctagacaaagccgattcattaagacaggggaattgcaatagagaaagagtaattcacacagagctggctgtgcgggagaccggagttttatgttttattattactcaaatcgatctctttgagcatttgcggagcagaggttttttttttttttttttttgagagagtcttgatcttgtcgcccaggctgctggagtgccggggagcagagtttttaaggataacttggcgggtggggagagccagtgagccaggagagccgattggtcagggaggaaatcacagggagtcagctgtcttcttgcgctgagtcagctcctgggtggtggccacaagatcagatgagccagtttatcaatctggttggtgccagcagatccatcaagttgcagggtcggcaaaatatctcaagcactgatcttaggggcagcttagggagggtcagaatcttgtagcctccagatgcacgactcctaaaccataattcccaatattgtggctaatgttagtcctaaaaatgcaatctagtccccaggcaaggaggtggtctgctttgggaaagggctgttactgtctttgttttaaactataaactggctgggcgcggtggctcacgcctgtaatcccagcactttgggaggccaagatgggcggatcacctgaggtcgggagttcaagaccagcctggccaacatcgagaaacctcgtctctattaaaaatacaaaattagctgggcgtggtggcgcatgattgtaatcccatctactcgggaggctgaggcaggagaattgcttgaaccagcgagttggaggttgcagtgagctgagatcgcgctactgcactccagcctggaaacagagtaagactccgtctcaaaagaaagaaagaaagaaagaaaaaaacaaaaaactataaactgagtttctcccaaagttatttcaacctaccagcagggatgaataaggacagcttggaggttagaagcaagatagagtcggctgagttagatctctttcactgtttcagtcatcattttgcaaaggcggtttcacctgggcgcggaaaggctgcatgacctccggcagctccgggcttagtaccagggactggactggggggacacgaccctacggattcgcgccgtcgcccacctggccaggccccatgtgcgcccctagccaccagggcgcgaggggcggcaggggcggggccttggggaagcggcctaggggtggtccctgggagtttccatgggcggggcctgctggggagatgcgattggactggcaccggggggcggggccttggggaagtggcccaggagtggtcccaaggagtcaacgtgggcggggccagctgggaagatcgtattggaccagccctgaggaggggcggggcctcccggaggcggaagccgggattcgccctccggggagcgattggtcctcgggaggggcggggaggtggacgcgggtaccggcggtcgtcgggtcggcagcctttggtcagttggcagcggcaagcgcgctgcggttccggtggcgccatgtcgttctgcagcttcttcgggggcgaggttttccagaatcactttg

SEQ ID NO: 777 - DNA, 1799 bp, Homo sapiens
actgaggtttcctctccctcatccctcatcacgcctggcccgcaccgtggttggtaaagaaggatcaagaacacctttaatccgacgcgaaggctttgagggatacatagaaagggagccacgtcgttgagctgctctggattgaagaggaggacgcgggaacgccctcctccacctcactcctctggtgcgctgagcccctcaaacgcccccagtcctcctccccgtggcacgcgaggaagattctcagtgtccttacagagtcatcttccctgagccccgaaagtgttggaaaacatttagccccttctttgggaaactcagtttctgatcagaatttttgttttacccctggggttgacagtctccccagaggtctcatttcatactgtcttttcggatctgatctcttggtaaacaggcggggatgttttaccctacagagccgatgtatgtgtgagttcgctgtgagttctttgagtgtctcaaacttgtggggccttttctcggttgcactgggattgaagagggaagagggccaaggtgtttccgggcaagcggcggggttaagtggagatgcgactcgtgaggctctcctttccgatccccctttgggacaccctctgcctacctctaccctggagccagggagacccaagtcttggtgaccggatgggcccgctctcagttggcctgggctctgggaactggtggactctccctgggggcttcgggctgggagtgggttcggtttgtgtggcttcggctctaacaaagagatccgctgtaatccgccgaatctgttatcaatttctctgctgcttgagccccgccccacgcgccccgctcgccgcgaagcttggaaagtgcacgcggccagcaccaatctgggccgctgactcggaaacatgtcgcagcgtgtgtgtctatgcacgcgtgtgagtgtgtaaatgtgcacgagtgtgaatgtgtatgatgtgtgtgcacgcggcatcggctgcccttggggagagttgactttgcagcctgggctgcgcgagaagcagactttgcagcccactccctcccctggaggaaatttgacacttagggcgggggtggggagatagccggagccttctctctcctagctggggaaaccccagatttccattctccaggatgcgccccccagctttgcagcgttttggggacaactgggccttgggtgtggagccctgcttagcaggcgctggggaccacataagcatttcctctttgagaagccccgaagcgtccaggccaaaggggcggctcacggagaaaaaccttggcacgcccctgagccccatagctttaccagggctgcctaggtcccctctgccccttttacggcacaggttccaagccaggctcttccaccgccttaaagaggctcacctttcttttcttttctgtggaaggggctccttcaggggctatgggcgatgcagtgcggcagggttagacttacgtgtaaggggatttttaaaacccgctcctcccacccgcacccgccacctactcgctccgccgccgcctacaggtggagaagtcaccagtggggaggaacggcagcggaagcttccaaggccaactcctacccctgaaattcttcaggaagggaaccttcgccgctgggggcctctttgccctggaatcgatgcgcccagctgcggctcggaagccagcgcctctggccccgtctggactcatctgcaagggctctggcctcgccccgcacccccacctttcggcactgaccgaaccaagtctgagtt

SEQ ID NO: 778 - DNA, 1500 bp, Homo sapiens
cgacaaatcaacagaacaaagaaaattacctaaacagcaaggacatagggaggaacttcttggcacagaactttccaaacactttttcctgaagggatacaagaagcaagaaaggtactctttcactaggaccttctctgagctgtcctcaggatgcttttgggactatttttcttacccagagaatggagaaaccctgcagggaattcccaagctgtagttataaacagaagttctccttctgctaggtagcattcaaagatcttaatcttctgggtttccgttttctcgaatgaaaaatgcaggtccgagcagttaactggctggggcaccattagcaagtcacttagcatctctggggccagtctgcaaagcgagggggcagccttaatgtgcctccagcctgaagtcctagaatgagcgcccggtgtcccaagctggggcgcgcaccccagatcggagggcgccgatgtacagacagcaaactcacccagtctagtgcatgccttcttaaacatcacgagactctaagaaaaggaaactgaaaacgggaaagtccctctctctaacctggcactgcgtcgctggcttggagacaggtgacggtccctgcgggccttgtcctgattggctgggcacgcgtttaatataagtggaggcgtcgcgctggcgggcattcctgaagctgacagcattcgggccgagatgtctcgctccgtggccttagctgtgctcgcgctactctctctttctggcctggaggctatccagcgtgagtctctcctaccctcccgctctggtccttcctctcccgctctgcaccctctgtggccctcgctgtgctctctcgctccgtgacttcccttctccaagttctccttggtggcccgccgtggggctagtccagggctggatctcggggaagcggcggggtggcctgggagtggggaagggggtgcgcacccgggacgcgcgctacttgcccctttcggcggggagcaggggagacctttggcctacggcgacgggagggtcgggacaaagtttagggcgtcgataagcgtcagagcgccgaggttgggggagggtttctcttccgctctttcgcggggcctctggctcccccagcgcagctggagtgggggacgggtaggctcgtcccaaaggcgcggcgctgaggtttgtgaacgcgtggaggggcgcttggggtctgggggaggcgtcgcccgggtaagcctgtctgctgcggctctgcttcccttagactggagagctgtggacttcgtctaggcgcccgctaagttcgcatgtcctagcacctctgggtctatgtggggccacaccgtggggaggaaacagcacgcgacgtttgtagaatgcttggctgtgatacaaagcggtttcgaataattaacttatttgttcccatcacatgtcacttttaaaaaattataagaactacccgttattgacatctttctgtgtgccaaggactttatg

SEQ ID NO: 779 - DNA, 1495 bp, Homo sapiens
gttcgcttttgtgccgacctggaaacactctgtggtgctctagattgttacaaagttcggggtggtgcagccccagcgcgccccgctccccggcctgcaggtggcatacaagtctcttcgctgtcgggattcgggactgaatctctgccgggcggcaaccccttcccccaccgggatcaccgggaaagtggcaccatggattctccatctttgactgtggccacgcccctctcgctgactccgcccatcccacgggaattggcgtgtggcgattggaggcgtgtcgggggcggggctgggggaggtgggctgaggaggcggggcctgggaggggacaaagccgggaagaggaaaagctcggacctaccctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggtaacctcaggctccaaggggcggccccggtccctggctgtggaggggtggctctaattccgcagaaggcaggaatggggtaaaggaaaaaagcgcagatcttgggtgtggagggagtcaaggcctgcgtgcaaagaagggaacaaatccaggtattgagaatgggaaaagaaaagggaaggaggggatgctggatgcttggatatgcagaaggtctgcttttgggcctgggagggagaaactgggcggtgaggaagttggatgcaacgacaaggggaaaatcaggtctgcacttgggttggaaaatcgaggggtggaagttgcaagaatgcatgtagaagactaagcctggagtgtaggaggaagaaaacgtgcagcagctgggggctggatgcaaagaaggctgtaagccgcagacgggcgtctgcaggcaactcaggcggcgaggaatagccttgaagccgatccctcgcgtccgccagggggcgtggaggggcggagctccagcggccttcagaggggtcgctaggccacacggggcgagagggggctgggggaaacacccccgccagttccgggtgcctggagtttaaaaggtcccagcaccagcgaggggaggggaggggaggggcgggcgtggagacctggaaggaggtaccgatccagccttgattgcagccctcttgcacaacggccataaggacgggtgcaggccaagagcaaggacatgcaaaccccaagacctgctaacgggcggcgaagcgggggcacgccctcgcacacgcagagataaattgtgctcccatgacctttatttggaaagtgcctgcgggcctaaaattggcctttgtcccaccgagtacactcagcactgtactttaaaccggataaactgggctgtctggcaggtactaaaaacagctaaattctcctgtgagtgttctgtatgttaacacttttattccttgttttgttttaggcgat

SEQ ID NO: 780 - DNA, 1466 bp, Homo sapiens
tagtcactttgatctcccccaaataaagaactgtaggtagtgattttcacatttaaatttgtgtaaggattacttgggatctctagatacctgggttggaccaacattatgatttttctgccatactaccagatgatgctgaggctgctggtcaccattctttaagtaggtgggttctgtgacatttggttgaagaatatttagcttattttctttttccttctgaattttcaggcctcccacttagtgtgtagtctgagatctttaagagaatgcatttttagtcttgggaagggatagtactccggttaaaccagtctgaactcactgtctaaggtcctaacaaatgatatgacctttaggatttttaaacatggggccttagtgttcttttgtaattaatgagatttttattttagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgtaggtgctctggtttccacatttggcatggtttttttttttgatactctagaaggaggggaaaggagtggtttggcctttgttggggactactattgaagggggtaaacttgcagctattccaaaaagatgggttttactctggccatcttgaacttggaagggactatgtccagaataagtgggctcatggaactaactggttctaaagcctcaagatagggggcaatcagatttgaggctgagagaggtaaaccaagattttctttgaagatacgggctttaagaaagcaaaagtggctgagcgtgttggctcacacctgtaatgccaaggcaggaggatcacttgagcctaggatttcgagggcagcctgggcaaccgcgagaccttgtctctgcaaaaaattaaatattagttgggcacggtggcatgtgcctgtagtcccagctacttgggaagctggggttgggaggatggctcgaacctgggaggtcaaggctgcagtgagctgtcatccttgccactgcactgtagcttgggcaacagagcaagagtctgtcttggaaagagcaaaagtaagttgctgtttgtatttccaggccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggtattgcagttctgtaggcattcatacttatctgtgttctttggttttttgcttctttaaaacttgtgattgactttaaacttgttggcaggc

SEQ ID NO: 781 - DNA, 1465 bp, Homo sapiens
tgatgaagaaagccttccaaaaacaatgaaattgttttttaatttattttaacttttagagacgagatctcactatgttgcccaggctggtttcgaactcctgggctcaagagatcttcccaccctggcctcgaaaagtgctggcatcacaggcatgagccaccacacgtggccaagagcaaaagttttaaagcaggacactatggcctgatggacaggagagactagggtccctcctccctcccaggggcctggcttcatctcagaaaaaccgagtccctcttgctccacacccgcatccttagcttcagccctggcagttgtgttgagcagatgctaaggagatggggacattttaccccctccgcagccgccccagagggtctcaaacccagggctgatttagggttgccctgacatggccaaccctattctatgtccaagtgtcattcatggctaaagcaggccagggccccaaggcaaccaagctcctctctcctctgcccgctcccacacaccctcctctgccccagtgttcctatcattacgtcctgggcattgaaacccgggccattcttggaccagggctgtgggctgaatgagggcaggaagaacagggtcaatgggaaaggacagcccagaaaagagaattcaccaccacctgtggtctcccactgctttggtaggaaccttgtaaacacagcagcagcccccaggaaagtcttggaagaagggagaagctgatcagatttagagactgagacatctgggcctccaacccaaggctccccgggccctaaaaagccagactcccgtctccttagccctttccctcaccgaccagcaggtggcaccacaaacagggatttcaaaaccaaaactaaattaaagtggaaactcagatcttttgtttatgcaaatagttcattccctccaacattcctccgggaatggtcccccctccactccacagaaaaccctcccctccctgctgtgcatgacgcgggctccctctgcacacagtgcacgaagacgctgtcgggagagcccaggattcaacacgggccttgagaaatgtgagtaagggtgatgggcaaccaggtgggagggagaagccaggggagaagccagggcatgggaggcaattcagggagacaggaacacccttctctcttcacacacctcatcagttccactgtgcacacgcgtggacacacacaacacacgccccatccctcctcctagggatcagaggagacttcatacatagatgctcatgccatggtcctttcttccctctgggctcttggcagggagcagcgagaggaggggaccccttgcccaggacgggacactctgtgcctgtgtcccccactccacagatggtttctcccagacgctcttgctgaacctgtgggagccctttcagagacccacgggtggaaaccctcaccctccattaact

SEQ ID NO: 782 - DNA, 1200 bp, Homo sapiens
gtttactccacagagtggcaagctgcctttccaaccctcacttagccacatgcggctaccgtattggatggcagtcttagggaatttcaatatcaactgattctttaattctgaatttgagaatttctttttataatacacacggtcgctaaggcgcttagagatctgtgaggcgcatggagattattttactctccggtcccttttgatccaagatcccacagcattaaaagcagtaagagggaaggcaatgggcatcccttgcgcccaggaacgtggcctggagggcctggctgctccgagcagtagcagtgcccggcggggaggctgcagacgcggcgttggaagttggatttctagacaagctccggcagctgcccggaacccgtgtctttttctggggcacccaggaacagcagggccagacggagagagagcagcctccagccaggcacagggtcccgagctgccaccgacaccgagggagcccggcccagggctgcagcgctttccgcctaggtgggcggcagcgggagcgaggagccggaggaagcccggcctgcgtcctgcgggcagcaggacacgatctccccggcgcgctctcgccggcgccgcagcgggcgcgcgggcgacagggtgggcgtggaccgatgggggcaccgcccctgggagaggcgggcgccgcggttccgggggcgggacgcgccgaggagtggggcgcgagccgccggttttgattagtgcgcggagctgcggcggtggagctgctcggccgggagcccggcggcgagacggagaggcggcggaggtgcccgcgcgcagggtctggtgggcggccgcgaggctcgggagaggcgaaccggagcgcgggaccgcggtcgccccgaccagagccgggagaccgcagcacccgcagccgcccgcgagcgcgccgaagacagcgcgcaggcgagagcgcgcgggcgggggcgcgcaggccctgcccgccccttccgtccccacccccctccgccctttcctctccccaccttcctctcgcctcccgcgcccccgcaccgggcgcccaccctgtcctcctcctgcgggagcgttgtccgtgttggcggccgcagcgggccgggccggtccggcgggccgggggatggcgctgctggacctggccttggagggaatggccgtcttcgggttcgtcctcttctt

SEQ ID NO: 783 - DNA, 1200 bp, Homo sapiens
gcttcaccagacacaagggcccagccccagctgtgtgtgtgctgggcccagccccgagggcccccttcctcccctgctgcccttcccaggctttcgggcagagccctcttgttcaccgcctccaggagggcggggcgtcctagtgggcccagcctcatctctgccctcgcgctccaggcctgctttcctcctgctgggtggggattgtgccctggcccatgtgggttgggaatggtggccccagggagggctcctggcacccgggggctgtgtccggggcaggtttccctgcctggcagctgagccctgtcgtgtctttgacccagactcggagccgtgggtcccgactgaacatcatcatcatcgctgagggtgccattgaccgcaacgggaagcccatctcgtccagctacgtgaaggacgtgcgtgtgggcctgggggtggccactgggcacctgctcctctaggccgtgtgggctggggctcagggctggtccttcccactgtcctgcagctggtggttcagaggctgggcttcgacacccgtgtaactgtgctgggccacgtgcagcggggagggacgccctctgccttcgaccggatcctggtaagtggccatcaccctgccctgcgtacgtgcgtgggtaagcgtggtgtgtgggtgtgggtgtgggcagtgtgcacgcgagcatggcacgtgcactgtgtccatgtggctgtgggtgagtgtccgtgtctgtgtgtgggggtgtatgtgtgggggacgcgtggtccttgtgggtgtgtctgtgtgtgtctggtccgtgtgggtgtgtgtggcagtgtgtgtgggtgtgtgtcagtgtgggtgtgtgtgggtgttccctcaagctgttgctcctcctgggggagactgaggcctggcttctccgttcccctgcaggtatagggaactcagacctggggaccatgggaggccccccaccagcctgtgcctcctggctgttctgacccccaccctctgccagcccaacgtggcagcagtcagggccaggggcaggccctgggagaggggctgggtgggcagagggtggtgcccatggcgcctgtggcgtcacagtctgggaggctggtgctgggagggagcattcggggtctggcctggcctcgccgtccttggtcctgatcaccgctgggtctcactttgtcctctgcaaaatg

SEQ ID NO: 784 - DNA, 1167 bp, Homo sapiens
acttgaagcaagtgcgcctcccgcgtcctgaagcccttctcggccctggcctctcaccccgcagccccggacagtaacagaagggctattttaccgcccagttcctgccaggagggccaatcagagccttcgccgttcccgagacccgcccccttctctcttacagtttgttaaagacacaggcgtgtaatttctaaaggataacgcagggtattttaattactgggtagcagaagtgaggacctagaatcacgcggagatgtgaccaatatttcctacccttctttaatttttcttatttttaaaaagtcaaatttaagtccagagtcataagaagtatatatttttttaacctggagaagaaacagactgcttttagatctgaacatgctggtatttctgctgttcgcaatagataaaatttggcggggggtggggggataatgtctctccagggacttgccaatcttttcttttcatttcttaaaacaaacaaacaaaaaagcaccaccatcattaacaacaacaacaacaaaaatatgcccaaaggacaggatatcaaatagcagttgataatactttggggaaagcacatgaaaacacaaattacagctcttaggaaatttattctgttccttagcctaaattggactataatactggataacaaagctctaaaaaatactgaaaaccaacacagcaggagatccacaacattcaatttcaatgttttaacagtccctgctatctgaaacatttttctttcatttaaaattaaatcccacctggtacatattaggcccattctattgctcagagaattttggagttcagttaaaaagtcagcctcactctctccttttccttctctccggtttcaatgaagagtcctagctccagacctccaactggagaagctcagtctccaccccaactccctccctccttggcctaagtttgtccttctgaggctgccatcccaaactctactcctaatccctccccacacccaggtttgctcttttaaaatagttgctttcttaggaaatgtagttgctttcttaacctcatcaaattcatgaagatttagccgaggcccatggtgagtcttaagctggatatctctcatgttttaaaagatgggtgtttgaaggagcaactcacaag

SEQ ID NO: 785 - DNA, 1162 bp, Homo sapiens
ggccactagaggagataaagggaaacagattgttataacttgatataatgatactataatagatgtaactacaaggagctccagaagcaagagagagggaggaacttggacttctctgcatctttagttggagtccaaaggcttttcaatgaaattctactgcccagggtacattgatgctgaaaccccattcaaatctcctgttatattctagaacagggaattgatttgggagagcatcaggaaggtggatgatctgcccagtcacactgttagtaaattgtagagccaggacctgaactctaatatagtcatgtgttacttaatgacggggacatgttctgagaaatgcttacacaaacctaggtgttgtagcctactacacgcataggctacatggtatagcctattgctcctagactacaaacctgtacagcctgttactgtactgaatactgtgggcagttgtaacacaatggtaagtatttgtgtatctaaacatagaagttgcagtaaaaatatgctattttaatcttatgagaccactgtcatatatacagtccatcattgaccaaaacatcatatcagcattttttcttctaagattttgggagcaccaaagggatacactaacaggatatactctttataatgggtttggagaactgtctgcagctacttcttttaaaaaggtgatctacacagtagaaattagacaagtttggtaatgagatctgcaatccaaataaaataaattcattgctaacctttttcttttcttttcaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatt

SEQ ID NO: 786 - DNA, 1143 bp, Homo sapiens
ttagccaggatggtctcaatctcctgacctcgtgatccgcccgccttggtctcccaaagtgctgggattacaggcgtgagccaccgcgcccggcctccgctttcaagactaaaaattgcctgggcactgtggctcaagcctgtaatcccagcactctgggaggccgaggaaggtggatcacttgggctcaggagttcgagagctgcctgaccaacatggcgaaaccccgcctctactaaaaatacaaaattagccggtcctggtggcacacgcctataatcccagctactcgggaggatgaggcaggagaatcgcttgaactcaggagggggaggttgcagtcagccgagatcgcgccattgcactccagcctgggcaacaagggcgaaactctgtctcaaaaaaaaaaaaaaaaaaaaaaaagactaaaaattgtcggggctgctggccaaaagaagatcttgcctggctgtcagaaaataatgttctttccagcggctgcttgaacccgcttccttcagtgcctaaatttaacggctgcagctgcagctgcaacctgtttcccccgtaataggaatgaaagtggaggataaaagaggttaggaagaaggcaagccagcagtctgaccagacacaggatgcatgtaagagacttgttaattacacgttctatttaggtcacactgataggcaaatcgctattctgggcccccaggaagccttttcgtccttgctatagtcaattcattctccagatgaaagcctgaaagcgccacgacccaagtttcacgtctatccactcaagaggcctgcttggcgcaggcgcataccttcaaaggcctcccgccctcactccaccacccccttagggggcggggcctcagagctcagtgctcgaactggctccagagccgtgagttcggcatgcaagagcggaagaaacgcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcacccgagggtcggctctaccaagtaggtgagtgaaccaggt

SEQ ID NO: 787 - DNA, 1085 bp, Homo sapiens
ttgctcctaagtcctgcaaattctcaggggattgaaataagagactgtggacagatcaacattaggaaaaaattcagtttgcatgctttggcaataagatgacaggcaaagcattctgatgtgttactcagattaacactgtctttaatgggatttaaagagttttctgaataggacacttctgaaaatgccttctgatttctctccattgctctcaacaggtgtgtgatctgtatgatggactttgtttatggggacccaattcgatttctgccgtgcatgcacatctatcacctggactgtatagatgactggttgatgagatccttcacgtgcccctcctgcatggagccagttgatgcagcactgctttcatcctatgagactaattgagccagggtctcttatctgacttcaagtgaaccaccattttggtggttttgatcttttgtcactgagcccaaagagccagggattaggaattaagatcgtgcacaaaagtttccttaaaattcctggatggctgcagatgttgggggaaaaagtacgtgatattttagaaacttagtgggaaaagtaggatggtatttttatgtaaagccttgacccaatgtttaaaaatataattgtatttagatcttgttattgctccagtacataggaattgtgtaaagtgttaacagcagctgtatttgtttaaattgtgtgtattgaagattaggaaaaagatagtagttatttttcctaaatgaaataactttcttctcttccccttccccacccgaattcttttctgaagttgctggcatttgggtcaaggttttattaaaagctacattttataacactggcacacacaaaaaagtagttttaagcttgtttgcacagttctttttttccattggaaatggaattcattgccttaggtctttttaaatagtgtattattatcgttggggctggctctatgcttgaaaaccagtttatttataacctgttataagtgctatattctgtttgcagttaggaaatgcagaattcaaagtgatctcctagcttgtaagcaaactgagatgcactatccc

SEQ ID NO: 788 - DNA, 1069 bp, Homo sapiens
actagcctcaaccctgtacctcccctcccctccacccccagcagtctccaaaggcctccaacaaccccagagtgggggccatgtatccaaagaaactccaagctgtatacggatcacactggttttccaggagcaaaaacagaaacaggcctgaggctggtcaaaattgaacctcctcctgctctgagcagcctggggggcagactaagcagagggctgtgcagacccacataaagagcctactgtgtgccaggcacttcacccgaggcacttcacaagcatgcttgggaatgaaacttccaactctttgggatgcaggtgaaacagttcctggttcagagaggtgaagcggcctgcctgaggcagcacagctcttctttacagatgtgcttccccacctctaccctgtctcacggccccccatgccagcctgacggttgtgtctgcctcagtcatgctccatttttccatcgggaccatcaagagggtgtttgtgtctaaggctgactgggtaactttggatgagcggtctctccgctctgagcctgtttcctcatctgtcaaatgggctctaacccactctgatctcccagggcggcagtaagtcttcagcatcaggcattttggggtgactcagtaaatggtagatcttgctaccagtggaacagccactaaggattctgcagtgagagcagagggccagctaagtggtactctcccagagactgtctgactcacgccaccccctccaccttggacacaggacgctgtggtttctgagccaggtacaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatcgtaagtatgcctttcactgcgagag

SEQ ID NO: 789 - DNA, 1049 bp, Homo sapiens
gacaataagatgtgttcaggggctccctgtttttaagagactcttttaaaaaaaaaaaaacctaatgtttttatcttgagtcaatatgattaggtattttggatttacttttaatcttaaaatactgcatttttatagcttctcagagcatgtggatgggatgggattttcgttattttgctgggtcagcttatctttaatatatggactattcctataaaccaaagtctctgacaagtgcacctaatttatattgtattttaactacagtgtaagtttccattaacaaaaccatcctaaagcgttaactgctcataattttaatcagctacagttatgaaaaaggaagaattttgctctaaagattattaataagcttagaaaatcctgcttttacctaacagaatgaagtggggttgaggggcggtagtatgaacagtgattctaactctatggcgtaaattactttgaagagttcattttggaagtaagggaatcccgcttcccttggtgttgaagatctgcatctgattttgaaacgtccagatttagctttcaaggtgcgtgcatgttgaatgatccagaagcaacgaaaactctggggtgagggattgaaaaaatctgaaatcacagttggatttttaaattcaaccatcaaaaatatgtactatcagtttttttttacattgatgtgaaataagcaaattttcatgataattaagctgcaaaatttaaagttatcaagtaaataggtcctctgtgttctgtttcatgtgatggagtgggtttcagtctgtgttcttggagccaaagggttcctcaggggtgcctcaggagtaatggtttaagagaagaggggcaatgagagggagcgagggggaaggcctagttggtatttgagcaggggccttaggctccatatccccaccccctttacccagaacagcccatttttcttatgtatattggaatttcaagtaagctttcatggggtgcagtggggcggggaggaatggatgggataaaaaaagtggagattttgctgcttt

SEQ ID NO: 790 - DNA, 1002 bp, Homo sapiens
ttctcacctctgagttttccctgtacctgggatatgggcttccttctgaactccattattcatgttatgcagagtaattctctttggtaaatccatccatgacaaagttcagtactttacatttgcatttcttcattctacaacttgcaggctgctataatttgtttcctcattccaaatctctttatgtgactttagcttcaaataggatttgcctcctttgaaaatcactggtgaagcaggtatgaatcttactccaaacccctgtgtaagagataaactggacattctcaagtactaccgagtttctgtttctaaggtccatcctgctgattttccatcctgggaacgtaatcacagtggcttaaagattgtactcacctctgatgcctggccctgcctcatccccaaaaacccagttctgcatttcatttgaatctagcacagtgccaaggctaggggtggatgctcactgtgttctctattttgacctcccaagagagactaaaagacttgcccaagtgacagagaggtgagattggaactgagaaagcctgtatctgaagcttctgcttttacccactgctctatagtgtctctgtatcagtttgaacaaatgactctctgataacctccccccattaccaaacagggttggggtttatcaggtaggttagttagttaatggcacaaaaggatgctctatgatcttggtatatcaggatattttacctgtgagaccactcaggtttcttctgaagaaagatctgggccagagggtaaacagtaacagcttggcactccctctctttccttgagtcccagggcctgattggttcagcaccaagtgaagtcatagtcactatggtgactcacaattgtcctcagaacctagtgccaacagtctgcaagattcaaacactggccaccatgcctggcttccttctggttcaagcctgaataaggtgagtggaagttgctgggagaggaggtgggtatatc

SEQ ID NO: 791 - DNA, 993 bp, Homo sapiens
tgcctcaaatgtaagaccacagatcttgggggatagctgtaaaagaaggctggtagatgccattgccagtcaccaattggcacaatagcataggggcagaagactagaggaggaaatccagagaactttggtgggtggaggcgggcacaaatgcaaaggacacatggaaagaaattattttgacttacttttccaggtagaagatttcgtggatcccaatggcaagatctctctacagcgggaagagacaccatcaaaccggtaagagcagaccagaggctcaggggcttggggagggagagtcagaactttggggctcaccaggccatgtgccctttttctacagaggagagtcaacagtgctgagctttgtgagctggctaacactgagtggtcctgagcagtctagtgttcggggcccatccactgaaaaccaagaggccaagagagtggccttagagtgtataaaggtaactgcccatccacccctggtgagaaagcctaaacaccttcctattagatgctacttggtgaactgaagaataaatcatccaggatttgtaaccagggctgactctgccctctccccctggctcttggggacattctgttctcttcagcctttgtcaaagaccccctctctcttttgccctctctagcaatgtgacccagaaaaaatgatcacagaaagcaagttcctccagctggagtcactacaggagctcatgaaggtaaaggatgaagaaaggaaacatggaacaactggctgaatctgggaggggtgacagggacagtattatttctgtcagggcagggccagtggttggcttcttttccatgcctactttcctgctgctgttccccttcaggctctggtctcagtgacaccagatgaagagacatatgatgaggaagatgctgctttctgcctagagatgctgctaaggattgtgttggagaacaggtaagatgagcgtagtctttaggcagacc

SEQ ID NO: 792 - DNA, 914 bp, Homo sapiens
gaaagctgttgtccaagaggaaatttcccaaaaagccctaaggtctgaagaaattaagatgtcagaggcaaaatctcaagaaaagttagccctcaaagaggaagcttcaaaggttctgatttctgaagaagtcaagaaatcagcagcaacctccctggaaaaatccattgtccatgaggaaatcactaaaacatcacaggcatcagaagaagtcagaactcatgctgagattaaagcattttctactcagatgagcataaacgaaggtcaaagactggttttaaaagccaacattgctggtgccactgatgtgaaatgggtactgaatggcgtagagcttaccaactctgaggagtaccgatatggtgtctcaggcagcgatcagaccctaaccatcaagcaagccagtcacagagatgaaggaatcctcacctgcataagcaaaaccaaggaaggaatcgtcaagtgtcagtatgatttgacactgagcaaagaactctcagatgctccagccttcatctcacagcctagatctcaaaatattaatgaaggacaaaatgttctctttacttgtgaaatcagtggcgagccatcccctgaaatcgaatggtttaaaaacaacctgccagtaagtttaattatgaatatattattgaagaaaaactaaaataccatgtcttccacatctgaagaacttcaacatttcttttctttttcctttgtcttagatttctatttcttcaaatgtcagcataagccgctccagaaatgtatactcccttgaaatccgaaatgcatcagtcagcgacagtggaaagtacacaattaaggccaaaaatttccgtggccagtgttcagctacagcttccttaatggtccttcgtaagtatctcctcacccttcttccttacatg

SEQ ID NO: 793 - DNA, 806 bp, Homo sapiens
gctagcaatatatgtgttagctttagtgtctttttaggttcagattatttttggtagaccttaaaaaatgagaagataaaggatatccgaaagaagccttaaggtagatcctttacttggaagtatcaggctcttccacctgactccactcataataaaaaatgaaaacaaaagtggttgacgtagcaaagattttaacttttaaagcttgatagagctttgcaggtttaggaagataacttcccagtcttcagattgggatggtgagactgtgtggccccacctccatgcaggccatgcagaacacaggactgtagagaaacagaggctcattctcagttccaacaggaggaagagtgcccactgggcagccagtcctgttagggcaaggagcagcccttctggagacatggcagatcttaacgtttcagtgcatatggatgggggagggtgttctggggctggtggaacgtagagggcattcatggtggtgaaagtgggatgtaggagagggtttgggtgatgatggataactgggttcactgtgtgctaactgagctgaacagagtatgaggcgttggcctacattgtctccctggaaagactgctgtcacaggttctcttgctggcattgtgatgcagggctgcgtgaagccctccttacagcgggaggtgggctctgttggagtgggccctgtgcctctgctgtctcctactgctaacgtgaggcatcagctgaggagggatggggatgaactattttaggcagggggttgcagtataatctgagccatgctatcctatgg

SEQ ID NO: 794 - DNA, 1310 bp, Homo sapiens
gaagatctgtgacttcgacctgggcagcggcatcaaactcaacggggactgctcccctatctccaccccggagctgctcactccggtgagggcccgcggggagggctgggggctcggccgcctgctctgcggttgcataacctcgcggagcctgggccatccagcagctccaggccgcggagctcgggcttccgcctagcaacagccgctgattggttgggcggggtgtcgcggcggggcctcgagcaggcgccccaacgcgtcggtgtttggccgggtggggcggggccgcggcgggggaggggcgagctctgcacctgctgattgggcgggggcgcgttcccggcagccgctgattggtcgggcccggcggggcggggtccgagccggctggcgcaggtgacccgcagttacccgggctcggttcccacgtaatgctgggaaaccccggctgacgcgcccctcccccgcccgcagtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccaggtgcggcggcccgcgcaccctcctctcctgggcaccctcctcccccgggcctgccctgaacaccccctaaccccaggggacctgccctgcgcaccctctaagtccaggggacctgccccctgaccaccccctaaccctcggggacctgccctgtgtgctccccagacccccggggacctactctgtactccccctaacccctggggacctgcccggtgtgccctactccctgatgccatccacagggcagtgccgccctgtctgccagtttcccgaaggcttttcaggtttgcctgcccaagggaaaccccagacagggttcagagagctgagaggtggagtgaggcccctggtttggggggatcaggctcaggctccctgcccgcggcttaaggctcagcatctgtggcctgtggtccctggaaccaggtccctcagagctgcttttttgtaaatccagctccacttgggtggagctgactctcctggtccggctcccagccccctctgccccaggcgtgcgtggtctagggcctggtctagggcctggttggggtccggttggagccacgtgtcagtgcacagtatccaggcccttgggcaggtctaagctcccctgtgttctatgtccccagaac

SEQ ID NO: 795 - DNA, 1200 bp, Homo sapiens
gtccatctgcaggaaaaagacaccacttttgcaattttaaggaaaaggattaaaacagggattggccgggtgcggcgatgcgcgcctgtagtcccacttttccggaggctgaggcgggaggatcgcttgagcccggggactcgagaccagcctggccaacatagctagaccccgtctctaaagaaaaaaaaaagacaaaagaagagaacaacaacaaaaaaaccaaaataaaaataaaaataaaaacggacgggcgaacgcgtcgggtgggcgtagggttccgcgaagcctccctgtccctcttgtctcgtcctagtcggtctagctgggccccatcccctttcccactcggagcgtgagcgcctggagacacgtacagccaaccagtgagaaggagtggccgcgagtggcatgcacttggtccaattacctgcggccctgccggtcggcccgcgctggggccaatggaggtgcgaggcggggctcgggcgggggcaacggtcacctgatctgcggctgtcgaggccgctgaggcagtggaggctgaggctatgatggcggccatggcgacggctcgagtgcggatggggccgcgatgcgcccaggcgctctggcgcatgccgtggctgccggtgtttttgtcgttggcggcggcggcggcggcggcagcggcggagcagcaggtcccgctggtgctgtggtcgagtgaccggtgagcgggccggggtgggatgcgctgtggcggctgaggcgccctcgcccgactccggcgctgtcctaggcgaggggtggtgaggcccggaggtggactgttccttgctcgggggctcgcagcgaatctgccggcgacagagctccagtccacatgcgcccccgtctgacagcacctcttctgtgccctgccagggacttgtgggctcctgcggccgacactcatgaaggccacatcaccagcgacttgcagctctctacctacttagatcccgccctggagctgggtcccaggaatgtgctgctgttcctgcaggacaaggtgcgcccgccccagcccactctcccccggtcatcgggaggcagccaggccccctccccccatgacactgacgcccattccccaagggaagcttcagtgaccttgtcccaactgtagggaggtgtgggtcgtctcatgggaaggcctgtagtaaacgcttcagtggg

SEQ ID NO: 796 - DNA, 913 bp, Homo sapiens
ctagaggcaatattggggtgttggtcttccccaaggggaagggtggtgaggctgagggagaagcagttatgttttcagctgggcaaacatggacggttgcccgtagaaactttgccactgtacttcagaacgttgccctagtcgttggaggagaacaatgtgttccctttctagccaccctggtccacggagggaggagggagagagagaatgtttcctcttcggctgttgtggcttgagagtttctcttctttcggaggttttgtggtagtggctggcagttattagtatgcctcatggcttttaaatttccagatctttttgatttagaagtggaaatttcctaattacttgacaagtcttgtagaattccataatgttgtgattcttgcccactatcttaagtgagactttgcatgagacctatggaaattatggcagcattccccttagaatctggcttgaatcagcttttgtgtaggaaactgctagccttctaaaaaaatatattgtaaccttgtttcatcctcaaatctaaatgtgtaatgagttttcttttggtggggaggggcggtgggtttgagttaagaccacagctaggatgaaagacaaagagaaaaacaaactgtggaagccaagcctgttctgtggctggattttacttatattggaagaagttctatgttttgtaaatttgtgtattggttttgatttgtttcctctgatagtttagtatttggatagtttagtgttaacctcagctacactgaaggaatagaccttagtcctcacaagtataagttctagcttggaagcctgggttctgcagtagctgtggaacttaagcctgtgagctcagggatgcagaggcattgagttactaccaagggcctgatcttttctttagcaggca

SEQ ID NO: 797 - DNA, 920 bp, Homo sapiens
gccactcggtcactgtctctattttatgatgagaaccaggagggtgtgagatttgcctgcatcatgggcagctggtttcacagccgggactcttggcttggctctgcagtgctcggctgcactgaaaaaagggccagctatggctctactttccctgtcagcttgtcatctgctgctcttgaccttggtcttgtctttgcagtgtgagacatccatggatggagaggcgggactctgctggtgcgtctacccttggaatgggaagaggatccctgggtctccagagatcaggggagaccccaactgccagatatattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaatactgttatctctgtgg

SEQ ID NO: 798 - DNA, 907 bp, Homo sapiens
tggaacagctaggtgaagaaagcctattgaacaggtcaatatgtcaccaccagaggtggaaaacctgcgctggaccaggggccctggggctaagcctgagctccatcactcagcaagccaatagctatggaagactttcctaggccccctaacgcttggatcttgggttcctcacctatacaagagaggaagggaacaaacttaacttagaaaagcaagtatctatttggacagctcttaacacttttttctccttgaactgtctaataaaacacaacaacatttttgtggcttgccagataataaatgagatcaaacagaccaagatttcatattgaggagtgctttaggtctcagtgaagtacaggttctgtagattttattgggagaaactgaggactaggccctgcttcacaggcaatgaacagtggggcacacacgagacatgttccctctgggttgggctcccctgacatcaggctatgaagcagacagctgtgcacacactgtactgtttaacacacatgggaagtcattattgcacatgccactcggtcactgtctctattttatgatgagaaccaggagggtgtgagatttgcctgcatcatgggcagctggtttcacagccgggactcttggcttggctctgcagtgctcggctgcactgaaaaaagggccagctatggctctactttccctgtcagcttgtcatctgctgctcttgaccttggtcttgtctttgcagtgtgagacatccatggatggagaggcgggactctgctggtgcgtctacccttggaatgggaagaggatccctgggtctccagagatcaggggagaccccaactgccagatatattttaatgtacaaaactgaaaccagatgaaataatgttctgtcacg

SEQ ID NO: 799 - DNA, 1043 bp, Homo sapiens
tggtgataatctgcctatgccttactgaattttcacaataatattactatactttttttgtcccctatatttccaactgtgaatccaggtgcactgcagatattagtctgctttctgagggtagggatgacaaataaaatatacaataccgggggaattggaagtacagaaaaataacaagtttttagtttaagtatgttccaaatattgcatgacatggcacccagtactactttaaaaacaaacaagcaaacaaacaaattcacactcctactttaatgaacaaaaatcctctaataaggaggtcacacacacaggattacaggcacaacccctgcccccccaacacacacacacacatatttaccttagagcagactccgggacacaccaacacacatgatcctcagtccttttaataaagcacgttcaacccttctcagagtgaccttgagtggttgcctccatgagtctgcagatgcgaaaaggaacttggttcagggccctaatcagaggcttcctgtcaggacaaggttctggcatcagcattacctgctgcaactctgaagggcagggtgggagcctgctatgggactgccccctccaaggtgtgagcctgttaattccagggtcagcttacccaacatctgcagtccctcagctggaggcctgagctcttaatgcccctgcctcccttctgccctgggcctgctctcaactgccacaagatggcgcagaagaaagggcctgaggagatgcgggagctcctctgcaggtcctcccaggcaccaccccttctgggaggaaggcttgggagtcccctaagacacatcttcagtcacttctctctgcctgtgactcaggaagaccagctcctcctactgtcttctgtgctagggatcacttccttgttgagtggggccggagttttaagaggatcttctgctcctcctcatctggtccctttccttccaaggcccccgagaggaaggcatgcggtgggccctactggtgcttctagctttcctgtctcctggtgagta

SEQ ID NO: 800 - DNA, 1066 bp, Homo sapiens
ggttgttgtggagattttctggattaagagaagttttttttctttaaaattcgaacaagtgtctgtattttttccctttatttaagaaacggtggcggcggtggtggtggtggatggggggcggctctcactaccttgcccaggctggtctcaaactcttgttctcaaatgatgctcctacttcggcctcccaaagtgttaggattacaggtgtgagacacttgtgttggattttttttttttggaggcagggtctcgttctgttgcccaggctggtgcagtggagcaatcacagctgccagcctcaaacttttgggctcaagcgatcctcgcacctcggtcgccccagtagcagggaccacaggcacatgccactactcctggctaattttaacattttttgtagagatggggtctggctatgttgctaaggctggtcttgaactactgggttcaagtgatcctcccttctcgacctcctaaagtgttggattacaggcgtgagcccactgtgcccggcctgcatttaattagacacctaaaatttaggccggtcagtagcacacttagcagcacgttactttttataaaaacaaagaccgaataccgcttttttgaaaaaaaaaaaaaaaaaaaaaaaaaaaggatgcaccagttctccccatatcatttcttctctctacctctcgtcttttgcagctaacattactggccaggtccgcagcagcagagttctgtgggctcccagcctccgccctcctcgccctcctccgcgccggcaggtgaggccgcgtggcgggactacaactcccagcgtgccccgcgacgggagggtcacgtgggcgtccggaaaccctggtcgcaccgccaggggtgagctggcggcgggggaggcgggcagcggagccaagctgacccggcgagcggagccggggctggagagcggcgaccactgcggatctcgggtgcgcaagcggtgatgcgtggggccgaagacctgctggggcgggggcgggtccaatccgaggggcttcccgggtcgggagggcggtggggagatgtaggt

SEQ ID NO: 801 - DNA, 940 bp, Homo sapiens
ctccccttaattacttcctcccctgtgcgccctcaaattcttgtactcattcaagcagtatttattaggggccagctttgtggccggcaccgtggcgggctctggggctacaaaaggtgaataatacttgggctctgcctctgagggccttacacgttagggaggagtgggtcaactgccacaaacgtcgctaggaaattaaaaggaaaattttacaaagtggcagttcttgtctgtcttcccctccagatggcccgtgtgttgttttcgggccggggctatttctcatttatttcgcacccccggttcttagtgccctgtaggtgctaaatcagcatttgtttcatgagtgctttttctgggggcaaccagacccctgcagaagtgtacctgtgttgtgccagaggttctgatgataggcttataggcggtagtttcctcagtgtccgtgggtcgcccccggtcccgggttggatgccccgcggtccagcaccgaacctttcggggtgcagagttgcagagccgcggagggcccgggccgtgcgcagccgaagggaggcctgcagcgccccctctggatgcagcgggcaccggccggccgccccgctcacccgctcgcaccccacgtttgttcaccagtatttcagtttacggtcagaaaatgaacacagacacttcgtgatactctacacttttcaaaggcgtaagggatgccttttaaaggattatggattagaaaaattcctccctctttcttgtgcctctgggcccttgcattgtgattctatcttacgtaaataaagggggctttgctctcctaattgtgcccactgttctgtgcagcgcggaccggcgcatgcagcgagcggggctgcgagggcgctgctgtggccaggcgtctggcatgctgaccacgtcgcgctgctgtaaaggaaacctg

SEQ ID NO: 802 - DNA, 994 bp, Homo sapiens
gatgaatcttgatgaggagggtgggcgaagtactctaaatgaaaatgagatagattgcgagatttccggagaggagtgagtgacaagcgcctacccgtgcatgaagctggaggtagaaaattccagcaaaaggaattttcaagtttcactgaagcttttgaatcaaggcttgaaagcccagggttaaaaaaaaggcagtgaagaagctcattaagacaaccccccgccaggtagcagatagcacctgaaatgcagtgggaaatttgtgaggtcttcataggcaaggattaaattttacatctccatcttaagatgtgtcatagttgttcaattacttagtgaccaaaaaagtgaattaaagatgttgtcaagattaaaaaaacaaaaaccaatgcaggttccaccgagatttgaactcggatcgctggattcagagtccagagtgctaaccattacaccatggaaccgccacgcatgtgtagctgccttcggctgtctaatcctcagagaaccccgcccccatccacaaacccaccactcacaggcggtcccgcctggttccagcgagccgcttccggcacggtagctcgagaaatgagcaagcggccactaagactatggtagctaggagttccaggactcagtttcccctttgagcctcctttagcgactaaagcttgaagccccacgcatctcgactctcgcgcacaccgcccttgttgggctcaggggcggggcgccgcccccggaagtacttccccttaaaggctggggcctgccggaaatggcgcagcggcagggaggggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacctctttaaaggtgaggccatgggctctcgcactctacacagtcct

SEQ ID NO: 803 - DNA, 906 bp, Homo sapiens
gatgaaaaggatggggaggagggaacttgttgggatctgtatctaagggtacccgaccccttggtctcattccactgttccacaggggttggtgacagtgtgtgggagacaggggtggacagaagtgcgttaaccaagatacagactagagaaggaagcgtcagttcttaggacaggggtcagtttgtagtgtgggaaagaggaggtgagaaagggtagtgaatttcacctggcccttgttgagtatgtgatgcctgtgttcgccatgtgaacagcagaaagcagcaaatataaggatcgagagcacggggtagagagagggctggcgatggacaccatctttagggtaattgcgaaattaggggaagggctgaaatacggaaggctcgccgaagatctctaggtagttaataactatcaaaatgtcacttctttggccttcacttttattatgtaaaagtactcagatcaggccgaatacaattttattctctttatccaatgccggaggctattgtcgaagccacggcctgccatttcataccctttgcaataggtggcgctgacgcctggcagggagaaggcggcagcacatgctgggctcgggggcgatgggcttgtgcgcggacctggcgacgctctagccccgagccgcgtattcgtggccgggtcctccctgggaacagggtgaaggccgagaacctctggcctcaggaagcgcatgcgcaaccggttctccgaaacatggagtcctgtaggcaaggtcttacctgaatcaggtaagaggcgggcggggaaggagtggagcctccccgtgcaccctcgcagcccgctccaggagtgggactagccctccttgggggtgtggctcgtgtgcgtgggccacaccagtcctaggggcaggta

SEQ ID NO: 804 - DNA, 1067 bp, Homo sapiens
gttccaggagtctgcctctgttagaagaatctcacacaagtgtgcgtgctgtgccattgtaaatgctgtataaggtggccaggcccaatcagtccctgcaagacaccgaacagtaagaactatctatggagtgtttactatgtgccaagcaccgtcctttgcaagcactattaaccctcaaaataccaccaccgtgagattgagaccatcatgattcccgttctacagaaggaaacactgagacttcaggaggtcaggacctttccagggtcacaactgcgtaactaagttgcagagctcaacccagtggcacttccatctcacacgcagctgtctgatggtcaagagcccaaccagtcccccggtcgtttctaccgcactaaaccgctgtgtcaagctggagcagcgggctcagcagtgaaaatgaaagaacagaaggaggttacagagaagagaacggtcacggtaaattccggagaggaggcaaggacgtacacaccgagatacttcccggtcaccgttactcagcactttgtggggttcacgtggctgggggggccggggcgtggcggcccttttcgaggaatccagccctgcctgggcggtccccatctcgagcgtgggcgtgttcgattcaggcccggcggacgcatccccaggtgacccgggagggaccttgtgtctctgggggtgactgtccgtctccccgcctcccaccgtcacgcgcagtgctgatccccacttccagctggagtgcgagctgggcttggggttacaggagccgaagccctggagctccgccccacgcttgcgccagccccgccccgatcccggctcgcaggctccaggggcggggcgtggccggggcgcagcgacgggcgcggaggtccggccgggcgcgcgcgcccccgccacacgcacgccgggcgtgccagtttataaagggagagagcaagcagcgagtcttgaagctctgtttggtgctttggatccatttccatcggtccttacagccgctcgtcagactccagcagccaagatggtgaagcagatcgagagcaaggtac

SEQ ID NO: 805 - DNA, 1259 bp, Homo sapiens
aaatgctcaatgtgaaggagaggggaatgcaaaatagtttttctgttttaccacagtctttgtaactgaaaatcctatgttcttgagatagagagagagccaatgatccaatgcaagaaactgagtttaagaagaaactgtttgctgggcacggtggctcacgcctgtaatcccagcactttgggaggctgaggcaggcggatggcctgaggttgggagtttgaggccagcctggccaacatggtgacacgtcgtctctactaaaaatacaaaattagtccagcgcagtggtgtacgcctgtaatcccagctactcaggaggctgaggcaggagaattgcttgaaccctggagatggaggttgcagtgagctgagatcgcgccactgctctccagcctgggtgacagagtgagactccatctcaaaaaaaaaaaaaaaaaaaaaaaaaagaagaaaaagaagaagaagaaactgttcatctgaaatccgacaactcattcttgaaggttagagctcagctttgaagtttcacttcacgagcttggctcagtgaggtatgttactccccggtgaaaaagaaaatgaagagaatgttttatgttgaaagtgcttggtgacgaaaaggcagcacctagatcccttatctcataaaaaatgcagcagattcttaatattagcaatctagtgtttagattgttacctgaagaaaggaaaaacaaactgtcccaaatgctgattctactgtttcggtgggaaaaaaaaatgtcttgcaggcaagtggcaaacaacaaaacttttgaaaaagcaggcctggggggagtccagtacagtttcataatgggtatgaatagttattttactgtgttccccccaccccctttctttctgggttttgatgtggatgtctttctatttgttcaggaaattgtgacgtgtgttctgggcagggtttgaggttttggaacattttctaaaagggacagagagcaccctgctacatttcctaatcaagaagttggcgtgcagctgggagagctagactaagttggtcatgatgcagaagctactcaaatgcagtcggcttgtcctggctcttgccctcatcctggttctggaatcctcagttcaaggtaagactcaggagtcttgttccccagccatcttctctgtaagccctgtggtccatgcaagtcattatattcattttaaggcatagaatgtataatattgtgagaaaggaggcaaagaagaaggatttg

SEQ ID NO: 806 - DNA, 1233 bp, Homo sapiens
gtcttgatgtttgttcgaaagggaaataaggctttgagcttgggatcagtgctcttcagtccacagagacatcttggctgcaagaagcagcaacaagttaggctcaaggtggaattgtgaggtcctgagaagagcttgctcttctgggacagaactgtatttttcttctaaactgcccatgttctggggagtcttcccgccttttggcttcagcaggacccttggtcattgttacaacctgtgtcatcttagtggagctgctgctggtttctgtctgaacccgatgcaatgggtctcatacctgtaaactgggctccaggaaggcagctttctctaagttggaaaatgaagactcaaggtggagggtgtttcccaaagccgataccacaagatattaataggtgtttttttcctatgacagcagttctaggatggtcaaataagtgcgtcgggttaaacaaagttaagcagctttctttactgcaggacttctcaggtgttgaatttgctagtagaaactgtgcatgaatacccataagggactacaggatgcagtgttttccaagccttctgacctttcatgttctgcagactgcactttgaaaaatgcttgtttagactaaggctagctgggatccggttaaaggtgcagaataaaattccctgaacgtgtcggacttaaatccttgggctggaatcctcccactgcagtccccactctacctcccctttccccaaaacactagcagaaaaagtcatctgcccctcctccttctggcagaatagtactaagggcttggatttttttctcatactgtaagttcatttaattgtttaatgaataaatattaccctccctctaggttgcttgtagcctgctggttgcactgtttatgaaacagctgtgaggacaggtgggccgtaatctctgggtagctaaagcccagcagcagcccgaggatcatgtgtcaaccctgtaatactgctctgtgcacacaggaattatgatgtgagctcagtaagacacaacctcacgattggacatgcggaggtgactcaggcccaagtcagggttacagctagcctcccggtaaacaactgacccatccttcctgagctcttctccccaggatttcaacagcaccacagaaatagccattttgctcatggttatttcccaggaccacaggatttgcctaagtcactgggaggctatgtgtctgttctgagcct

SEQ ID NO: 807 - DNA, 1000 bp, Homo sapiens
ggtcagttggggtgtactccttttctgtgtgtgtggatgggggtgggggttctggtaaagcttatcaggcttcgcagtcacctgtgatgtgggcttccttctgggaagaaaggaaggagtgggatggggctgtcagcttttcatcctagcctgcccctgtcctctgtccgcctctgtgctgaggcagttcctgctccctgagtctctgtcctttcctgggaaaggtggaagcagttcatggtctttccctttcagaggaggaggggatggaggggattgtattagcaactgggattgaagctccccctggcagttatggggtgcccttgggagggctgctttaggggggctttctgagaagaggcaggtcgggctgtacctgagaccaatccccttgataaaatgcagccaggcctgaagcacgttcagaacggaagcagcaaaggtgatgatatcgctcgttgctactcagctttcaggaggaggctgggcgttagagggaggctgtggcttatctcctgcagctgggcaggacggctgagtttactgttgtaaagaggaagccgccgctttagtttcctcttgtgagggctgtgaagagggccaggacactgcattcaggataccacagccattttgttttggataactgggattacctggggacttcagggctcttggaaattttccactcatatttcatattcacgagagaatttccagcccaggcttttcctgctctggctcactgctgctcacagatatgcaaaacagagacctcctactccagccggcagacaggacccagccagctgcacgcacgcactgactcagctgagcctcctgggtggcaggcagcacctcacccgggtgcatcacttgagtggcatcttcaggaccagtcatggagccaggctcaggtctgtgtcggggcttctgcaaggggagtctggcaagagtaggaaccagcttccttcgtataacgaggggatttcagtgg

SEQ ID NO: 808 - DNA, 1318 bp, Homo sapiens
acgcgtgcggcgcactaaattgtgccgcgctcgcccccgccagaccatgtcctcctggggaaaaagtttccctagtccccccagcagcgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaaggtaaaggggggcggagcatttgcttttcaaaaagtctttttcttttgccttaagaaagaacccccaaaagtttgggtcttggaaggcaatggggaaagtggtgcagcgagatgattcttttctcctccggcatttctcccaagtttgaaggaatttggccccgtccttcccaccctttgagtttcaacagttgctggcggggattacatgtgaatctggaggccagggttttgaggggcgaagtttgcctggcagggcagcccgggggcttcggggggagggctgggattgggacaagttttgggcgatcctgttttac

SEQ ID NO: 809 - DNA, 1213 bp, Homo sapiens
tggcagagtaagcactctgtgagtatgacactggcatttcttctgcagcactacatgctgtctatgcctttgtccaagtctgaaaccctagaactcttagaattcagttcaatgtttacacaatcctacagttctgctaggcttctatgatgctactattctgcatttgaatgagcaaatggatttaatgcattgtcagggagccggccaaagcttgagagctccttcctggctgggaggccccttggaatgtggcctgaaggtaagctggcagcgagcctgacatgctttcatctagtttcctcgcttccttccttttctgcagttttcgcttcagagaaagcagaatccttaaaaataaccctcttagttcacatctgtggtcagtctgggcttaatggcaccccatcctccccatttgctcatttggtctcagcagtgaatggaaaaagtgtctcgtcctgaccccctgcttccctttcctacttcctggaaatccacaggatgctgcatttgctcagcagatttaacagcccacttatcactcatggaagatccctcctcctgcttgactccgccctctctccctctgcccgctttcaataagaggcagagacagcagccagaggaaccgagaggctgagactaacccagaaacatccaattctcaaactgaagctcgcactctcgcctccagcatgaaagtctctgccgcccttctgtgcctgctgctcatagcagccaccttcattccccaagggctcgctcagccaggtaaggccccctcttcttctccttgaaccacattgtcttctctctgagttatcatggaccatccaagcagacgtggtacccacagtcttgctttaacgctacttttccaagataaggtgactcagaaaaggacaaggggtgagcccaaccacacagctgctgctcggcagagcctgaactagaattccagctgtgaaccccaaatccagctccttccaggattccagctctgggaacacactcagcgcagttactcccccagctgcttccagcagagtttggggatcagggtaatcaaagagagggtgggtgtgtaggctgtttccagacacgctggagacccagaatctggtctgtgcttcattcaccttagcttccagagacggtgactctgcagaggtaatgagtatcagggaaactcatgaccaggcatagccta

SEQ ID NO: 810 - DNA, 1286 bp, Homo sapiens
gtcagggcaagactctgtctcataaataaataaataaataaataaatattggagcattaaattctgggcagcaatatacaagcatgctattgtcctacaaatcacaatataaaatactctttattttcatgtttttgagagcaatgaacacacaaaatataatctctggaggagactaaaattcttttttcaatccaccgttttctaaggcttcacatctctagtccaacttcattggatcacagataatcccccgccaactgagcatggtggctcacgcttgtaatcccaggactttgggaggccgaggagggccaatcacttgagtccaggagttcgagaccagcctgggctgctgaaacccatctctaccaaaggaaaaagaaaagaaaagaaagaaagaaaaattagttgagtgtgattgtgtgcacctgtaatcccagctactcggaaggctgaggtgggaggatctcttgagcccaggaagtcaaggctgcagtgagcggtgatcgctccactgcactccagccagggcaacagagcaaggccctgtcttaaaaaagaaaataataagaatcccattcattatcttctaatgcaaacaatcaatggagtttctaaagacctagacataggtggtgtcaggacctgcttctgtaacttttccatcctttgcattaggcagcgcggaaccccctaggcgaccccgcgctggccgggagcactctttcttcagccaaaggtacgttccattaccgcccctcgggggcgcgctaggcagcgggccggccaagctgccgccgcccagggcgccctgtcccgttcgcttttgtgccgacctggaaacactctgtggtgctctagattgttacaaagttcggggtggtgcagccccagcgcgccccgctccccggcctgcaggtggcatacaagtctcttcgctgtcgggattcgggactgaatctctgccgggcggcaaccccttcccccaccgggatcaccgggaaagtggcaccatggattctccatctttgactgtggccacgcccctctcgctgactccgcccatcccacgggaattggcgtgtggcgattggaggcgtgtcgggggcggggctgggggaggtgggctgaggaggcggggcctgggaggggacaaagccgggaagaggaaaagctcggacctaccctgtggtcccgggtttctgcagagtctacttcagaagcggaggcactgggagtccggtttgggattgccaggctgtggttgtgagtctgagcttgtg

SEQ ID NO: 811 - DNA, 1524 bp, Homo sapiens
ctgggtgctcagttgtctaacctgaaaaatgggactagcggaaaaagccaatgtgttccatgcaccttttgctttctttattaaggcatgatgtcacctgtacagtaactgccctgtgtgtacttcagggggggatttcaaggttagatagacaggaaattgttttgaaaatgtaaacacattattaaatgtgaagtattatctgattccttgttcgaatggcatttccttctcagcaccaccttccttgcatattcacttaaccttgtacaagaacacctttttgccctaaatgaagacacccccccaaaaaaaagagtcccagaaaatatgtccctgcttgtgcggggaataaatagaatattctgaggtgcattcctccttcctatgttaggcaacattccttgaccctcctcggcccccaagccaggttgcgtttttttctgccatttagaagggttttcctttttgtcctagtaaaacatcagcccctgtagctcttcatctccccctggtgttcttctcccgccatgtcttaagattggtggcaccgaccaatcttaagatttaagttctgtgtgaaaaacacctttgcttttcaatcagtttatcagcctcctccgcaggggaagtgtggacacacaaaagaacttatcggggcttctcatcagtgatagggaaaagactgggcatgtgcctaaacgagctctgatgttatttttaagctccctttcttgccaatccctcacggatctttctccgatagatgcaaagaacttcagcaaaaaagacccgcaggaaggggcttgaagagaaaagtacgttgatctgccaaaatagtctgacccccagtagtggggcagtgacgagggagagcattcccttgtttgactgagactagaatcggagagacataaaaggaaaatgaagcgagcaacaattaaaaaaaattccccgcacacaacaatacaatctatttaaactgtggctcatacttttcataccaatggtatgactttttttctggagtcccctcttctgattcttgaactccggggctggcagcttgcaaaggggaagcggactccagcactgcacgggcaggtttagcaaaggtctctaatgggtattttctttttcttagccctgcccccgaattgtcagacggcgggcgtctgcctctgaagttagcagtgatttcctttcgggcctggccttatctccggctgcacgttgcctgttggtgactaataacacaataacattgtctggggctggaataaagtcggagctgtttacccccactctaataggggttcaatataaaaagccggcagagagctgtccaagtcagacgcgcctctgcatctgcgccaggcgaacgggtcctgcgcctcctgcagtcccagctctccaccgccgcgtgcgcctgcagacgctccgctcgctgccttctctcctggcaggcgctgccttttctccccgttaaaagggcacttgggctgaaggatcgctttgagatct

SEQ ID NO: 812 - DNA, 1462 bp, Homo sapiens
aacagttgcttgctatcagggtcatcccggagataacttgaagtttctagagcttattcttagaggcttcaggaaaaaaataaaaaaaaccaaaatcaaactttaaaagctgtctctcacaagcacacgtttagaatactttttggtggcttgggttggaaaattgaatcccgcccccgcctcccccgccaggattctttcacttagtgattgtagtaatttctttgccagttttggggtgtgcaagacgttgccttttttcaacttcttccgctgtgttgtaataacggtctcttatatttgtatagacagtttacaaagcactttacccgtttgttatttactttcctccttacgtacttgtaaggtggattgtgttgttctagaatccaaattagcagacagtctcagggcagtgaaatgatttacagaagtggaggaactggttttctgacaccaaatctagtagcccccactcctcagctaaacggggagtctgaagacagaaccaattcacagtccttcggcaaaccaactgtgactctaggcaagccattcttcatctctgggccatagtttcctcttctccaaaacggagctcaagatgctctttctggccacagaaataattatgtcaaaatcatattcaaatagagaaggtggcattccttgttgccaaattttagccctcggatacctcaaacaggttttcacattgggtatagagaaccaggatcttcaacctttcccttaaagattaagtccattcaggcccacaccaggaagtttgttactacaactcttacctaatagggaattcagccccactccttgaggaatggggaaaagtgcacagaaatgctattataccagagtggtagggagaagtaacattttgttaagaatgtattgttctgggtgataccgtttggcctggatgtgagaaccaataacaccctctgggctgttcccagaagagctttctaacgtttcttcataaagggtaaggaggattttttgagttatgatggttttatcaaccaaagagaaggaggtttaaactgaaaaagtgattaaacagtttcttctctttgtaggttttttttttttttttttttttttgagatagagtctctatctgttgcccaagctggagtgcaatggtgcggcctcggctcactgcaacctctgctgcccgggttcaagtgattctcctgcctcaacttcccgagtagctggcattacaggtgcccaccatcacgcccggctgatttttgtatttttagtagggacggggtttcactatgttggccaggcttgtcttgatctcctaacctcaagtgatccacctgcctcagcttcccaaagtgctgggattacaggcgtgagcccccgagcctggcactctttgtaggttttagggcagctcacttgaatcttttcctggtagctcaggtactcg

SEQ ID NO: 813 - DNA, 985 bp, Homo sapiens
cagatgggagtcctgaaaagagagccaggcgtggtggggggaggtgtggggagggggcccccttcctactaatcctctctccaggaatccctggctttgggacaggacggctgtcgttttgttgggggaggcgcccaggctgggtgcatgtcctgggccaccagccaagagaacatgatgttcccaagtgcgctggccgccgccctctcgggctggccgcctcccaaaccgctgcctctccagtctctccagcctccctgccccacattccgaggcagcttcgccccgcccccttcttccgctttgacgtcactgctgtctcccgccccctcgcctccattgacggcagcagggcctggttactgtggggacggtgaagcaggacaacaagagtcttgggagcaagcgggggctgctggagggctggagccttttgtctatgcaaaagacagggagatggaggcgggagatcaaggactgcctgggttaggggagatcacacctaaatccctgaagggggagaaaaaccatgtttccagggaagaggtatctgcaaacgagataaggccaaagccacagtatgagttggggtggagaggatcattttcagggagaggagactgagaatccaagctcctgaatctttttttttttttttaatagagacggggtttctccatgttggtcaggctggtctcgaactcgctacctcaggtgatccgcctgcctgggcctcccaaagtgctgggattacaggccaccgcgcccggcctccaggctcctgaatcttttgttttcctgtttcgatttttctgggttaatttataacacgatcttgtctcagcttttccacagagccctccccttcacccttccctcattgttcaggaaagcttaggccacgtgacagtgaggggagtgcccccacaatgattatgtcagcagctgcttggaggcctgttcatctactacccacgtttccagg

SEQ ID NO: 814 - DNA, 948 bp, Homo sapiens
agtgcaatggtacaatcttggctcactgcaacctctgcctcccacgttcaagccactctcctgcctcagcctcccaagtagttgggattacaggcatgcgcaaccacatccagctaattttgtatttttagtagagacagggtttcaccatgttggtcaggctggtctccaactcccgacctcaggtgatccactcgcctcggcctcccaaagtgttgggaatacaggtgtgagccaccgcgcccggccgtcaggtactattcttgatggtgaggataccctagtgaactggaaaacagggcagcccctgctctccgggaactgacattctggttaggggagaaaggccatgggctagtaaacaaatggctctatcatctaatttcaagcagcggtaagtaaatgaccacccactgaacagacaaggaacagcttgagcttagaggacaggcttcccttcagccaggacattcagtcacagacatttattaagcactgggataagtactggagatcctgttgcccaaacagatgtgttcccttctctcagcaacgcatatgtgacccccagtccacttatactgggcctgatgagtgatcctgccctgtttctcttccatgtgtttccagtggaatctattcctggctctttggggccagagccagatcctggcttccctccttggcagagctggagctccctggaaattggggcctctgtttataggtgcctcagcttccctgaggaggaagggcccatgtgtcactgcttatcaggctcccaggccaggggcttggctggggagggtgggggcactggccgggcctatctttggagtctcgagaatgctggccacagggctgtggtcgtgccctcagctctctaggccataggctttggcagccccaccctgccttgtcgggtgactcaggcagaaatcagagagg

SEQ ID NO: 815 - DNA, 1357 bp, Homo sapiens
cggtgatatttaggcacgtaagcattatcacctcttccattgtttcctcccatgttgggcactaacgtgcctgcttctagctcctctctcccagatcccctttgagaaatgtccatgaaacgttgcttatttgtaaaacacagattgacttaatacattcaacggacgtgtacctgtgttagatttacatggtaaaccttttgtgtatgtccatacatacctagtgcagaatcagtttgcgctaatttatttttcaacgaatttcaaagtggaaacttaggagacggtagaaaagacacatgttaaaaaggcccaaagaatgagtcgatcagatggatcttgaagtttatacttagttcttggctggtaatgcttgatataaatgtattttgaaatgtaaataaacggcagtactagaggaaagagtgtataggaaaggactttttgatattaaaaaatgaaataaaaatgtctgtatgaatgttctgtaggagttaacaggagttagaattatttttaggaggagcacatccctcttcatgcagtagataactataggcatcaccaagcatcacataaactaaaaatataaacaaaaatgaactaatgcaggagaagaataaagaactatgctttacgaagtgcagaacatgtagtgcttaatatgttggtgattgtcattggcaccccagtagattattatagaacatcagtatgctttaactagagtgagggcagctaacaccctgttctccatttggaacctgtgacctcagtccgtctagaacatgtgaattttctggtggttactttagaatggaggcccttttaaataaatattgcagtggatggtattgcatgtggaccattgtcacctaagaaatgactttagattgagagagatttttgcaaatataaagtacatgaataggcctatttattattcattcatttctttaatagttgtttatcatttcctcaaccaccattaagttagtgcttagagtactgttctaagctttgaggactgaaagtaagatatttgagggtggtctaaaaggagaagattatacgagttacagattattagagtatgaaaaatgctacaaaaggtactgagaaaacgctatgggagggatacacagatgagaacacttaattcagaatggattggggggaatttaagcaggatttctacgttaaggaatgcttcatggaggagaggtggttggcctcagggagcaccttggcttcttgaggttaggttgtcatgttgtcatgcttctttgaaacaattggtgacatcataaccaagctgttcctgtaacattaaggaggttcatccccttttcttgtt

SEQ ID NO: 816 - DNA, 1071 bp, Homo sapiens
ccagcttatttctctgtccccttttcttctcatcatcttccttggaatcttcgggggaggggaaagcaatagttgaggaaaaattaacaagccaatgaaaggtcagctcggagactttctgaaccaagaaaactctatgtggtgcagagggcaaattaatattaatatatcagggaattctgataccagttaagctcctgatttaagaggtttttttttttagtgaatgttcttgatgacccataagtatagcctgcactttgttctgtctactacacatgtcttagtgcaaacaccgtgttcagagaggttgtgtcttaaagttaacagaatgtcctgagatcattattgtctcccacctaaagtgagatgaagaaaaacaccatcccgggctagtgcagcaggtttacttagttctattggtcagtactttgcaatataatggctcttgtacacatattatcaccactggaatccaccaatagagcaccacaccatagccaaaaatgttggctgttcagtggcataactgccctggaagccgggaggaaatcaaggccttcagactgcatttggctggggccttggccagggtgttagtgccaggcacctggttaagataaatgtcctgaagcaaacaataattaccttctttgctgataagaggccccagtacttttccaatagcatgattgcgttaggatctttctttggaccacagcctgtggagcactgattcatgggtactggccttaacttcatccaaactgttgtatatgtggtggaacccaatgttctcctttggtcctgagttggtgtaaataatattcccggttgcatcacctgtccctgcccctcttgctccttctggtggaaattctgcttttgtccaccaggtggcctcacttaggaaggagcagaagaaaaggacctcaagtctctggtgcctttattttttttccctcagcttgaggctgaatataaataagatatattttaatggaaacgtgtaacttttattatggaacaatcacctcatcttgtttatggtttggagtctgtttttcctga

SEQ ID NO: 817 - DNA, 1081 bp, Homo sapiens
cttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaagtaaggggccaagaggggcacctgcaggcagggcctggggaagagtgggagcagaggggaggagaggtgaagagactcaggaagagcgttgggcaggactctaggagtccagggtccaggtttcagctcactctgtgccaccagggtcccctggtggaaaccatgccccttccccccatccccaccccctctcagcctgaacagactcccccaggtccacatcccctctcccataacccccattgtccaaagaaggtgggagcacttttagtccccctgcacagatgaggaaactgaggctcaggaaggcccaccagccacatgcctcctccagtgaggaggtcaccctcctccctgccagactcagaaccgcctcttcccccaggactcccttctggactgatggcctcctgctcctgccccttcaccagtgcaggcccagcctgggccctgctgcccagctagaggggctcatggttccaagctgggcggcccagaggtgccacagggacagagctggaggggtggctcctagggccattcctgggttgtgcctcttatcagtcccttgcagttccaggggaagtggtatgtggtaggcctggcagggaatgcaattctcagagaagacaaagacccgcaaaagatgtatgccaccatctatgagctgaaagaagacaagagctacaatgtcacctccgtcctgtttaggtgagggccgacatctcctgggggtgtgagagtcagactgacgtcacaggcaagggatggccaaagctgagggatcctgtcgttcacctcgctgttctgcccggaattcatctgtgttcatccttcctctgttccttagagcaacgtttatagcacatttccatgcagacacacagacagtggtggggatggacatgcacagtcgttagaaaa

SEQ ID NO: 818 - DNA, 1174 bp, Homo sapiens
gcatagcaagaagcccatctctattttttttttaagattctgacaaaggcttattaaaaaaaagagaaataaaaattttaaaaaagaaaaggaaataggatgttactgtaacttaaaaaaaaaaggtatcaagaaattcctagttttttgtaaaatttgacccaaatttatacttatgttaaagtagaaggaatcatgtcaacacgacattccaactatccagaattattgacagaggaaaacttgaatactgaactcattggccatacgaatttattcagcaaaatatccttacttgctttttttctcaaagacctggtgggaagccctcaccagctacatagaaaggccataatcaaataaacgtcatggtgcgagtgttctagagctctagccttacttgcctacaaagtaagtctgtttatcaaagatggcaccagtggaggccacaacactgtggaaatttagatgatctgggatagactgtcgctataggcaaatttaattggtttgaggattattcagaatcttattttatcttgaagggattgtcaggacctagggataaagaggtccccttcgttactcccagacacagagtcagaattagctgcttctgagatagagtcgatgtgagaacggcttgctttttgccagagcattcacctgaagcatttgatatttagtcaggctccggaaatgaaaacttgaaaaaatagtcaatgcggttatgttgtatactcttaaggactgccaaagtcgtttataatggagtgagcaaacacgtactgccgtgttttaagaccagacatcctgtgcttccaaagcaactgataaatgagtattcaagtactggggagaaagaaacaggaaatgacccttggggagtttcaaagttttaattatgttactatcctccactggctttctccagaagctgatagttcatacagttgacttattttgcgagtattttgaactttgccatagcaaattgtaaccagtagtgtggcttaccccgtcagagctgactcatgacctcaaaactgcagaccagctttgtgactaatcacagccaaagaagccaaacttgtaacagttcttttttttggtttttagttgttaaagaaatgttcatttctacaaagcttggctgtagttcgttggctgtagt

SEQ ID NO: 819 - DNA, 1460 bp, Homo sapiens
gatacgcttgactttctgtggctggggtgagtgagggggcagggaggacgaccccggagttggtgggagctgcagaaactgctgaaaacttcagaatccatttcccccacgtaaacttggcaccgcagcagcagcagttgatagagtggcactaggctgctggcatgcaactcggctcacggaaaagagcaagagatccgaaactgaggcttaggacaaagtgtgcatgatattggtggtgtaacatgttggagaggacagccgagaaattgggttgtaggttttttttttttgttttccgacagagtctctatctgttacccaggttggagtgcagtggtgcaatctcccggctcactgcaacctctgcctctggggttcaggcgattctcctgtgtcagcctcccgagtagctgggattacaggcgtgcacaaccacgcccggctaatttttgtatttttagtagagacgggagtttcatcgtgttggccaggctggtctcgaactttgtacctcaggtgatctgcccgcttcggtgggttgtagcttttagcgggagctaaagggttctgggatggaggtgggaagtaggatttggccggctgagtcttctagaggcaatattggggtgttggtcttccccaaggggaagggtggtgaggctgagggagaagcagttatgttttcagctgggcaaacatggacggttgcccgtagaaactttgccactgtacttcagaacgttgccctagtcgttggaggagaacaatgtgttccctttctagccaccctggtccacggagggaggagggagagagagaatgtttcctcttcggctgttgtggcttgagagtttctcttctttcggaggttttgtggtagtggctggcagttattagtatgcctcatggcttttaaatttccagatctttttgatttagaagtggaaatttcctaattacttgacaagtcttgtagaattccataatgttgtgattcttgcccactatcttaagtgagactttgcatgagacctatggaaattatggcagcattccccttagaatctggcttgaatcagcttttgtgtaggaaactgctagccttctaaaaaaatatattgtaaccttgtttcatcctcaaatctaaatgtgtaatgagttttcttttggtggggaggggcggtgggtttgagttaagaccacagctaggatgaaagacaaagagaaaaacaaactgtggaagccaagcctgttctgtggctggattttacttatattggaagaagttctatgttttgtaaatttgtgtattggttttgatttgtttcctctgatagtttagtatttggatagtttagtgttaacctcagctacactgaaggaatagaccttagtcctcacaagtataagttctagcttggaagcctgggttctgcagtagctgtggaacttaagcc

SEQ ID NO: 820 - DNA, 1075 bp, Homo sapiens
atcccttagagagttattccggcgcccaccccacctcgcggatagatccagccggagttaaaggagggcacctccgggtgggcgcggtggctcacgcctgtaatcccagtactttgaaacgctgaggagggtggaccgctttgagccggggaggtcagaccagcctgggcaacacagcgaaacccagtctcgctatgtttcgaatacaaaaattcgctaggcatggtggcgggcacctgtcgtcctggctagttgggaggctgtggcgggaggatcgcttgggccccggaggtcgaggctgcagtgagccaagatcgccccactgcactcccgcctggacgacagagcgagactctgtcaaaaaaaaaaaaaaaaaaaaaaaaggccgggcttcgtggctgacgcctgtaatcccaacactttgggagcccgaggcgggtggatcacctgaggtcgggagttcgagaccggcctggccaacatggtgaaaccctgtctctactaaaaatacaaaaattagctgggcatggtggcggacgcctgtaatcccagctactcgggaggctgaggaggatcgcttgaacctgggaggcggaggctgcagtgagccgagattttgcgccactgcactccagcctgggcaacagagtgagactgtatccaaaaaaagaaaaaaaaaaaaaaaaaaaggaggggacctcatagccgtgcaaggtggagtgaggaaatgcggatgtcctcaccactcgcctttaaaatcgcgcgttgtcattgctgcctcgcgtaaaggttcccccggcgctcttcacccacagcgccccgggcgtacaatctcgccagcccggagcccaccgcacgcatcctcctcgcccggcgcgcagcggacagcctcctacgtcacgccagcgccgcgcggcaaggaaggcccccttctccgcctccgcctcctcccgacgccggcgccgctttctggaaggttcgtgaaggcagtgagggcttaccgttattacactgcggccggccagaatccgggtccatccgtccttcccgagccaacccagacacagcggagttt

SEQ ID NO: 821 - DNA, 1066 bp, Homo sapiens
aaacgtttttgccacatctctgtgggaaagtaggtgagtcagaatgagtgcataatatataagtatatattttaatgataatgaatgtgtagattaacaaacccaaactttgtttttgtttttttgagagtcttgccctgtcgcccaggctggagtgcaatggcatgatcttggctcactgcagcctctgcctcccgggttcacaggattgtcctgcctcagcctccggagtagagtagctgggattacaggtgaccgccaccacgcccgactaatttttgtagtttttagtagagacggcgtttcccatgttggccaggttggtcttgaactcctgacctcaagtgatccacccgcctcggcctacccaaagtgatgggattacaagcgtgagccaccgcgcccagccaaacccaaacattctaaaagcgcagagtaaccgctcccctccccgccaacggtaaccagcatcttcgttctccaaccagaacagctgtatgcaccggtgtataagcctgccttaagtgctatttttaatcttttttaaaaacaggccttaaaataactcatttgggtacaactccagcggctggtggagtgggcttaatatattaaacagctgttaattttggtttctttttggtaacagcgacacggagatccgcatttgtcgcagtttccaccgcgggcgggaagtgtaaacacaagaaatacaaacatagcgcaacggctaaaggagtgtcacagcgccaaaccttgctggctccgcgccaggccgagccccaccctctcagctcgcggccaacacccccaccccgcctcacagcccgccgcgcccgcggggcgacaccccccactccatcatcccggaggtggtgcggccgagccccggacccaattggcggaagcggggccggttgtgtgcgcgcgcacaaatgcccggatgcgccgcgacgacccgcgcgctcccctcgggcggtagggggcgcgcaccgaggcaccgcggcgagcttggctgcttctggggcctgtgtggccctgtgtgtcggaaagatggagcaagaag

SEQ ID NO: 822 - DNA, 914 bp, Homo sapiens
ggactccaaattttaaccaagggcagatgtgcatggaggccaagtcatttccttcccatgctctcatactgacccaacaaacccattctgcacgtgagaaaactgaggcccggaggagggaattcacacacgtttgaagccaagctggggccagaaagtagatcggctgatctccaaacctccacgtcaaaggtcttcccaggaggacatatgccttcaaggattttacaatgtataccaccctacaagtgatgggagagaggggaaaaaagcaaccgactaaggagaaaagcaaggagcagaaaaaggagcaaaagaggagctgtcagaacggtgtgaggagagtgggaaaggagccgcctccttttgcctctcttcctacttattaacaaaacagaacgactatccaacgtatttcagggagctaagtcttagccagcttcagctgtgttttaacccttagctaaatatagacaaggctaaggcaggccaggtgtacacttcaggaagacgtggaaattcccagggcggaccaaaacttgagctgttccggcggtagtgatttgaggtcagtttgaaagagaagttgagaaagcggccgaggggcgaatttggctgcactacacgctcgccacaaagaggaagggccgccggccgccggggccgagtgcgcttccagcccaggcggagcggtagacgcaacagcctccgcccgccacgtgacccgtagtgttgtggtctggcccgcgtgggtggcgggagcgccgagagggcgggggcggcgatggggcgggtcacgtgatggggtttaaatctcccgcagccggagccgcgggggcgccagtgccgcgcgtcgagcgggagcagaggaggcgagggaggagggccagagaggcagttggaagatggcggac

SEQ ID NO: 823 - DNA, 1781 bp, Homo sapiens
ctgtaatcccagcactttggaaggccaaggcgggcggatctcctgaggtcgggagttccaaaccaccctgaccaacatggagaaaccccgtctctactaaaaatacaaaattagccgggcgtggtggcgcatgcctgtaatcccagctgctcgggaggctgaggcaggagaatcgcttgaactcgggaggtggaggttgcggcgagccgagatagcgccattgcactccagcctgggcaacaagagcgaaactccgtctcaaaaaataataacaaaataagcaatcgtcgcgtcctttctatcctggtcttagcttgcgctctgccataaaactccctctagccgaacccggcccagccctagagcaatccgttacttccggggcgctcagccggcatgcaaacactcttggctacagccccatctccgagtgcgttcggctatttccggaaaccgtcggcatctaggctcaagtccgctaaattctagtgcccgtaggggtcgagatcgttggctgtttccggacgctctgggttgccatggaaactccttcaaccctggctttctccgacttctgctttttgcggcaggccctttccccactctactgccccctgtttgctgagcttgagaacgcctcatttgtcccctggaaccatctatgcttcagtaattcccataagctggcggtcgcctctgggtctaaactcccaaggcctccattgggcactgagcacattcggttatttccagaaacgctccgcggtcttggggatcagcctcagttgtgccagtgcggccgtagagagtgttcggccatttccgaaagcgctcgggcgtctctaagcccagccgagcccagtctcggatccctcgccgacccgattgcactcggctacctctggaaacgctcggctgtctcgggggcaccctctagtccaccagtcccgcgggattacgttcggctacttccggaaacactcgggtgcccccttacctcaggctccgcctcggcctcggttcatccgcccggctcgaatgcgctcgggcatttccgccgggggcgggccaggccgctcggaaccgtggcggcggcggaggcggggatcccgcggctgcggcgacggtggccgcggtggagccacggggcgggcttggcttggtgtgacggcggctgcggcggcggtggcggccgcgaccaggtgagtcctgactggccctcgtggcgggggcggctgggagtgtgcttaaatgcggggcgcccgggggcagtgccgggccccggtggaagccagaacgcaagcgccaggctgcgtcgggccccgcgggaactgggggggccgcaggcaagggggggcctcgggctcggctccgcagcggtgcagcctccttgggacggtcggggcagaatggggagagactccccgcgtccaagataccggactggagccgaggccccaaatgaagggaggccctgcctggaatggggcttcgaatagtaccgaggggcgcccaggcattgtgcggggcagaatggggtgcgggagggccgggggtcgaacccacttccggtcccctagccgggtggccgggtccacgcagacccaagtgcgcgtctgtgtgagcgctcaggccctgccttcacccgcggagcccccagccctgcctgccccgcccctcccgcctcccggattcggggagcgctgctcccggggcgcgcacaccggggcgtgggggcgggctggcaggcagatccaggcggttttctgggcatcccctct

SEQ ID NO: 824 - DNA, 1086 bp, Homo sapiens
gggagaaggaaaggtgtcttcatcaatgccggggcagggtagatggagccctgggcagggagtttggaccaggaaatctcaatgagggaaatgtgctgtcctcacctctccaagaagcgactggccaaacagagtgacagaggggataaaggttatgcctagggaggcatgtgtcagaggctatcatccactctgttgaacccacagtgaccagcaccaccatcacacaaacatgcctgcatgtgtgcacgcacgtgcagtgtgcaaacctgatgtcagcctcactccctggctcttctgtccacaaacgctgtttctttaagtaccactttcagttcctccaaagaatctacttaaactcttaaattcctgatctctatagattttactaaagatttcaaaggagataagatgagagggttacgttgcacattctaaagcaaacaaattaaaatgttttgttagacatttccatatttttaagggcctccttggagctgccaggctgggagtgaggtttctctccctttctaaaccctgtgcccatcttgtcaccctcctggagctgccagcagacttcagattcttctccgatctacagagcagaaaaattcagccagcccttccttgtcttcctatccacagctgcctgcccagactcatgaaacctgacaaaatgcaaggtcttatcattacctgaaccttggacctgttcaaaaatactagttcctgagaataaatatccctggtgtcttcctgcccttcctgcacacctccagtggcttatcaaaatatttgtttcatgcgcacactgggctctcatttaagaggaatttgggagaatgttattttctaatctgcatttcacaccaggctccccctccttcctggggtgctagtgtcagcagaacctgatggggaagtgaggtctgggaggcagaggaggaaggaatgaggggaaaggggaagtttgggaggaaggcttctgagaagactggtgggagagaaggagagcctgcagacagaggcctccagcttggtctgtctccccacctctaccagcatctgctgagctatgagccaaac

SEQ ID NO: 825 - DNA, 929 bp, Homo sapiens
tacgttggttctttgcccactatggtccaaatcgaatgtaccagtccaaagtccctccttcaaacaaaacgttccaagatgatccctgcccccacgtcttcaaagccggaactgacaccttcctatcccaaatgcttcctaatcaaagagtctttcaggggctcaaatcattctctgccttgcacttgaaaaggctcatgtccccgtggggactgtgagtcccaatgggcgggaccctggtctgatttctgtgccattcctagacattgtggcccgaatgtatttaataaatacccttttgactgaacaaataagtaaatgaaagcttctgggaaagtaagagaggctggtaaggctctcatcaccttaggggcttcactcacattcataagagacctcgtggggaaactaaggttcagggattgcagaggcgtattgggggcgcagggggcgggagcaagacaaatgggcggggcttaccgtgggggtggggcttacctgctagactcatgtagattggctggcgggagcggaagtgattcagagcgcccccagagcagttctgctcttcgcactgcagtacgcagtcgcggtacaccggctcacggtcgccctgggagccgctcgccagcgccgctgccccagctagcaggaccaaccgcgccgccaggccggccatcctttctccctggctcgccgccgggggaggagcttaggagtatgaagcttccacttccggagtaaccggaagttcctgtgttctttattctactctccgctgaagtccacacagtttaaattaaagttcccggatttttgtgggcgcctgccccgcccctcgtccccctgctgtgtccatatatcgaggcgatagggttaagggaaggcggacgcctgatgggttaatgagcaaactgaagtgttttcca

SEQ ID NO: 826 - DNA, 901 bp, Homo sapiens
tgtgtctgagtccttgctctgaagatgtctgatttgggttttttttctaggtataatctctttccctcctcttcctcctcctcctcctctcccttctctctctctctgagcctgtagtattttccctttcgtgttctgtggtatcctcctaatgtccctagttaacaggacctcatccatccatccctggggtgttcagtggcctcgcaatccacgtccccgcccagatccgcagccttcctcctgtgacctgagtgtctcctcctcgctgtccctgttctgtcccctcccgccctcacatgcaggtggatgtcaatgcgtgcacgcacccaggttttcttgcctgttcccacctctttatcctccttggctggttcctccgctccattctctggctcaggaatttgctccccagggtttttcattccgctctgtagcagaatgtgctactgttgctttccagcatcaaacttttcactcccatggcctctgtgttcttcttcctaatgggtgccctttctgcctggcgctcctggaggccgggcccctctcccaagtgtgaatctgatggaagcaggtccttctcgccgggacctcatgtgagaaatgacatgtcccacctgtctcaaggggccgctctctgacatcagagctgctgtagagcggagaggggcaggggtgaagggccacggtggtgcaacccaccacttcctccaaggaggagctgagaggaacaggaagtgtcaggactttacgacccgcgcctccagctgaggtttctagacgtgacccagggcagactggtagcaaagcccccacgcccagccaggagcaccgccgaggactccagcacaccgagggtgagtgtgcagaggccccgctatgtccacggtgatttttg

SEQ ID NO: 827 - DNA, 1001 bp, Homo sapiens
actcatcagatccacgtccaagtgcctgtaactcttctagtcatcagccttgtgacgttaataatgtcacataatttcaatgagactcggatcgaaagctgcacctcactagtatttaggaagatggaaggctgattctgtgcggggaagtgcgcggaaaactcttaagtcccctactcaccaacctgtgccaggaggcgtgacgtaagtccgccgcgggttcgccagcaccttgccatcccgcaccacgcccacgccaatcttattggcgctgccttcaaaacccagcaccgccggcatggcggaggctgggagaaaacgccgacaggactcctggcaatgtcaggagctgtggaggtcctcactagtccgcgctgggccgcagctttccggagcgcagaggaagctggccagcctgcagatagcactgggaaagacaccgcggaactcccgcgagcggagacccgccaaggcccctccagggacctgtcttcctaactgccagggacgccgagccaactctgtgccttacattcgtatccgttttcctatctctttcccgtggtccagcccagccttctccactgtttttttccctcttgcacatagttagaatcttaagtcagtgtcacacaatgtgctgtgcatctggcacaacgataaacagcccgagggagggttggggacctaagtgtcctagagaattagaggagggaggcgaggctaagcgtctccgtcacgtggtgtcagacagaccaatcacgcgcattcttcggccacgacaagcgcgcctctgatcacgtgaccaggtccgctacccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatct

SEQ ID NO: 828 - DNA, 1078 bp, Homo sapiens
tttgaatatagcccttcgggattggcggggagaagggaccgcgatggaaaaagtcatcatccaaagaatgaagagggaggatccaacatttaggatattttattgacttgctaggcgcgtttaccttatcttcgtattaaccccattttcttcattaaccaattgatgctgtgagaagctatgtaacttgacgagcagtgcccagaactgtttttttttttttctggactcggtcttttccactcaaaaccaacaaaaaaccaaaactcgttcttttccacatcaaaagcaaacaaaaaaccccaaccccaaccccaagagccccactctttcaaaagggcttctccggatcactaagtcctagaggtctttggctaggcctgggtccgatctaaataggaaggtaattctagtgttccgcaaatccttgccgaattccatcccggccaaagcagggacccgggggagcctctggtcgcacccgagacagttcgttaaatactcagtgcacgtgctggggatggaagtgctgacccactgctcaggtacgcgcgcacctgacgccgcttggtgcgcgccgcggggtactgggtacgtgctccgcgcgcgcgcgcccggcaaagttccccgtacgtgcgccgtacgtgggcgcggtgccccagcgctcagcgtttcagcgagtgagtgggctccgtgcccagctgaagtctgggaggggcacttttccaggcggtcgcggctccccctggcggcggatgtgcctcgctggaggggcgcagtcaggcgttctccgcgggcagccggcggcggggccttgccttacagcgcggggtcctcggcggcctgggtggctactgcccctgctgctgtcgtaggcgaggacggctgttagtgctgctgctgttggttcgtcgcggcggcgaaggaggaggaggaagagggcgaggcgacaagagaagaaggaggcaggcgcggcggcagcggcggcgccccgagccggcggaggcgaggggggggaagatggcggacgtgcttagcgtcctgcgacagtacaacatccagaagaaggagattgtgg

SEQ ID NO: 829 - DNA, 1029 bp, Homo sapiens
tcttaccccactatccgatgagacatttgatagggaaacctctgaaacttgtaaagcaatttacaagcaggccacctacttgtatttaacaaataggctagaaatacctatttgtgggaaatcgagtccccaaaacaccccaacccctccgggtccccgccagcacagcctctcttctgactgtcgcgcgaagcggcggttgactaacgcgagccagccgttctgatgaacacaggagggccggacggccctgctggctcggacaccacgcggagggagagtgctgcctgagccacagttgaagaaaccgctctcgggctggacgaaggcggagcagcagctcagactgggccaacagaagagccttacaatgcctggagcagtccgaggacagcccccggcgcgaggaactctgggacttgtagttcgctttcccagacagcgcttttccccacttggtctccccgcctttcaatgtcgcttttattcttccctttacctcccagcccgccgacttcctggtcgtcgcacgtcctcacgtatgactacactacccagaagtctcctcttcacgtcccagcgcgggtgggcgccggcggctcctcttaaccacaggttccagaagtcctctgcagaagtgcttccctctctcatttccaggaccacaattcccagagacttcggcttcacgacgtttctctttttgcccgatctctcccggagctggctgggcttcggccggccagaggcccacagcgacgacgtgatccgtcgtgagcgggtcccagggtttcctcggcggcccttttttctctcccctcggtcgtcccccttgcaggctgtcgcggctggcctgagcggtgacctggcgggtcgcgcctgcgctctgccctgtttcctgcctggctggtggcggcggccattttgttcatcctcctcctcctcctgctcctcctggttggagcgcagtgtccggagcgggctggggggagagagcccgagagcagggttcggtgccttttcctctgt

SEQ ID NO: 830 - DNA, 700 bp, Homo sapiens
cggtctagataagaactgaggtctccagacatactttatgcccactcagttttgtcttttgccctagttgctaaacaaaacttaactttgctgtgcggtgcgacttcgttaacttaaaattacaggctgtcagctatgaccgctagactctaagaaagtccagtggaaatccttcaatgaaaagaatctgttcttgggtggaagccccgctcatgcaggaggaacagagggcttccattctcgcgtcacacaactgagggtcaaccccttgctccctgcagtaagcctgattagtgggcggagcttccttcaggatcgcaagaaagaaaggaggaaggggaccccgcctcctacgtgctcgcgggggggggcggggtcggtggactgggcgtgagttaattggctggggggcggggcaccacgggttggctccgcccaggcgctcgcgcggatcccgggtggaatgacgggagggagtcccggcagctcctacctcccagcgatggcgtcgctgtgccgcgcccagtccccagcctgccggccggtactcaccgctacccggagttcgctcagacggtgagatttggggcgggtccgaggcagcggcgggacgctacctgcgaccgggaccatgaggagctgccagacccgtggggccggtaacgagagcagtcgcggcacctgctgagaggaaagaggg

SEQ ID NO: 831 - DNA, 1093 bp, Homo sapiens
tgtttgtaggaggaaacacagcaatcacactattaatagtaaattaaaataaatgggcaactgctgcatggtaatacttttttttttaaggcaaaaaataaaaaatagtgaaacagagaaacaaaacatgaaacaccggcagtcaacaggcaggcaaagaacctgggggtgggggtagcagcggtcccaccctcaaaaggcccgggctgcccagaccaagagaaagcgatgaatctcttctggtaacgtcccttcctgtcgcatggattcaaggccgacctgccccagcaccaccaccagcagccttctgctggggccggcacagctgggagcaacctcctactctcaggcagacgcgcagcaccaagcagagaggcccggtgcaggatcccagcgccgaaccagcgccggctcagtggacgcggaaggggccggcggccgcggccggtcccatcccccactgcagacccccagcctgtggcggtggtccagttccgccaggaaaccgccgcctggagctgtgggtcgcgcacattaacgcatccagcggaaaaatgaaggagacccaaattcaaagttaaagtaatggtgacccgagaggtgccttgatgagaaggtttggggtcccggttactgatggttatcattcttacgagatgctggtcacctacgaagggagaaaggcacgaggagcgcctgaccaaagtggttttgccctgcttcccgcaagaggtggcacccacggctggaacgcaggagtcagacccacagtccccagctctggacgcccgcagcggggcctcgaagaggttcagggcggtgcccgcggcgctcgggccgggtctcccggggcgtggggcggggggcggggttgggcggcggccggggctcctccctcttctgccccgggctcccctgctcttaacccgcgcgcgggggcgcccaggccactgggctccgcggagccagcgagaggtctgcgcggagtctgagcggcgctcgtcccgtcccaaggccgacgccagcacgccgtcatggcccccgcagcggcgacggggggcagcaccctgcccagtggcttctcggtcttcac

SEQ ID NO: 832 - DNA, 1096 bp, Homo sapiens
actgcagtatcctcccaggaaaagcccttttgtgcgtggaggaggcagatggcgaggaggcagatgtgcactttttttttttttttttttttttttagagacagggtctggctgtgtctcccaggctggagtgcagtggcgagatcaaggctcactgcagcctcgaacttccgggctccagcgatcctcctgacacagcctcctgagtagctgggactacaggtgcacatcaccgcgcccaactagttttttaaaattttagtagagataggctcttgccatattgcccaggctggtctctaactcctgacctcaaatgaccctaccgcctcccgaagcgtcgggaccacaggcggcgagccaccggccggcctctgtgtgcaccgaggagccgggcagccaccgccacgatccagctttaggacatttccatcaccccactcagccttcctgcgcccctggttcctcatctataaatagagataatatacgcctaaccctctaggtcaccagcacattgcacccataattattatacttgttgatgccacactttcaggttttaacctttccaaagcgcagccccgccccagcgcagcccaagtccctgcacgcagaggcgccgatcacgggtgggaggtggatcccggaggccccgccccaggccccgcccctccgtgcgcccaagctcgaccgcctgaaatcggggaatcgggcctctgccggcgccctggcagcggcgcggggcgtggctccgggctggattggtggcgcctgggccccgcgagcgcctgcgcagtggtcaaggccgcgctcgcgccgaggggctgcgagagtgaccgcggctgctccagcgctgacgccgagccatggcggacgaggagcttgaggcgctgaggagacagaggctggccgagctgcaggccaaacacggggtgagcgcatcagcccccgccaggcttggccctcgcggggcgccgccctcgcccggagtgtagggcgcgcctccggggcggaggctctgggcgcctccccggggccccggtcccctgcgctgccctggcggcctcgtggccggctcagaggtggcctcgtc

SEQ ID NO: 833 - DNA, 1076 bp, Homo sapiens
ccatgttgacagaccctcttctcctaccttgtttcccagcctgactctccttccgttctgggtccccctcctctggtcggctcccctgtgtctcatcccccggattaagccttctccgcctggtcctctttctctggtgacccacaccgcccgcaaagccacagcgcatctggatcacccgctttggtggcgcttggccgccaggaggcagcaccctgtttgcggggcggagccggggtgcccgccccctttcccccagggctgaagggacccccctcggagcccgcccacgcgagatgaggacggtggcccagcccccccatgccctccccctgggggccgcccccgctcccgccccgtgcgcttcctgggtggggccgggggcggcttcaaaaccccctgccgacccagccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctg

SEQ ID NO: 834 - DNA, 919 bp, Homo sapiens
acaaagtcatttagaaagcccccgaggaagtgtaaacaaaagagaaagcatgaatggagtgcctgagagacaagtgtgtcctgtactgcccccacctttagctgggccagcaactgcccggccctgcttctccccacctactcactggtgatctttttttttttacttttttttcccttttcttttccattctcttttcttattttctttcaaggcaaggcaaggattttgattttgggacccagccatggtccttctgcttcttctttaaaatacccactttctccccatcgccaagcggcgtttggcaatatcagatatccactctatttatttttacctaaggaaaaactccagctcccttcccactcccagctgccttgccacccctcccagccctctgcttgccctccacctggcctgctgggagtcagagcccagcaaaacctgtttagacacatggacaagaatcccagcgctacaaggcacacagtccgcttcttcgtcctcagggttgccagcgcttcctggaagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttaca

SEQ ID NO: 835 - DNA, 1012 bp, Homo sapiens
gttgtatttttcccttcccttgcagtagaccgcggtccccaggcgaccgcgaaagaaaaaaaggggtttctctacctcgcgtggtctgcacctcgcttcgcccccgcagccctcgctgggtcgcagggagcacgtgggccaggcaggctgggtgggagtggagtggagtggaggggagggggcggcggccagcggctcgcgcggagccggtctcccgggcttacgtaaggcgcgagtcccgcgcggccggccggggctccgcgactgggcgggcggaggcggcgccgccctgcaggatccgggctggaagcctctcggagtgctgcctccagccaaggtgtgtgtttatttgattgcttttggtggcgaggcgcggggctcgggctcgtcgcgcgccccatggccggggagcgcatccgccaaccccgggcggaggtgggcccctccgagcgcgcgcgggcggcgggcagcggcggcagctgagactccgggggatgtgacagccgccggggaggggacgagacgcagaccacacgttgcccacgtgcgaggaccgggcaggggctcagcccctaggccgcccggtgcgtggggcggcgggggctggctttgagtcacccccgcttgtgccagcttccccggctcggcggagactggcttggggatgcctggccgcccggcccccttctcggacgcggcgtggggagcgagctggagttaaggatgaaggtgggactggccgggccgacctctgacccctggaggccgagtcggcagggcggggcacggcgcgcttcagcagctttgcgtgggggcgaggaggtggaggagggcgaggaggtggagaagggcggggaggtgtagcgtggcgctcagtccgcctgctactcggtcccggcgctgggctgaggggaggggttgtcttaaaagtctctccttccccctgtaggggcggccggcgagtcccagtgagagcggagggtgccagaggtagggggccgagaaacaaagt

SEQ ID NO: 836 - DNA, 909 bp, Homo sapiens
tgtctgtctgtcaagtcaggagggcagccatgaacgttctgatgtctactgagcacgtgtggcccagaccgtgtgtcaggtgtttaggtgccatccacagaaccttcctaataaccctgggcagcataggctttcttatctctgacagatgaggaaatggagactcagattctgaaccgaagtcacagacacagtagatggtaggtctaaatggggacccaggtctatctgactgcaaagtccaaaccgtttccttgcctctgctgcagcctgcgaggagcagctgggcagaaagactgtgcctttacggtggtgagtcttccgatgcccaagcctcaccccagaccgatgaaatcagaatctctggagacccgacccagacattggtgggttttagggctcctggctgattccagtgggcaaccgggctaccaagcactgttttaccctaagggtaagaggaacatcgcctcctcgagggctctccaggtgtgcctttcacagcgtaatcccgttcacgaaaccaaaaatcaaaactaggccactgcccactggtggctgatacgcccttttctcatcaacagaaccgggaggaagggctctggtggggctggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggct

SEQ ID NO: 837 - DNA, 1142 bp, Homo sapiens
ccgtgaccagcagttatttattttctttggttgtgtgtgtgtgtgtgtgtgtgtgtgtgtgtgtgtgtgtgtatgtatgtattgagacggagcttgctctgttgcccaggctagagtgcagtggcacgatctcggtgcatgcaaccttcacctcccgggttcaggcgatactcgtgcctcagcctcccgagtatctgggattacaggcgtgagccaccatgcccagctaatttttgtattttcagtagagacggggggtgcgggtgggggaatttcaccatgttgaccaggctggtctcgactcctgacctacggtgatccgcctgcctcggtctcccaaagtgctggaattatgggcgtgagccaccgcgccgggccagctattgattttttgaaaggatttttaaaaaataatgttgctttgaaaatttttatttatgactagctcttttggttaaaacttggctatggtttctctggagtgatcctgagttggataattttgggaaagttagagaatctaattaaaaacattttcaaatgcttattaattgtaacaaaagagatatcacaggatccataaagagcgctagcccgaaacgtcttttgatgcagtaattcctgggcaccggcatcgctcacattctcctctcagaattacaccgggaggggtcgcgaacctctgctagccgctctcgctgcgatccggagatacccagacaccggactccttgagttcacagcccggatgcagaagggaatcctagcagcgccgtaccggatgtgtgagtggaagtgactgaggtgaactcacgaccgattggttctcccgagtggacccaagcctgttttcacctgccactggccgcgtggtttgtctatttgaacagtccccgccccctggagaagccgggtcctgaagcttctcttcttcattactattggcctgtttttcagtccatcttctccctatacctgtcgattggtcctcagggctgggaaccctccttccctcgctcccggcttagaggacagcggggaaggcgggcggtggggcagggggcctgaagcggcggtaccggtgctggcggcggcagctgaggccttggccgaagccgcgcggtgagtctagggcctggcac

SEQ ID NO: 838 - DNA, 986 bp, Homo sapiens
tggaactagaactacagccctggtctgcagcatcacaccagacccagatgcctcaaaaggattatatgttaaggacagtctgctggtctgttggcacctaaccttttttgggttatgaatccaataaactatgagcagtttgaacctttctcagaaaatgcaaagaaaattatttgtagttttagaagaatcatgaatacagacaataaaagacataaaatgtagtctatttcactcaattacaaaatattcagtgttgcagaaccattgtgggtaaacattcctaatttttagtgaacatataaagaccccgtgcctcaccaagacgtcctcctgtcttgcccccagaattcctgtttctccatctgcctggtctatgggcaatgcacagaatacgtaatgaagaggggagcagtgagtattgggttacacaattccctggaacctggaacacacccttctgagtactgtgaagatgtggtccccaaggctagagctgaaaagaggcttagggccgggtgagccttccagccagggcctgcctccaagtgatgctcccccagggcagggggcataaggatggcacccagccaggtgggagcctgggccctgcccagcctcaaagctttgagctcaggaaatccggaggcaggggagggggacatcgttgccacattccccagccctttaagacccccaaggcaggaaggctgcccgggcctcaccagcttccctcacaggctccttcctgggaggaaggggctgcctgtgccctcgaaggcgcaagggagggcaggagggaggctcggaaggtgttgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacgtgagtaggggatccctaga

SEQ ID NO: 839 - DNA, 1058 bp, Homo sapiens
cttccagcaagaaatggttatggcactgacctgaaccccttgacccctggtctggtctttggagttgtcccactctgaatattcgagagaagcagcttatggttaaaacaggcagtggcagctgggaggatctaacagctagatcctccaggcatttggaaaggacaggggcataacgaaggcagaatcgcttcctgggtacgaatgcccactacttctgggcactgtgaaatgggtttaagacgcgggccagcaggacaatgtgaacggtgaaaggaagggagtggccggtaggtggcgctaactggcccgggcatgagtcccgccgtagccgcgtcctcttgcaggggaagaaagttgggaccgccagcctgggcaagcgcgtgagaagggagctgggggtcctaggcaagcgcgtgagaaggggaagaggcggcggcgtcctctccagctgggcttagaatactcttagttctgcctttggggtcttgtcttcctttctgggcctcctgcctgtgttaactttgatgggtgctgaagggaaggccggggtcccggcaggagaaacccgggaacgtcgcggccgtccaggctcccctggcgggttggagccagggttctgactgccaactgtggtccttcccgctgcggctgtggctgccagggcgagggcggtcagcgcaaacctggctgaggacatttcggattcttccttggggattcgttcccttctccttgactccggtgccgcgagggcgacaccctccgggccccgcgtggccaccccgggcgcttccccacgcggatgaacccacctcctgggcgccttcccctcggtgccccgctcgccaattggaggctgcagctcagccccctgacaacctgagccaaccagaggcgccagggaggggcggatcctctgtccccaccttcctccggaaagaggaagcggaagtgacgttaggggaaggtgggggcaatcatggtgccgctggggaggggagaagctgctgctgccgccgttgccgggagccgcggaggtaaaaggcgaaactaga

SEQ ID NO: 840 - DNA, 926 bp, Homo sapiens
ttcaaacccgaggtctatcatgtccttaatgtcctatcatgtcagtcagttagcctgcctttcatattttccacacttacaggtcaccatagactcacctgaactgtgagaagtagaggaaggcgtcccagaggaggtgattttaaagcccaggtttgagatgggtatgcatttccaggcaagagagcccggccggtgcaaaagcaaggcttggctcacaaacgggaatgtggggggtggagacagggaagggagaagtcaatccctgggcaagacctcctggagtctctctaacaaataaatactactttccatgcagtagacgctgttctaaacactttacaaatattaactcacttggtctttctacaaccctacgaggtggtactgttactatccctagtgcaccgaagtcacccagcggccgagtgagaactccagtccagctttccacccgctactccgcgcatcccagcttgccttacagccgggtaccggctccaccattttgctagagaaggccgcggaggctcagagaggtgcgcacacttgccctgagtcacacagcgaatgccctccgcggtcccaacgcagagagaacgagccgatcggcagcctgagcgaggcagtggttagggggggccccggccccggccactcccctcaccccctccccgcagagcgccgcccaggacaggctgggccccaggccccgccccgaggtcctgcccacacacccctgacacaccggcgtcgccagccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtc

SEQ ID NO: 841 - DNA, 1038 bp, Homo sapiens
tcatttttggttcctctgcatttcggtggaactcagtcccacagatgtcttcttcaatgtgggaaccatcctttctggaaccacagagctgcagatgtcacgctggaattctcccagaggcaaactgccagatgtgaggctgctcttcctcagtcactatctctggtcgtaccgggcgatgcctgagccaactgaccctcagacctgtgagccgagccggtcacaccgtggctgacaccggcattcccaccgcctttctcctgtgcgacccgctaagggccccgcgaggtgggcaggccaggtattcttgaccttcgtggggtagaagaagccaccgtggctgggagagggccctgctcacagccacacgtttacttcgctgcaggtcccgagcttctgccccaggtgggcaaagcatccgggaaatgccctccgctgcccgaggggagcccagagcccgtgctttctattaaatgttgtaaatgccgcctctcccactttatcaccaaatggaagggaagaattcttccaaggcgccctccctttcctgccatagacctgcaacccacctaagctgcacgtcggagtcgcgggcctgggtgaatccgggggccttgggggacccgggcaactagacccgcctgcgtcctccagggcagctccgcgctcggtggcgcggttgaatcactggggtgagtcatcccttgcagggtcccggagtttcctaccgggaggaggcggggcaggggtgtggactcgccgggggccgcccaccgcgacggcaagtgacccgggccgggggcggggagtcgggaggagcggcgggggcgggcgccgggggcgggcagaggcgcgggagagcgcgccgccggccctttatagcgcgcggggcaccggctccccaagactgcgagctccccgcaccccctcgcactccctctggccggcccagggcgccttcagcccaacctccccagccccacgggcgccacggaacccgctcgatctcgccgccaactggtagacatggagacccct

SEQ ID NO: 842 - DNA, 968 bp, Homo sapiens
ttcaccagggacaaaagtccttaaaagaggaaaaaaactggaaaggattacaaatcaccatgtgatgtttaggtgctctttagcacctaaagaggatttacaagatacattgtctgcacggcaaccactcagacgaatccaccaccaagcgaaggtttttagtaaaatatccttttttttttttttgagacggagtttcgctcttgttgcccagactggcgtgcagtggcgctatctcggctcactgcaacctctgcctcccaggttcaagcgattctcctgcctcagcctcccaagaagctgggattacaggcatgcgccaccacgcccggctaattttgtatttttagtagagacggggtttcgccatgttggccaggctggtttcgaacccctggccacaggtgatccggccgcctcggcctcccaaagtgctgggattacagacgcgagccaccgcgcccagcctaaaatacccattttaattgcatttcaatgacgttactcggtcattgacctcttacgcaaggagggcgagattagggagacagctggacttcttcctcgccctcccttcactggactggctggcgcagtgagtagccctgcccttggacgatttggcattttcattggtcaatttttcttaggaggctggccgtgtgttgactccgcctactatataggcggggtctccccgccgcaggggctgggatgctgggggctgctgaagccgccatcttggattccgcggtagcggaggcggcggtcaggcgccgcttctggggagtggcctttcttttcccctccctcccggttcggtggcggcggctcctcccactgggggggggggtggcgcggcggcggtggcatctgcggccatggcggcgactactgccaaccccggtgaggagacggaggactggggcgcctctaaaggggaggggccgaaggggctgacaactaag

SEQ ID NO: 843 - DNA, 1058 bp, Homo sapiens
agtgaagggggctgagtctaaagacggagagagagagaggccagctagggctggggataatgagggagctgagggttccccaggacatattttttacactttcttttttgttgttttttgagacaaggtctcattctgtcactcaggttggagcatggtggcgcaatcacgaatcactgcaaccttgacctcccgggctcaaggcattctcccatctcagcctcccgagcagctgggactgcaggcgcatgccaccatgccagctgatttttaaattttttgtagagacaggggtctcactatgttgccctgacttgtctcaaactcctggcctcaagtgatcctcccgccttggccttccaaagtgctgagatttatagtcgtgagccactgtgcctggtccatactttcaatacaaatgtatggtgatactactgtgaacaggtcctagatttaccaaaattatctttttgtgtgtttgtgtattttaaggttatatctctttagagaaatgtcgtatgaatttattaaatgtatctttttatattttgaagttatgcctctttggagaaaggtttcaccttatcaggtttcatcttaatcagttgaaaaccttgctgtccttattctctttccccaggtctcccatttcatggtaagtcatcctcagctcccagtccctctttcccctggttctgctaggggtctttctctttgctgtctttcctggacaaatgatctgacccatagattcaggttgttgtgccactaagttctcccatgacctggtctctcagcacatgtttggcaggttagggaggtcacccagtcccttctcacccagccgtggtctcttacaagaaaaaggagacacaaggtatctaggcaagcttgcacattctgactaattgattgcatcatagaatccttgaacaagaaccagaactccagagagggaaaacatctatcttgctgtgtttggacaggccagcccctgaaacatcttgggcaatggagggttaacttctcaaagtttaataggcaagaccagcaaccat

SEQ ID NO: 844 - DNA, 1015 bp, Homo sapiens
tgagagctttcatttttagggcaaacgagccgagttaccggggaagcgagaggtggggcgctgcaagggagccggatgaggtgatacacgctggcgacacaatagcaggttgctctttgtgctaagactgacaccatgaggacacagatttgggggaagggggaatctctaggcaaaggctgttacagtcaaatctctgcgaacgattgtgatccgacagcggtgcaaaaggaaagagcgaatgcagtccacgccgcggaaatctaggggtagaggcaaggggggagggtattccccttgcagggaccgtccctgcatttccctctacactgagcagcgtggtcacctggtccttttcacctgtgcacaggtaacctcagactcgagtcagtgacactgctcaacgcacccatctcagctttcatcatcagtcctccacccccgccccacaacagcctaccctgcctccggctgggtttctgggcagaggccgaggcttagctcgttatcctcgcctcgcgttgctgcaaaagccgcagcaagtgcagctgcaggctggcggctgggaaccggcccgagcaagccccaggcagctacactgggcatgctcagtagagcctgcggcttggggactctgcgctcgcacccagagctaccgctctgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgag

SEQ ID NO: 845 - DNA, 800 bp, Homo sapiens
ccagccataagaactgtccaagtaagcaatagaggtattaatatggccttttataatcagtatagattgtttgaaaatgtgagatgtccatggttggcctctaataacattcgattcacggcaaacatatattcaagtaggagacatggtgatataggcagaaaaatcaaatgatgctaaacaaaagaaaactgtctttgattttgaaagaattcaacttgctgtatatcttttgcctaagccttcagtcagcctttgctctacatctaccaatgtgatcactgcttttccttctgacttctttaggtgggtcaagagtttgcttttctccccattcatgagtgtaaagtttaatgcctaactgaacttgcttccttctttgactcttgtgtagactcgggcacatggggcaactttttttgtgttttgctctaccaggtcgtccctattccgtgggactagtgtctagccccatttcttcagcagtggagcctaggatgtagagctgcatactaccattaggaggcgcaccctcaggcctcggctccgcgttctttatgtctctggaccgctctctctcgcagctcatctctatggtttccgttgggtgtgtggtttttttgtttttttttttttggggtccggaataggcggagcttccggttccggtgggggccgtccctggcggcggagatggcggcgacagcggcggaggctgtggcctctggctctggagagccccgggaggaggctggagccctcggccccgcctgggatgaatcccagttgcgcagttatag

SEQ ID NO: 846 - DNA, 1023 bp, Homo sapiens
agaagacctaagagacgggaggaggcgcctggcgtcagcgggtcgcttctcagccgtgaccacgagcggccagcaggtgtcagtgcgtcctcgctttgccctggcgctcggctcctggacccctccccacctcggtctaagggggcgcggtccagaccccgggtcttgcgtttcccgcagacagcatcgcggctgggaggacacgtagccgcttcttccctaagcggaggtctgaactccggcttgtaccacttccccgtgggtgctgtccattccgccccaggggttccatccgaagccgcgccttcctccctctccaggacccctttctccccagcctccaggagcacctgcggaccgcgtcggctctggcccggagctgggctgctccagacgtaactcacaccggaggttacttccctcgatttgggcggggattcccttccatttttttcttcccttttctcccaagatccagcttcttgggggcactcacgggtgcccgttgcgttctgctccgtcggcccggagctgcatggccaactcccagcaggggccgctcctcccctaccccccacccccgggctccctctttaagtctctagctcaaggtacccgcctctccaaagggctcgtcccgcctgagggcaacgctccccgaggtccagcgctaggcgcgggcgctagactggcggaggggtggtgcgaggggcgggggagggtcggcttcccacgtgggggctgacgccggctgctcagcaacgcttgcttgatcctggggctataaaacgagtccaccgtgagcgcagcggagcagcagcagctccagctcggtgcagaagcccagcagccggcgtgccgccgcccggccactccagcgccttcttccccgccttgcgctcctgccccaactcgcgctgtcgtcggaccccggcccatccagcagcgctcggcgcccaccaggcggacgcccaggagaacccctgcctccgtcgcggctcctggagagctgatcgttcacct

SEQ ID NO: 847 - DNA, 1100 bp, Homo sapiens
ttctggtgcttaattgcagaggtggggaggcagtatgtgtgatggttatgaccacaggcttcggaatcagatcgacatcaggtttgtacctctcagctctaccaccttcaagctgtgtgatctttggcatgctacaatctttaattctgggatctttatctgtagaatgtgcaaaataatgttcccaatctgatatcattgataggaatgagcaaatgtatgtaaatagctttgcacagtgtcaagtgagcactttcctggagccctcagttagctattaataacttctcgagctaccatggccattaacaatgggacctgaagcactgcggatgctacaaatgcttcagcagacccagtgcttgatttcaggaatttcagacgaagggcgacacgccctcagctggagatggaggaagaaggggcagggtccagcagggctgagaggagagaattccgaagaaaaatctctccccagccctgggaaaggaaaggaacgaaggactggtcaaggagggtccccagagcgcccgccgcccgccccggctggggtggctgagcagtccactcacagctccaagctctgtggcaccgccttccgagtgtatctggagatcatcctcctcctcctcctcctcctcctcctcctcagccgcggccggggcaggcacgccagggtgggggcctccgggcctggccctcccgccggctccggcccggcccctcccgccacctaccggccccgtctcgccccgtcacctagactccgagcagccacctccccagggtccccacctctccagtcctccgacctccctgctttgccgcgggggcggaagtgacgaaggcccccggacactcgcaaaatgctcccgccgacgcacagcagtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccgtaagag

SEQ ID NO: 848 - DNA, 927 bp, Homo sapiens
ggcactgcattcatcaaattcttcaggtttcatatcttatttccaaattccttttgcatacagagttttgttgttgttttgagacagggtctcactccgtcacccaggctggagtgcagtggcacaatttcggcttactgcaacctccgcctcccaggttcacaaacaattcttgtgcttcagcctcccaggtagctgggattacaggggtgcaccaccacgtccagctaatttttgtatttttagtagaaacgtggtttcacgatgttggccaggctgatttcgaacccctgacctcaggtgatccgcccgccttggccttccagagtgctgggattacaggcgtgagccaccacgctcggcccagagttttaaaattttactttttctactttagctcacatttgaggtggtaaaagttaatcttgaggtccctttctcctacagggctgggggaaaattttcacgtgagagtcaaacagtccttttcagatacatccagacaaggtttggttagaaataaaattacttgggctctctggtggatgggttctaggcaaacaactccgcccaacagcagaggccctgcactgcgttgtgcctgcagcacctcgtgcgccttctgcagccggccaaccacctacaccgcagcccgcccacccgcacgcgggggcggggcgggcaggcagaggcgcaggcgcggtgcttcgcagcccgcttccggcctcacacctgccaagcatcacacctgccaagcatcacacctgccaagcatcacacctgccaagcatcacacctgcgatgcctgcacgagctgggtgcggtccgcgcagctgcagtaagggggcgacccggcgtctgttagtcggcggttcatctccttcgtgcctcgatgagctttaacgccattttcctccattctctttc

SEQ ID NO: 849 - DNA, 913 bp, Homo sapiens
tggattttgaaaaaggttcaaatgcaaatactctacaaaagatggagtaggttgtgtccccttctgtgagatatatatctctctcacaaaaaaaaaaatatatatgtaaattttttttgagatggagtttctctcttgttgcccagtctggagtgcagtggcgcgatcttggctcactgcaacctccgcctcctgggttcaagcgattctcctgcctcagcctcccaagtagctgggactacaggcatgcaccaccatgcccgactaattttatatttttagtagagacggggtttcgccatgttggccaggctgttctcaaactcctgacctcaggtgatccacctgcctcggactcccaaagtgctgggattacaggtgtgagccaccgcgtccggccatgagttataaatattaacaatttcttgctgtaaattgaaagcatccttcgcgtctttgcgtttcattaccaccctctgttctctcaagagaaattctaactttatttcagcactcagtcctgaagttacagaagttaataattttttaaaatcctgcaaacaatgcatggatatccccgtcttgcacactctttgggccagtctagaattcttcccatcagcatttcggtgatctggaccgccgccacccacactgcgctccagggcagaaaagacgccccatgcccgcgcctgggccggcggggggcggagcttgcgtgctgacgcataagagccgagcgggggaacgtgcgtgtctcgagtcgcacggagggcaaccgtcgacgggcttagcgcctcaactgtcgttggtgtatttttctggtgtcacttctgtgccttccttcaaaggtggtgctttgtccctgtgggtcatctgtactgattgcgccaagcaaagcatttgtgagcgt

SEQ ID NO: 850 - DNA, 1037 bp, Homo sapiens
gctgttcggtttgcgacacgcagcagggaggtgggcggcagcgtcgccggcttccaggtaagcggcgtgtgcgggccgggccggggccggggctggggcggcgcgggcttgcgccggacgcccggcccttcctccgcccgctcccggcccggggcctgcggggctcggcggggcggctgagcccgggggggaggaggaggaggaggaggaggacggacggctgcgggtcccgttccctgcgcggagccccgcgctcaccctggcggcggagctgggggtggggtgggggcgtcgggaagggccgagggaggtgtgaggtgtctgcaggggcgacttcccggtcggtctgtgggtgcagggggtgccgcctcacatgtgtgattcgtgccttgcgggccctggcctccggggtgctgggtaacgaggaggggcgcggagccgcagaagcccaccctggtatgttgacgcggtgccagcgagaccgcgagaggaagacgggggtgggcggggccaggatggagaggggccgagttggcaggagtcatggcagacgccacattcgcgacatctcccccacaccccctctggctctgtccgcaacatttccaaacaggagtcccgggagagggggagaggggctgctggtctgaggctaagaagggcagagccttcgacccggagagaggccgcggcccctgcccagtgggcagcgtggaagtttccatacaaggaggtgggaaggagacccccccccccttcactgccctgtgcagagatgagccgggggtgcaggatgggagcccatggcacttcgctacgggatggtccagggctcccggttgggggtgcaggagagaagagactggctgggaggagggagagggcgggagcaaaggcgcgggggagtggtcagcagggagaggggtggggggtagggtggagcccgggctgggaggagtcggctcacacataaaagctgaggcactgaccagcctgcaaactggacattagcttctcctgtgaaagagacttccagc

SEQ ID NO: 851 - DNA, 912 bp, Homo sapiens
tcgataccagagccgtatttgtttttgcagcaacaggttggctgcgggctcttcccccgccttccaaagccctcagcccctggcccaccctgcaacttactcatctctccaaccctcctcccctagaactgctgcctcctgtgcgcagcccctagcctgggcctgattccaatttctgtaacattcccctgcccgggattgaatacaggttgaaagtcggtctcctccgcgcccctgaggcccaaccccggcgctgaagcctcccaactcctgtgtgcaaaggagacggagactgagggatctgggcgctctggcaggcacaggagggctccccgcccgtggcctcgccggagatgcacccggctcccaacccaacaaacccgctttgggaggggatggggtggggaaaagaagacggggctcggggctcgaggggagatatagagaaagcaagttaggtagaggagatgtcccagaggaccccattttcgggactgcacctcccattggagctccccgctcccaagccctctggggactcccgcgctgccgtcgaaacccctattccggccccaacggggacacttctccaggatttgctcctcgcctgtggggaccacagccaaagactcctggaatcgatcccagatcctgggagtcggggggcccagccggggtgcggggagtcgcggcgtcgtgactgcacccgccccgccgcgccgggaggcgcccctggcgaccgtcgcgaacgccacaccctcggttcggccctggccccgcccccgcccagagcgcgttcgcggccaggggaggcgtgtgctgctcccgcagccagcgagagcgagagagggatggatgttggaggaggaattcgggcttaacaagtgatcgctgctgtctaggattttgttt

SEQ ID NO: 852 - DNA, 905 bp, Homo sapiens
cctctacaatgcaatttccctcaaaaataaaccctccaggatgggtgggtggctcatgcctgtaatcctagcaatttgggagaccaaggtgggcacattgcttgagcctgggagctgaagacaagcctaggaaacacaaggagaccctgtctttacaagagatacaaatattagctggccatggtggcatgtgccagtaattgcagctactcgggaggctgagttggaagaatcatctgagcctgggaagtggaggctgcagtgagccaaggtcaaataactgcattccggcctgcacgacagaatgataccctgtatcagaaaaaaaaaaaaacagaaagaaaaaagcaatgtgaaaagaaggacattaaataagaaaagctttaattctggtgaaaaatgtttctatttcttaaagcaaaaatgtttcacagggacatacattacccacaactttcccaagagctatgaggtggggtcaggggaacagtggttcacatactccaaaggttgtgttacttttctccgtcaagctttctaatgattgagaaactcttcactgtgtgaatttaattgtacacatactttttcaatcctgtcttactctccaagccccattcccctcctaccctgatctatccaagggctggtgaagaaaatttcccatggatacactacctgatgcaggctacagttctgattctttaatgggaagaaaaataaagacatgcatatgcatgcacagtgagtatttcccaatacatgtacaggccctgccaaaaaggaaggcgaagcatactttcagtttcagtcacacaagaagggaggagagaaaagccatggccggtgagtcttttactgttccaagaacaggtccctgggaagaaagagttttggaaggggct

SEQ ID NO: 853 - DNA, 925 bp, Homo sapiens
tcagtctttgctatcattccaggaatagaaagttttaacactggaaactgcaagtaaatatttgccctcttacctgaattttggtatccctctccccaagcttactttctgttgcagaaagtgtaaaaattattaaataaaattctaatgatggtatccgtgtggcttgcatctgatacagcagataaagaagttttatgaaaatggactcctgttccactgaaaagtaaatcttaatggcctgtatcaactatcctttgacaccatattgagcttgggaggaaggggaagtcctgaatgaggttataaagtaaaagaaaatatttgcaaaatgttcctttttttaaaatgttacattttagaaatattttaagtgttgtaacattgtaggaattaccccaataggactgattattccgcattgtaaaataagaaaaagttttgtgctgaagtgtgaccaggaagtctgaaaatgaagagagacagatgacaaaagaagatgcttctaatggactaaggaggtgctttcttaaagtcagaaagagatactcagaaagaggtacaggttttggaaggcacagagccccaacttttacggaagaaaagatttcatgaaaatagtgatattacattaaaagaagtactcgtatcctctgccactttatttcgacttccattgccctaggaaagagcctgtttgaaggcgggcccaaggagtgccgacagcagtctcctccctccaccttcttcctcattctctccccagcttgctgagccctttgctcccctggcgactgcctggacagtcagcaaggaattgtctcccagtgcattttgccctcctggctgccaactctggctgctaaagcggctgccacctgctgcagtctacacagcttcgggaagaggaaaggaacctcagacc

SEQ ID NO: 854 - DNA, 1056 bp, Homo sapiens
ccccaggtttacatgttccaatatgattccacccatggcaaattccatggcaccgtcaaggctgagaacgggaagcttgtcatcaatggaaatcccatcaccatcttccaggagtgagtggaagacagaatggaagaaatgtgctttggggaggcaactaggatggtgtggctcccttgggtatatggtaaccttgtgtccctcaatatggtcctgtccccatctcccccccacccccataggcgagatccctccaaaatcaagtggggcgatgctggcgctgagtacgtcgtggagtccactggcgtcttcaccaccatggagaaggctggggtgagtgcaggagggcccgcgggaggggaagctgactcagccctgcaaaggcaggacccgggttcataactgtctgcttctctgctgtaggctcatttgcaggggggagccaaaagggtcatcatctctgccccctctgctgatgcccccatgttcgtcatgggtgtgaaccatgagaagtatgacaacagcctcaagatcatcaggtgaggaaggcagggcccgtggagaagcggccagcctggcaccctatggacacgctcccctgacttgcgccccgctccctctttctttgcagcaatgcctcctgcaccaccaactgcttagcacccctggccaaggtcatccatgacaactttggtatcgtggaaggactcatggtatgagagctggggaatgggactgaggctcccacctttctcatccaagactggctcctccctgccggggctgcgtgcaaccctggggttgggggttctggggactggctttcccataatttcctttcaaggtggggagggaggtagaggggtgatgtggggagtacgctgcagggcctcactccttttgcagaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaac

SEQ ID NO: 855 - DNA, 958 bp, Homo sapiens
gcatttgtattgtttgtgccagaatgtgcagaggtagagatacaagtaagcaagaggaagagggcagtggtaaaagcaagaggagacccgactgtggagacaatgaagcaaagggaaggtgagacttgagtaatggatgcacctcttgctctgggagcatctgaccctttttccagagtggatcctgtttgctgtgaagcccaatttatatgtttgcttcactgccagaatcccgcccccatccctccccactgcaggcttgagaagtggcctcacagacacgcccttccctcttgacactttcattccaaatagctagcttttctgtactttctctgagaaaggtaatgtaaatgtaaaagaagtttttgaggctattctatagaagatgtcataattcaatgttcctcaaaggcagggactatatttattttttttaaacctctcggcacctaatgcaaaatctagcacacagactcccaagaaatgtttgcttaaagacggatagagggccacaggggcaggttttattagcagttgctgaagatgttggaatgcaaggtgtctcaggcagtctggactaggaaaaagttctgtgttgaaaacaagagaagcaacgaaataatttattattcccattaaataaagatgctgatggctctcgagatagatatgaggaccccaggactctggggagtgaaggaactaagccgctgccatatctgagctgagtacttagggggaggaggaagaggaggagaaaggcaagcaggaggaggcggagccttcttgtcagcatctgttagtggaggttgggaagcctctcctccttccccctccctctttgcctccacctggctcctccccatgttcgtccatcacccctcccccctttcccaaggacaatctgcaagaaagcagcggcggaggagagctaagactaaaaggcaagaggggc

SEQ ID NO: 856 - DNA, 906 bp, Homo sapiens
tgttcctttgagagaggtgatccctaaagaataaaatatgaaggtgttcccatgtcgtatgtacacatctgtgtatatacggcagtgactttgtgttaattttctcatttcatagcatgtagtaatgtgaggggcaagacccaaagaccaaggatcaagagatgctcaggaggctgacatcctgagagggaagagccatagaaagcccctgaccattcttgagactgacaccattaatttgcctaactctgatgtgcctttatagcctcagactccagtttcaactccatatcacctaaccccattccaatagcacaattccataacacccaaccctaatcttaattataatccaacctacccttgctcttctacttctactttgctgattgtcatcagtgccctaaacctcatctgattccagccctctgcaataacctatcccttcattgaaaagggagggatcgttgaggctaactcaactttttctcctccctttctcatttctattcagtcaacttctcttttccctgaccttagtttattccccaaataggttccaattggggtgggagggatcagggaggaattaggaccttagtagtcttgggcttgattacatgacatttcagcttgtcagtctacaagggtgtggctttcctctggaagaagtccaaagctctcaggctgcaaagctcagacttggtatagtgggagagcctgactgaggtggctctagccagtctaattgccgttcctttagctagtggcatcttgattcctgctgtgtcttaactgaccattgtcttaaattctagagtggatcatgacccatgaagagcaccatgcagccaaaaccctggggattggcaaagccattgctgtcttaacctctggtggagatgc

SEQ ID NO: 857 - DNA, 1033 bp, Homo sapiens
gtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggtactggcccggcagcgagcggtcacttttgggtctgggctctgacggtgtcccctctatcgctggttcccagcctctgcccgttcgcagcctttgtgcggttcgtggctgggggctcggggcgcggggcgcggggcatggggcacgtggctttgcggaggttttgttggactggggctaggcagtcgccgccagggaggagggcgggatttcggacggctctcgcggcggtgggggtgggggtggttcggaggtctccgcgggagttcagggtaaaggtcacgggggccgggggctgcggggccgcttcggcgcgggaggtccggatgatcgcaggtgcctgtcgggtcactagtgtgaacgctgcgcgtagtctgggcgggattgggccggttcagtgggcaggttgactcagcttttcctcttgagctggtcaagttcagacacgttccgaaactgcagtaaaaggagttaagtcctgacttgtctccagctggggctatttaaaccatgcattttcccagctgtgttcagtggcgattggagggtagacctgtgggcacggacgcacgccactttttctctgctgatccaggtaagcaccgacttgcttgtagctttagttttaactgttgtttatgttctttatatatgatgtattttccacagatgtttcatgatttccagttttcatcgtgtcttttttttccttgtaggcaaatgtgcaataccaacatgtctgtacctactgatggtgctgtaaccacctcacagattcc

SEQ ID NO: 858 - DNA, 1093 bp, Homo sapiens
gttcccaaaccttagcctcaactccttctgagcgataggggcatgctaccagcacggggggaaatgagatacaagaaacgcccgaaagggaaaaacaaggctgggctgtttccttcctttggggtcaagacagaggcacagaaggcccaggtctgggaggttggatcacctccggctggatgttgagccgggtgggagcccaaacagcagggggcccacaggaggccggcccaggcagcctcgcgtccacttaccaggccaggcccaggcacgtccccagcgacagcaggctcaggcacgttcgggggtctgcccagcccccgcctccgctgctccgggccacgggggtcttcccgccctcgctccgcttcccgggctccgcagcaggggctcccttgggccccgacttcttccggctcttcacctcagacatgtctggagaccctaggacgacaagcccagggcagcttcttcaccagggggagcaggacgtggccgccttggcgttcgtgggaaccctgggcggtgaccgcgccccctcacagacttggcaccgcccagagcccagccccttccctctccccggcatcctcgttgcttcactgagtctttcagctgccagctccatagttcccctaggagaggtgggcggcgacctcaacccacagcgccttccactgcgatattgctccaaatccgaggaaattcaaactcccgggcgcgcgcaggccgacgggacccgaggaggaggggcaggacgaaggggtcgcgcgcgccacgtcgggcgcgccgccgctgcccgagtccggcattggtgggaacgcggcgcgtccctgaggcttagccacgccccgtccgcggggtaggcgggcacttctacgcgcgcgggcatgagccgtggcaggagtgcgcggcggcagcggtggccgccccttggggcttggggtgtgtttatttgcataagcgggcgcgcgccgtccgggctgggtggatccggcgggatttgactgctccgctgtccagaggcggagaagaagaggtagcgagtggacgtgactgctctatcccgggcaaaagggatagaaccagaggt

SEQ ID NO: 859 - DNA, 1076 bp, Homo sapiens
ttccttccttccttccttcattcagttattatgtatttattcagcaaatattcatagcctgctagtgcacagtgctgaataagaacatgagtaagagcagggaagcatgagagagcatggctcaccttagtagctgcaggtggctgggtgcagctggagttaaaagacactctgagtttttcttaaaaaaaacaataaataccaaacttagaatctaataaggaagaggtgctctcaggggaagttaggtgtgttcctaagaatttgtcatttcttttcaggattagtcaggatgaactagacatttcttttcaaaagcctaataacttcctttagggaactgccaaactgactaatccatgaccttaaggcagtgggtcccaaactttgctgccaactcaatcacctttggagttttttttttttttttaaacgcagaggcccaggtcacactccacaccaatgacatcagaatgtctaggggtgggagccaggcaccaggattctaaagaccctcacgtgatgacaacagctagcaaagttctgtagctactgccttagggcatagtctaatttcttcagtaaaaacacacttattccaaatttggttccagaattgccttaaattgtttttgctctgttcttaggttgggggcggctatgagcaggcagaggatgtggtgtcacccaattaggagctctcagcttacgaggcaattagcataggttgccagggctgcacgaggagtggatttctgctttgtcattctgactctggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcggggaagggaagatattttaa

SEQ ID NO: 860 - DNA, 913 bp, Homo sapiens
tgaatgttggcgtgatttatgtctaatgaataggcctcatgtcagtgtaactgtggaatctgtatgttccactgagttcacccctttgtgaaattttaccattagtgcctagtttcatctgtagcgttgtgtattgcttcaggattctttttaagaatgcaccaggtaggcagagtgttcttaattttgctccacggtttcaaatgtcaaggaaacgttggaagttggattttggcattcagtatagatgcagagttgaaagcaagatcaaactgggaggtgttttgtgaaagttgagataaacgtgtattaagcttcttttttgaagcttttctgaattcgggatttaccgggaaagtaggacgtttaattttagcggagtagtgcaatgatttaaccctgactagaactctgacgtttacagctagccttgaggccatgttttcagccagtgtgcggatttgccggggtcagactccaagcttgattgtgagttctagcctttgtcagaaatgcagcaagtcatgctaacttgcaagggagtcaacagagggcacgcggtgcctgcggggccgggacggaagccccgcccccggcgcagttcccgcctgttagcgggggagaagcaccttacacgctccgctctgcttttgtgccacacagaggacggtcgggccctggaaggaacgctctcggaattggccgcggaaaccgatctgcccgttgtgtttgtgaaacagagaaagataggcggccatggtccaaccttgaaggtaggagagagtaacgtatctttttaaacgggggatgagctcgttgagctcagcgtggtcacagcctgccttttaaagccagcgtggatgtgaccctccaaacgggacgcagcgctgggaaatgacgaaaaacgctcgtg

SEQ ID NO: 861 - DNA, 931 bp, Homo sapiens
tggaattgtaggggaacttcagatggcagggacaaagcctcattggtcttgtcaggcaacgagtaagcaatcattgcgtgtttgttgaaacaggttgaaaaaaatagtcattttcatcaaatgaactttaaaacggagatgatctaaattcagatgtatttttttaagtcctttaaagtttaactgaaatgcaacatagaaatttatttctggccgggcgcggtggctcaggcctgtaatcccagcactttgggaggccgaggcgggcggatcacgaggtcaggagatcgagaccatcctggctaacacggtgaaacccccctctctactaaaaatacaaaaaattagccgggcgaggtggcgggcgcctgtagtcccagctactcgggaggctgaggcaggagaatgtcgtgagcccgggaggcggagcttgcagtgagccgagatcgcgccactgcactccagcctgggcgacagagtgagactccgtctcaaaataaaaaaaagaaggaaagaaatttatttctatttgtactaaatctaatagaacaagagcgttaaagtccagaagagtcggggatgggcaagttttataaataacttggcctccgcattgaagagcctgcgagatgtgagaccagctgagagcggaagcctctggaaggagacctcctcatctggagggtgggggagggagtgtgcatacttgagcccttgtccttgaaggggattgagcgagccgaggggaggggtaggcggtactcggatttccaatcacaatggagaaacctaagaggctgcggtggttgtggggccccgccccctcctccctccttgcagagccggcgccggaggagacgcacgcagctgactttgtcttctccgcacgactgttacagaggtctccagagccttctctctcctggtaggt

SEQ ID NO: 862 - DNA, 940 bp, Homo sapiens
cagtgacaggcagcctagtagaagaataaagaaaaatgttctatttcagttgggttttacagctcggcatagtctttgcctcatcgcaggagaaaaagtatgagacagtgccctaaagggaccaatccaatgctgcctgcccctccataggttctaggaaatgagatcacacctctcacttggcaactgggacaaggggtcacccgagtgctgtcttccaatctactttaccccagtcacttcagggttaaaattgtagagtttgctggagagggtcttatcgtcctttctttctttttttgttttaaataatgcatttgctctagaatctaaaattgctctcccatcccccatattcctttaatactggtaaggtgtattagcagacgtttgtgtcttcatgcccagcagaaagttaatcagaaaacagatccttattttctatggcagcataagtattttaatgtctgcgaaccctgtcactaacacacattcttttaagggaaaaaaatgcttctgtgctctagttttaaaatgcaaaggtatgatgttatttgtcaccatgcccaaaaaagtccttactcaataactttgccagaagagggagagagagagaaggcaaatgttcccccagctgtttcctgtctacagtgtctgtgttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaa

SEQ ID NO: 863 - DNA, 1028 bp, Homo sapiens
ggttttcctctttgcctcttctctgcgcaactcgaagcctgagtgggtttgctccgcttggcaaggctggggaggaggaaaagatcaaatcacccagagccaggtgccaagtgtgtgtgtgtgtgtgtttgtgtgtgtgtatgtgcgcgtgtgcgcgtgcgcgtgtgtgtgtcctctctttccttgattttcccccgttttcccaagactgtgtgagcagcagcaacagcaacggggagatgcaaaatcctttgcaatctgcccaggaaaagacagattttgagtcgggtttatatggttacccatatgttagggcccctaagaaaggaagggaagctgcgttctctgtgtcttccctcctccagcccagaccttggcctctccacacctgtggggctcccaggccacagatgaacatgtgccctccatccttcactctccccagatgccaggcctgagtgtggctccagaaaagaccagaaccaggcaacatttcctgaacaggctgcttttctccgtctgtccacccgagagccaaggccagaacccaggctgcaacctctgcgggctcctgggaggggctcccagcactgcccagcctgggaggctgtgtgttccactgtcccattaaggaatgctatcccaacactgatgtagaggcagaaataaccatccctgcctcccatggggccttctctgcccaaatagacctgccctgccctgcgtggctactacattcagccctatccaggctcccagaaattgtcattgtgtgtgtgtgtgtgtgtgtgtgtgtgtgtgtatgtgtgtgtgtgtgtgtgtgtgtgtgtttcctgatagaaaaaaaaaaatggaaattaggttatataaaagatgtatgctttggagcccagagcggctcttttaatgagggttgcgacgtctccctccccacacccataaaccagtcgggttggacgtcactgctaattcgtttcagtgatgataggataaaggagggacattaagaaataaattccccctcacga

SEQ ID NO: 864 - DNA, 1092 bp, Homo sapiens
tagcaaatgatctagggcctcaagttaatttcagccggttgtggtcagagtcactcatcttgagtagcaagctgccaccagaaagatttctttttcgagcatttagggaataaagttcaagtgccctgcgcttccaagttgcaggagcagtttcacgcctcagctttttaaaggtatcataatgttattccttgttttgcttctaggaagcagaagactgaggaaatgacttgggcgggtgcatcaatgcggccgaaaaagacacggacacgctcccctgggacctgagctggttcgcagtcttcccaaaggtgccaagcaagcgtcagttcccctcaggcgctccaggttcagtgccttgtgccgagggtctccggtgccttcctagacttctcgggacagtctgaaggggtcaggagcggcgggacagcgcgggaagagcaggcaaggggagacagccggactgcgcctcagtcctccgtgccaagaacaccgtcgcggaggcgcggccagcttcccttggatcggactttccgcccctagggccaggcggcggagcttcagccttgtcccttccccagtttcgggcggcccccagagctgagtaagccgggtggagggagtctgcaaggatttcctgagcgcgatgggcaggaggaggggcaagggcaagagggcgcggagcaaagaccctgaacctgccggggccgcgctcccgggcccgcgtcgccagcacctccccacgcgcgctcggccccgggccacccgccctcgtcggcccccgcccctctccgtagccgcagggaagcgagcctgggaggaagaagagggtaggtggggaggcggatgaggggtgggggaccccttgacgtcaccagaaggaggtgccggggtaggaagtgggctggggaaaggttataaatcgcccccgccctcggctgctcttcatcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtg

SEQ ID NO: 865 - DNA, 1046 bp, Homo sapiens
tgcctccaaagacaaaagtgattatgttttgtttagtagcttgcaaagttgccaaaggccattttttctactctttccctgaaattggtttatatgcttattaaagtcatttatacctatttgcaaatgcttaacatagtttcagattttaagatttccctgcaactttatttcccttgaagtttacagcaacaggagttcatttttatttttaattgcatttattcagtaagtaaactccgccacagaaaaacttagtagacaaggtgagttcccctgtgctccgtggcaaagagtgcggtgggtgacattgacccatggttaggtaatctggtaaggaaagaccccgttgtaacacatctgagcaacgagaccaaaggaagggcttgctgccacgaggcgaagtctgcttttttgaacagagagcccagcagagttgggcggcaatcgtgcccagcactgaggccgaggagaaagagagcaggagcattacattactgcaccaagagtaggaaaatatgatgcatgtttgggaccaggcaaccgaaatcccttctcagcagcgcctcccaaagccgggcaccgccttccttcggagaaggcgcagagtccccagactcgggctgagccgcacccccatctcctttctctttcctccgccgctaaacacagacgagcacgtgagcgtcgcagcccgtcccagctgtgcctcagctgaccgcctcctgattggctgagagcggcgtgggctggggtggggacttgccgcctgcgtcgctcgccattggatctcgaggaacccgcctccacctcaggtgaggcgggcttgcgggagcgcgcgccggcctgggcaggcgagcgggcgcgctcccgccccctctcccctccccgcgcgcccgagcgcgcctccgcccttgcccgccccctgacgctgcctcagctcctcagtgcacagtgctgcctcgtctgaggggacaggaggatcaccctcttcgtcgcttcggccagtgtgtcgggctgggccctgacaagccacctgaggagag

SEQ ID NO: 866 - DNA, 1001 bp, Homo sapiens
atcgctggtgttcagtaggaaagggaatcaaaactccataaagcaaatcagcttatctgtagataaccaaagtcttctcagtggtgtctgtccctcttgtgaaagtacagctgcttgtgggaaaagtgagagacctagaatacagtgtatcttttgggggacatacctctgactgttacagaagcatgtgattaatttggaaggtagaatttcggaacatcatattttaataggaagcttgaaaggtaagtagaggaaaacatcaagcaaagcaaaatacaccatttgcagagttcaatcagatatgactcagcatttcttcattgtgctcatccccagctcctcaagcacatagtgccttgcacacagtaggggctgagggaaatattcgttaatgcattaattttagttaaaactagatacctcctaatctctcagtggcttgaactgggtcaaacagcagaggaatggggtaaataaggaaagacacccggtaaaggtagaacaagaccactgcttaataaatatattcgtttttggggttattattttgctcaaaagtctatgaggtgaccaacccagaatgtggcagttaattctatttacattttcagtgtgggatccaggttttcaagtttgttatgtgattttatgcaaaacaatatgcaaatccagcgcattctaaaaattcagtctgctttccagccgctcccctggtcacaaacaactaaggttggcgccgggctctctgggatccttcgcggaggggcagagcaggcgggggtgactggcagcggggcgggggaaagggcggtcccggaggcggtcccggggcggagcccgtgacgcgcggagtcggccggcttaagggccggacctcagcgtctcccggagtctggccgcagtcgcggcagtggtggcttcccatccccaaaaggcgccctccgactccttgcgccgcactgctcgccgggccagtccggaaacgggtcgtggagctc

SEQ ID NO: 867 - DNA, 940 bp, Homo sapiens
agggcaagttaatcaccaaagtgttagatacttaatttggagaccgcaaatcggtcggcaaaacgatgggcttttcaaaatcatgccgggtgtagctgggtaagcatgaatttgttcaccaagtccccgattcccaagctaagggacccttaagtatgaagcacatggctttcggggaacccaaaagtagggagcgctcccgagccagcggtgggtctggagaatccccgagcgcgcaggccgcgggacagcctccccagtgcgcagcagcctgaggctaacagcccccagagggcagagccccgcgatcccggcgccgcttgcggctggattctttggcagcgggcgcggcgccagtcaggacgacggctccggaagtctcccgggcgcgtgagacccgggccgctctccgtccacgcacgaccctccctccaggcgcgcctcccaccccggccccgcgttccgctcagcccgggtgaccaactacacctcacttcaaaggcccccacgcccgggcgtgccctccgcccgcccgcggcaggtgggggtgcagggcggagggcgcgggcggccccagaaggcgcccggaccttcccgagaattccgggccgcgcaggcgcattgaggccggcgcgggggcgtgcgagaggcgcgcggcggcgattgagggaaggttgcccgggccgggccacgagcagggcctgcgcgcgcccgcaggaaggcgcgggggcggggtgccgcggcaacggcgcatgcgtaggcgcgcggccgcggcggcggctggggagggttcttccggaaggttcgggaggcttctggaaaaagcgccgcgcgctgggcgggcccgtcgctatataaggcaggcgcgggggtggcgcgtcagttgcttcagcgtcccggtgtggctgtgccgttggtcctgtgcggtcacttagccaag

SEQ ID NO: 868 - DNA, 998 bp, Homo sapiens
cccagaagtggtatcaaagttgcaccaatctggccagaaactcatgctcagatactctgtttaacaagagatcagctgggatgatggatgagaccaggggatttccatagcactaggaagtccccaagaccacgacctcaacttaacttttttatcatcagcagccccacacagcctggcatccagtaggcacccaatactgatgggctttataagaacaccaaaagtgcactctgggccttgatttatactaccagtaggcatggggagacaaggaatgccagtctgtgattccagcaagaggcaagacgaaaatccatttattcagcagctaatacatgtagcagggtgattcattttccaaaaatatgcagtagtatgctgagatttagtgctggagtgactcccagccggcccctaccctgctgaagccccagccgactgtcccagggtgggtcctggccaggactggcaccaaggcagtggaatcctttcaaaataggcctccagcgccatagaccagaaagcaggcgcccaattctgggacactgggagatggtgcaggcagccaccagtacgcaaagcatagagccctatccttcctggcagggtcacggttcagaaaacgtaaccttattttcatctgtagttaacagaagcatgtttcctcagcattcatattaaaaataaaaaactagtaattccagggatctcggttagcctcttaagcatgtcaactattgataatactcttagcaaaactaactccagaaatcacttgctagagaagcagcccttcactgccttagtctgagcacccacggaaagcacgtgtcggagactctggcaaggcccgcgcagccgcagtagagggccagggggcggggcacgcgcacctgccgtagagtgctgaaggtcctgccaacggctctcttggcgtctcaacgttcggatcagcagcttttttccattctctctctccacttcttcagtgagca

SEQ ID NO: 869 - DNA, 800 bp, Homo sapiens
tcatcaatctgctctcaaaaactgtcgcaacaatttacaatctcatcagcactgagtatccatttccttgcacccttctcagtagtattaccattaaacaaacaaaatttatatgcgtcagtttgttgggctcaaaggagcctctcgacaagtttcctattccccacgctgcctctcctctggacacaggaaggggtccttttccttatttattttgttatttcattttcgtcaacacggctcggcttggggacaggggtcgggggcaggccggttaccgcagaggtggaggccgcgcggcacctggcctggagagctcaccacacagcgacacagacttcttctcagctgggtccacctgcttgcctcggggcgacagagggcgccacggcgtccgcgacggaccccgcccccaggcagtgcgccgcgctcccgtgacgtatttccgcgtcatctgccgccgaggcttgcccccattggttgtctgcgaggcaataggggcggagccgagtgggagtgtggaaagcgccgcatcccgggtgggaggcgaggcttccccttccccgcccctcccccggcctccagtccctcccagggccgcttcgcagagcggctaggagcacggcggcggcggcactttccccggcaggagctggagctgggctctggtgcgcgcgcggctgtgccgcccgagccggagggactggttggttgagagagagagaggaagggaatcccgggctgccgaaccgcacgttcagcccgctccgctcctgcagggcagcctttcggctctctgc

SEQ ID NO: 870 - DNA, 1033 bp, Homo sapiens
gaagtgctggaccctcagagtaaaatataagtaattacagacgagatccctgccctggtgcggcttatctgagaaggaaaggtgacctaaagtcacgacaattgtgtaatgatacagttcatgttgttgaggaactgtacagggctgtgacagcctttaagaggtggctctggcctagtgtagaggtttaggaaggaaaggttctgaggcagagacgtaggactggagatgtgaaggcgtggcagagtggagcaagacttttggcgtgcccaaaagacagcctgtgtggctacagagcggagagcgaggagaacagaactaggcgaggatgggtaagtggaaagagtaaaataaagctcctagaacgaggggaccagagtggacaggaaagggcggggaggggcggttccacttagaaactacaattcccaggaagcactcggcagccacaaacggatgtgaggtgaggcaggagcggcgacctttgaaggaaaaaaggaagtgtttggacgacagcgagcgggagaagcggggtcaagtaggtaggggtgcggtgcgggaggggcaggcgggctccggcgtgcgagggccttggccagcggagcgtttcgcggctccgtgtcgtcataaggcggcggccattttcgcgggcggaggcggcccggcgggccctgggagagctgggacgggcggcggccgggtggcctcggccacccgctaattgcatcttttcccggcgtctcgtctgcagagggagcactatgtctgcggaagtccccgaggcagcctccgcggaggagcagaaggtgagcgcgcggggcgtgagccctgggccctgcccaaggccgggtctggcgggcggcctgctcccgccaggcggagggccgcgcccgagatgcggggccgaggcgcatgaggccgaggctcctgcgccccacctttggcttcccgccgtcgctggctggtgcgccgacgaattgggagttccaacgtgccccgcgtttactccgaatcgtgccttttgtaacacctc

SEQ ID NO: 871 - DNA, 1003 bp, Homo sapiens
tgcccagtctgtttttcttgattaattcttctgcagtacttgccatgaagtaataaacactccttccctattaaatatagcactttgaaagaaagcagactaaatcaagactgttgttcaaagtgaatagatggaagaattgatagttctgtcaggaaacaggtttttgatatattaaagaataggatgtttgacatgaacagagtttgtcattttaaacatgggggagagttaggcaatgatatacatagatgtgaggattgacaaaaatgatgtttctcttctttaaaaataacaggatgggccaggcatggtgggtcatgcctgtaatcctatgactttgggaggtcgaggcaggattgtttgagcccaggagttcaagaccagcctaggcaatatagcaagaccccatctctattatttaaaataataaaaatattaaaaatttattataaaaaaacaaatatcaggatcatctgtattcaagaaaaatgtactgataagtaggctgctgttaatttctagtaaagaatctaacttcaaatcatacataattttagataaatagaaaaaattctgtatattttaacagtattaggatgattctctaaatataggcaaagaactgaagagttccatagaaggtgactaactataaatgtattatacatgactggaaaagtaatggcaagcaagacttcagagctgagctatcttgatatttttatccagtgtgtggggtgttacacatgcatcacagctataatagagctatcacatggatcttttgaaaaacaagatagagatgttttaaaggcttctgggtttgatttcttagtcagatgctgtggtacttggcatttaacaactagaattcagaatccagatttttaaaggtgaattattttaaataactgagttgtaatagagaagtaatttatttgaaattattttaggaaatggaagataaagtgactagtccagagaaagcagaagaagcaaa

SEQ ID NO: 872 - DNA, 981 bp, Homo sapiens
aaaacagaaatgctgactcctgcataggttatcggccctaatgttctgacttgatatttccagatgcccagctctgcgctaatatcaacaccgtctatttactttctactctgaggcattcgctctgcaggattccagaccctactaaattattcacatggccccaaccggtccttccttgttccgcggtcctaacacaatgaatggtcctaagaggaaaacggcctcgcgctcccgctccaggcccacttcgcagtccctagttctccctactgccgctccagtgccagagcccctccgaaggcggccaggacctccaaccacgcacaagtctgcagctctccccaactttccgttcagctcagtctccgagggtgcgccagagcagacacccggaggagtggggagtggcagggcggggccgggagaatgctgccccggaacccataaatctgggccctgcccaggtaggccgggacagctggggtggcctgggccgagagccaagaaaagacaccccatctggcagcccaacttggcggcaacaggtggcccggcgcccgggggtctgggaggaaagtcgctccgggggcgggccccgttgccccgccgcgtccccattggtcatcaggtttcttaaaatgtgactctgaatctgtgtccttccgccgcagaatttagtcccaccgaaagggcaacctgcccgcgcgttccgccgccgccgccgcgcttcctcctgaaggtgactgcgcccgcggggacgcagggggcggggcccgggtcgcccggagccgggattgggcagagggcggggcggcggagggattgcggcggcccgcagcgggataaccttgaggctgaggcagtggctccttgcacagcagctgcacgcgccgtggctccggatctcttcgtctttgcagcgtagcccgagtcggtcagcgccggaggtgagcggtgcaggaggctacgccatcagtc

SEQ ID NO: 873 - DNA, 960 bp, Homo sapiens
agcactcggatgttgtcacctattcattattttttcagttctattcccaattcccaacccttcttttgaaacacagctaggtatgtgcacttcaaatgctccagaaaaacccaaggtcacatttcaaataggatggttatggtcaccataaaggtggtgacgtttgagtggtggaagagggtgcgggacggcgttgcaggcagaggaacacagccaggacactattataagtaactctgtgatcgtgtcttgtggtgatacagtataattcaacacaggttagagcagttactatgatcgttctttcctaaaaggctttgattttggagaaagaaccttgaggatcggtggggactttcttggcctgaaaggtatcaccagcagcaggagcaggaggctgctcacatttcgtgtcttcacttggggtggacgttggctgcaaccctcaaatgctgggagtcgtcaaccaactgagccctgttgtccaatgtgccccgggcaaggatgtgggtgcaaatcctgcttccgggcgaccactgacttccttggcttcagtgtccaattagaaaaaaaaaagaaagtagaaattcggtaagaaatccgtgaacgaggtccgtcctccacccccgactcaagccaagagatagcacagaacgttcccacacgcgctgtcccggccccggcgagcgtagccgggatttctcccccgccacgcccctcggccacgcccccctgcgtttggcccagcgacggggcggggtcggcctgcgattggccgggaccacgaccgcgtccgggcgcgccacgtgtgcgtaggagcgcaccggaagcgcccggctggaggcgcggcggcagggctgggcggcggcggcggcggcggtcatggaacgccaagaggagtctctgtccgcgcggccggccctggagaccgaggggctgcgcttcctgcacaccacgggt

SEQ ID NO: 874 - DNA, 969 bp, Homo sapiens
ttcagaacaaggactcactgctgatttttcaacagcacagggaattgcactgttcctgggaatgatggacagtaccctctgttccactgggcaagtgagatttcccaggcctctctgttcccttctccccttagagagcaacagacgtggccccatcccacctccctcaaccctctctctcctccctcaggactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtgagtgtagtgccagtatctactctccttcttaaaaaaaaccagggctccagagaatcagaacagccaccatcaccgcagggagtcaagggaggagggagattagagaaggagccagggagggtggcagggaggccacgtgatccgagtcccctcacccctttccttcccacaggtccctggccaaagatttatttctcttgacaaccaagggcctccgtctggatttccaaggaagaatttcctctgaagcaccggt

SEQ ID NO: 875 - DNA, 1008 bp, Homo sapiens
cacctcgggtattcgtagaagtgtcccgcgggctgtggtctcgcgtgggggactccccaggcccgcacccctgtctggggcacctgcgaggcgccaggcaagttgcctggggcggggagtgcggcctgagcgtccaggcttaagccccgatgcgcgggcccttctccgcccaggccggccctcgccaccccgctctcacaggtgagggtgtctgccctgccgccttgggatgcgaacaggcgtgaggccccctcactccctagtgtcacgaggtagggcgggacccgaatcccggccctgccacttcctgcctcgaccactttggagcagttgctcgccccccgcctcagtttccccatccgcccacctcgtcggcaggacccaagggcggtctgtaacctgcagaggccattccacttccctggccggcggcgaaggctagtggcgcggcctgggctggggtcgccccgaccgttcccgaccgacgccacctaggagggtctggggaaggggacgcgaggagctgggaacacgcagcgccgccccagcgggacgggcgggcccgggctggcgtcgaatccgcgcccgagagcccagcccgcggccaggccgccgctcccggagcccgctggggcccggagccccggccctctacgcctggtcgccatcagaacaaaagctgtggctcagcccggagcccaggcgccccgcaggcctggcccgcgccgggccgccagcttccctacgcttggcggccgcgccttcagcccttcggcccgagcacgctcggctctttccgccacggccggcgcaggtggagggggcggggcgggggccgtgcgtggtgacgccgcgggggggtgacgcaccggcgtgccccgcccccaccccctccccgttcaggctctggaaagagaagaaaaaaaactttcttttttttttaattgaggaatcaacagccgccatcttgtcgcggacccgaccggggcttcgagcgcgatctactcg

SEQ ID NO: 876 - DNA, 918 bp, Homo sapiens
ccggtagggtcttacagtaggctcctcaccccagccccagatcctccaagccactgacctcgcttcgctccctcccgccgtctcctaccttccagcgaagctgccggcggcgggtgcttggctgtcccggcccccgggtggaggctgtccacaggcttctccgactccctgtctgcctgcctggcttcctgggaatgcttctccatcaacttctccttagattttggaactgaataggtggatcccttcttttgctcctcacctgaaatatatggatcatccgttagacccgggacttaccgaatgcagggcagtgggtcccatcgtcttcagtcgcctgcgtggatccagaataagctggcttcaagtctcgagtctccgcgtttccgtaaccgcctcaggcgggaaacgcgccgtccgtggcggactcggcggcaggaacggttcgcaccgggccgagcctggcgcctgcgctcacaccgccccgcccagcccagccccgccctgggcccgcgcccaggggcggagacgcggggagcccagcgcctgcgcctcctttacctttcctgggtttctctttgcttttggaaaggcccatgggtgagcccaccgccccctccgacgcaagcccgggtccccacacctccgcggccgcggagccgggagcgactcacaaaaggtcctcgcgccagcggcgtgcgtcaccatggcgaccgcgcgccgcgcagccgcgccccgcccctctggcgggaccggccaccatcctctcgcgagagcatcccgtgcgaccggaagtggggcggcgaccccggaagtccccgccgggtgcagcttggtcggttcgatcgccgccgggacctgacaccgcccggagttggcgtcccttctccctctccgagtgctgctcctgtcattgtg

SEQ ID NO: 877 - DNA, 999 bp, Homo sapiens
agatgctgaggacagagagaggacccaagcaggcaactagttggaggacttgtacacgtttccttccagcagtatgtcagagaggtggcagcccactggggacagggctgcctgggttctgtgctcgaggggaccttgagcaggctatttaacccttctgtgcctcagttgcctgatctataacatgaaaattagcaatccctactagataaagttggggaatttacagagttaatatttgtaaaggtctgagaatattcctggcagagtaagcactctgtgagtatgacactggcatttcttctgcagcactacatgctgtctatgcctttgtccaagtctgaaaccctagaactcttagaattcagttcaatgtttacacaatcctacagttctgctaggcttctatgatgctactattctgcatttgaatgagcaaatggatttaatgcattgtcagggagccggccaaagcttgagagctccttcctggctgggaggccccttggaatgtggcctgaaggtaagctggcagcgagcctgacatgctttcatctagtttcctcgcttccttccttttctgcagttttcgcttcagagaaagcagaatccttaaaaataaccctcttagttcacatctgtggtcagtctgggcttaatggcaccccatcctccccatttgctcatttggtctcagcagtgaatggaaaaagtgtctcgtcctgaccccctgcttccctttcctacttcctggaaatccacaggatgctgcatttgctcagcagatttaacagcccacttatcactcatggaagatccctcctcctgcttgactccgccctctctccctctgcccgctttcaataagaggcagagacagcagccagaggaaccgagaggctgagactaacccagaaacatccaattctcaaactgaagctcgcactctcgcctccagcatgaaagtctctgccgcccttctgtgcctgctgctcatag

SEQ ID NO: 878 - DNA, 958 bp, Homo sapiens
gggttctctttgtggtcacattctttgtttattcaggagactacagcatggaaagaaaatggactttggagtcaggtgaatcttgattcaaatcttggcagtgccattcatcagctctgtggcattgagcgcatcagtggaccactctctgatccccaattgccttgtctgtaaaatgagattagacacccctgctcaagattatggtaggattatatataatgtgtgtaacacagcttttccagtgcctggtacaaggtaagtgtccaataagaagttacaaatgttcctgagccaccctactgggtccctcctcacatccaatgctggactcttcatgcccaaggaaacatataaggcacaaaagtcagtggcactcagctcagcagaagaaggcacaggaaggggatgggggagtcctggctcccactttgttcttggggtcaggcttgtggccagcctggaaagactgacatgaaccctccagcatctgagggtgccaaccaccaagagcagcacagttcttgtctacaagccacttgtagcaggtgtgaacatttcatcttttcctctggggtttgcaactctctccccagtctcggtcactgcctttggctgtaccacttcccttttcttctcgcctgcacctccctcatctttcctctatgatgacatcgccctggggaagagaagctgagaggaactcctcactcagctagcttcaggagcatgacgtcatctctaccatggaaattccactcactctcctgtgcccccacatttgtcctaggcctcagagtccctataaagagagattcccaagtcagtatcagcacaggacacagctgggttctgaagcttctgagttctgcagcctcacctctgagaaaacctctttgccaccaataccatgaagctctgcgtgactgtcctgtctctcctcatgctagtagctgcc

SEQ ID NO: 879 - DNA, 941 bp, Homo sapiens
gctacttctcaccaagcccaataggaactcataattgaaatctacttctcagagtaaacctactactgattggcacctaagaaactccaagagaataaagcccatggcgggcgcttacttttaggctctgcagcagctcactgggctgggtgttttacctgtgacatctcgccatgtccccaaaatggccccatgagggatttcactgccaggccctgcctcagtcacagcctcacactctccctggcaccttggagggagtgagtagggctaggggataaggagaggggccaaatcattcatcacagatcattcattcactcaacaaacacctgctaagcacatactaaatgctgggctttgagctgggtatggggggtgtgtataacagtaaggcagattcagtttctgccctgttgcaggaggagaggcacccttccaatcatctggcccaactctcattctagggatgtgaaaactgaggcctggagagggaaagtggcttgcccaaggccatgcagccaggcggtggcgactgaggtgcaccgctcctgtcagccaacaaatatccattgagcgacacctgtgtcccaggtgctgctctgggccctgggagaagtgcatcagtgggcttggtagtagagggtagggatggagtgaagggtaggcaggaagaatgtccccaggctggtaggaggtggggtggggggtttcagtctcaaaactcccatgaaaaccagagagaagtttcagaactccacccaagaggctgggtttctagggcccagagctgccctcccccaccctagaatgggctataaaagtcccttcccagctacgtccagagaagagctggaggaagtgagaggtcggctgggggtcctcaaagtgagaggggagcagaggatcctcccgtgcaggctgtggatgtcactcacttc

SEQ ID NO: 880 - DNA, 1070 bp, Homo sapiens
gagttttgtcctgcagttccagttccatgaagccctgtgcaaggaggcaggctatgagggcccactgcaccagtgtgacatctaccggtccaccaaggcaggggccaagctccggtgtgtggtgggaagccgggggaagtgggaggcagagaggagcggctggcaaagggtgtggcaggaggtgtctggctgctctgatggggtggggggcaccaaccacagagctggactgatgtggatgcctgtctcctcgctatgtcatcaaatatttattgagtgggccttctggctggcatggggcgacacaaatgccccctgccaccatcagagagatcccaggccccagggtcttattgccacagtttctgcagtccattggggggcggaagtggccaggggcatgtgggccggggtccaggagcagactccagcctgagtcccctgtgcccatggtacccactctgcccaccaggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcataggtaaagccctgagtgaggatggtgtggggctaaggtgggtcctcaactctgggcttggcccaggccccaggttcctggtcagctcctaccagctgagccctggtaccctgtcctggagggccaggcagccccccaagctcatcagcagggcctgcgagtggggacaggcatgtctttcccccagcatcctagagagggtgtgctcagacctgagggcccctccccttccagaggaagccagacacaaggctctgtgaggtcacactgcgggctccgctcttattggccaggggacggtagctgcaggactctgctctcctgcggccatgggccagggttgggctactgcaggacttcccagcctcctcttcctgctgctctgctac

SEQ ID NO: 881 - DNA, 1050 bp, Homo sapiens
acgtggatgagacaggaaaacacaggggagtgtggagacctgaggtgacttggagcaagcctctcaacctgagcggcaatttcttcatctgtaaaatgagggggttgttctcatctctgaggctttgtgtcgctctcaaagcctgctagcctcgggttctaggactctgttgggatcgtgtgtgatgttttctgctgagcgactggcagcctgtgtcctcggggggaaagagggcaggcgctccaaagctcctgcgctctgtggctccccctccctcgcagccccaagccccaggtgtgccggccgccctgagcccctccagcacctcccggaggcgcctgcaagacacctaaggtccccgcctccctcctctcccccccgccacacccctacccccggcaggcgacgtccccgcccctcgaccatggcctggtgaagaagccggccaggcccgatcagccccatccccgccgcacgagcggcgcctgcggacagctcctggggccccggccttgtcactccggaggcgggaggctccggggggtcgggctgggaagatcgagccggaggccgctaggctcccaggccccggccgaggctgcgcggccgcacggtgggcaggctcgggtgttccggcaaactgccgggtccccatcttctaaagagaggaggccctttctccagcttcctctgcgggagcccgacccagccccatcccgccacccccgggctgcacctcggcccctccccggcccgcgcccctgcccggggcgggccaggaacctcggcccgcgccgctggggactctggagcggaggaggaagcgcggcggggcgggggcgggggtgtgtcgggttttataacccgcagggcggccgcggcgcaggagaaggggcagagccgagcaccgcgcaccgcgtcatgggggccgcctcgggccgccgggggccggggctgctgctgccgctgccgctgctgttgctgctgccgccgcagcccgccctggcgttggaccccgggctgcagcccggcaacttttctgctgacgag

SEQ ID NO: 882 - DNA, 926 bp, Homo sapiens
atcattccctgatggagaaaaatttagctttgtttattttagagttataaacgatgctgggtcaggtatctttatgtttgaagatggctccatatttgggttgtttccacagaactctttcctagaaatgctttttctaggttaatggctacagatatttctaggcacctgacatattgacacccacctctaaagtatttttatgatccacaactagcgtttaacacagcgccctagtcactacatgactaataaatagacaaatgactgaaacatgacctcatgctttctattcctccagctttcattcagttctttgcctctgggaggaggaagggttgtgcagccctccacagcatcagcccatcaaccctatccctgtggttatagcagctgaggaagcagaattgcagctctgtgggaaggaatggggctggagagttcatgcacagaccagttcttatgagaagggactgactaagaatagccttgggttgacatatacccctcttcacactcacaggagaaaccatttccctatgaaactataacaagtcatgagttgagagctgagagttagagaatagctcaaagatgctattcttggatatcctgagcccctgtggtcaccagggaccctgagttgtgcaacttagcatgacagcatcactacgcttaaaaatttccctcctcacccccagattccatttccccatccgccagggctgcctataaagaggagagctggtttcagacttcagaaggacacgggcagcagacagtggtcagtcctttcttggctctgctgacactcgagcccacattccgtcacctgctcagaatcatgcaggtctccactgctgcccttgctgtcctcctctgcaccatggctctctgcaaccagttctctgcatcacgtgagtctg

SEQ ID NO: 883 - DNA, 1075 bp, Homo sapiens
gataccagtatgcatgcccttgtgctcacgcgaaccgccctacgccctcaggtggcctgcaggggactggtgcagccccgaggacactcccagttgctcgtcgccctcccatctccacgtcggccttcaccgacccggcgggagccttgagtcccagctctccagagcaatggtggagcgggcagggcattcaaaatgaccttatctccttagtctcctaaagtgttcccagctggccatgcaaatgtcttctctgtgtagcgttccgtggatttttttttgtttcattttttaattttgtgtaaagataaggtctcactccgttgcccagactttccctggttctttattctgattcccacaatcgtcccgagggggcaggccggagcgggtcttgaaaatacacatttgcacatcccttctagtccgcgttcccttttctcaagggcaacccgcacttttttgcctccgttataaaagatacttatgtaaattactgacgtgcgaatttacatacatttctcaactaactgcgtagccatttctccgtctctcacctccgttcctggacggcgagaaggaggaggagctgaccatgtaaatgaagtcacgcgcaccgcgctgccgaactcggtgccccgcgctgggcggggggcgggtaggcctgtccatgtaaatcacatcatttgcgtgccccgccccgccgacgccacttgattccaacatgcaagaaacgccccctcccagacccggcccctcacactgcgttccccctcccgcgcaaagggggcggggcggaggatgcaaatgaacctcgtgtaggccacggaccgctgtttcctttctccttggtaggggggttgtcccgaacttcctcgccccgctccgccccgccccgcgcggctcgggcctgcgcaggcgccgtcccctccgcggggcgcggtcacgtgcccaccgggcgaggcggggcggggcgtcgcgcgcggtgggggcggggtatggcgcgctgtgcggcgcagggcggctggcacaaacggcggcgccggggccggaggaaaaagctcggtgaggaggt

SEQ ID NO: 884 - DNA, 1074 bp, Homo sapiens
tgctgtagtatcctcttccctgccaaccaaatccagaatagtggtccaacacacacacacacacacacacacacacacactctgttccttatccaactgtaatgctttcacccttgcttggtacctttgtacttctcccttcatagtcgactagttaaaaaaaaatacatttctcggctcttttttgaagtaggtgtgattgagttaaaacatatttacttgacataagcttaattattcatcaatgggaacctgaaaagggagtcagagaggccaagaggttagggtggagtagagggggtagggaaggtaagctggggtgcagagggtgcagactggaggaatgggggcgaagtggggtatgggactggggtggcagggaggggctggggagagagagagaagggtaggtgccagagggccaaggattgtggaactggggtggggttgggagttggggggtggggaggagatgtggggtactctgtgaataccttagaagggatagagaaggcagggctaggggtttggaaggggtgggattggaggtcagaggggctcaactggggttaggaaatggaaaggtgagaagaggtgggggttagaggctggggactggggtccagagagcagagtgaactgagtgggttcagaagagtactggcgttggcacttcagaggctggactagagaaggcgcgttcagccgacggtgcgggatacactgccgaggaagtccgcggcgaggggcgtggttggggggtgtgtattacacggtatcccccccttgcctttccaagtctttccctctggttccgcctccttttcaggagtgacataccgttgcccaatcagagcctcaggcctggcgtggcacagccaaccgcgcggcgtggggaggagctggggagggggctcgcaaggccggggagggggctaggggcctccgagggctccggagcggcgactggcgagccatggcgctggggctgcagcgcgcaaggtactgaagttcgggggcaggagttctgggaattggggggctctcctcctggagacccctgagctggattgt

SEQ ID NO: 885 - DNA, 1014 bp, Homo sapiens
ataattttccctagatcctgcggccgccggaccacgaggccggcgctgtgcgttgttaaaaggagaatagcagatggtggcgcgcagccccgcgaggagacatccagcaacgaaatcgggagatggaagggacagtgagaaggggggcctggctgtgcgcccccgcccgatgccccactcctcgccgacgggcgccgggcacctgcgggaagggcgggagaatcgccgctcctttcccgccgcgccctttccgccctctccccgcctccttttcgggcgtcccgaggccgctccccaaccgacaaccaagaccccgcaggccacgcagccctggagccgaggccccccgacggcggaggcgcccgcgggtcccctacagccaaggtaaggcaggaatctcctggactgggtcgcggtcccccggcttcccggaagcgcagtgcgcgggtggcatcactgtgcccggagcccctgcgcgccccggccatccccaccccgagggaccccctacggaggcgacctgggggctgaggtgagcgcttgggcagcagcgacggggaggggtgtccaccccacccctggtgcgggccggggcgcgcaggcctggaactcggggttcagactccccgcgactcggaccacgcggctaagcgcgctcagggtcgcgtgcccccgccccgccgccatgctgggcgccgtggtggccgcgcagctgggcgacagcaggcgtgggcgggggtggggagcggcccctcagcggtccctaccgcctgaggccagggcccggggacttttattgtgacacggcgggcgcccggctctgcttagtcatggtgacctgcgcgcgctccgcgcctcccccacgcgcagcgatggaggcgccggggctcgggcggtggaggcggagccggagcgcggccatggcggggtgagtgaggcgggatgtgcccgggctgcgggcatcgcgggccgcgagcgcccctgcggccgtgcccggagaccaggaaaacgggc

SEQ ID NO: 886 - DNA, 1047 bp, Homo sapiens
agaaaggcttttactctctgcccccattgctgagtccccaacatctcagcgtctctgtctttctaatatctctgtctccccttttctgtccctggggcctctccgtccctgtcactctgccccgtgtctctgtttgcctggtgcctttcttcagctgcggcatcctctgtctcagagtcttggtgtctctgttcctttcccctcggggtctccctgggtctccccaagtccctcctgctgtcttcctcccgctctctgatctctgactcccagaacctctccctctgtctccagggctgcccctctgatcctctttgcttctctggtgtgtctctctggctgcctccatctctgtggatctccatctccctgtctctgtctcagtctgtccttcactctgtgtgtgtgtgtgtctctctctctctccttcccttccactccctcttcctcctgcctccacctctccaggcccctgtcttgtccctccgtccggcctttctctgcctttccgtcctcctgcctccccatctctctctgctagtcctggtccagccggacccccacccacagtcgggccccagcgcttgagcctgagtgtctgctccggcccgtggaggtggagggaggggacgccaatgacctcaccagcccctctccgaccacccccccctttcccttttcaacttttccaacttttccttccgtgccctcctccgagcgcggcggcgtgagccctgcaaggcagccgctccgtctgaatggaaaaggcaggcagggagggtgagtcaggatgtgtcaggccgccctcccctgccgcctgccccccgcccgcccgccccagccccctatataaccccccaggcgtccacactccctcactgccgcggccctgctgctcagggcacatgcctcccctccccaggccgcggcccagctgaccctcggggctcccccggcagcggacagggaagggttaaaggcccccggctccctgccccctgccctggggaacccctggccctgtggggacatgaactgtaagttggt

SEQ ID NO: 887 - DNA, 931 bp, Homo sapiens
gccaactcttgtcactccaagatcacactggggaaccagactgacttctccaattctgaactcgccccggcctcgggcggctcaaagggcctcctctgccgcatccccgccaaaaccaaaccgcctggcacaagccggtaagcaaccaccctgctgggagagggaaggaagagtaggcgcagccctagatcaatttccttgcactgcttctcccagacggtcaagtcagctgcgtcccaccgaaaagggcgcatcgcccacgcccgaaacgcagccgctgggggccgagaaattatccccacctggcccgagggccagggacgcaggagcgcagcagcgtggaggggctccgcgctggcccggcgctgcccgcggtcctgccctcgttccaagggcacggcgccggtacgaggacaccgacgctgtggcgcaactgccgtcccccgcagcaatcccggagcccggctcccggccgcccctcggccctgcgcaggctgcctctccccgacgcggagtcccaccccgctacccgccgcccagacgacctcataaacaagtcctcgaagtgcggaggcaggaggcggggcgcagcgcgggggcaggaggcgggccagggtcagggcagaggctgcggccgcgcgtccccattggccgggacgcagtgagccgcccggagctcggcgcgggcggggcctgccggcgcgtgcccgcccacacacccgcgccggtgcccgccccccgccctccgcgcccgccccgtgcccgccccaagccggccgacggagtttttaaagtgggctgccggccgcgggagctttacactcgcgagcggaccgccacacgggtccggtgcccgctgcgcttccgccccagcgctcctgaggcggccgtacaatcctcggcagtgtcctgagactgtatggtcagctca

SEQ ID NO: 888 - DNA, 1015 bp, Homo sapiens
gctcttcctgaagcttccacatacctgtgctgcagcccgcacctcacgctttcctctttcttgggtctcagcaccccacctgaggcagtggttctggaggcagacacgttccccgggcatgcagcaggccgtgggacagacaccactgaaggagcagagtgaaattagggctgctctattggtatcccccagtcacaaagaagtagacacttttccaaatgttcgatttaggcctttaagttatggtaccaacccttctttcaggcatggcaagccggctgctcgggccctcatttgagtcctacctgctgcccgaactgaccagatatgactgtgaggtgaacgtgcccgtgctgggaagctccacgctcctgcaaggaggggacctcctcagagccctggaccaggccacctgagccaggccttctacctgggcagcacctctgccgacgccgtcccaccagcttcactctctccgtctgtttttgcaactaggtatttctaacgccagcacactatttacaagatggacttacctggcagacttgcccaggtcaccaagcagtggcctttttctgagatgctcactttattatccctatttttaaagtacacaattgttttacctgttctgaaatgttcttaaattttgtaggatttttttcctccccaccttcaatgacttctaatttatattatccataggtttctctccctccttctccttctcacacacaactgtccatactaacaagtttggtgcatgtctgttcttctgtagggagaagctttagcttcattttactaaaaagattcctcgttattgttgttgccaaagagaaacaaaaatgattttgctttccaagcttggtttgtggcgtctccctcgcagagcccttctcgtttcttttttaaactaatcaccatattgtaaatttcagggtttttttttttttgtttaagctgactctttgctctaattttggaaaaaaagaaatgtgaagggtcaactcca

SEQ ID NO: 889 - DNA, 979 bp, Homo sapiens
attgcgtctgtgttgcatgtactgtcccatcctagagaaagaggagtttgaacaaaatttaaactgttctttgtgattcaaggaaatcattaggagcatcaattgttttgtgctttaatgtcctgatatactcagtagggcacagtaacatggaagggactgctggtgtctgcgcttaaaatcccgaaatggctgtgtgctttggttctcgcacctgccttaatggttttcctgtctcctctgttactgggcaatcagctgccgcttttttcagtgtgtgttttcttctcctagccttctccctctttccaatttgccatctggaatctgcttttgattgagcattctgttcacctgttgttgcatgaaaaactatcccaaaacttagtggcttaaaaatgacaactattttatgataactcctagtttctgtatgtcacgaatttgagggctcaactaggtgattcttctgctccatgtgtctgattgagttcaaacagtggtgctcagctggtgaatggactcatctggagggtccacgatggcttcacttacatggctggtgcctttgcagggttcctgggaggctgagcatagctaggattgtcaaccaatgccctacatgtggcctccctagcaaggtggtctcagggcagttggactgtcttcgtggtggctgactttccaaggaagccaggcagaagcaagcaccccttggaaaccaggtggaggctgcatggatttttctgatctagctcaagagttcacacagcatcacttctgctgcattgtattggttacaccaagttacaggccagcccacattcaagggaggtgagttagactccacctcttggtggcagagtggcacagtcacattctagaagaccatgtgggatgggagatactgttgtggtcacctctggaaaatacattctgctactcttaaaaactagtgacgctcatacaaatcaacaga

SEQ ID NO: 890 - DNA, 1067 bp, Homo sapiens
attatgggccagaagttctcctcttccttcctacacctgcttcctccctccctccctccctctttcccttccttccttccatccatttgtgaagaagacatgatcaccctcattctgagagtgaagagacagaggctcaactaatgaaatgatttgttcaaggtcacacgggtggcacaaggcaagtggcagaggttgaatttagacccattcctgtccaaatgctgagtttatgtcatcgtcccgagaccataactttaaagatgtaagatagtgggaaaagagttgatttcaaagcacctctcagaaggactcactttacatcaggggtcagcagactcaggccaaatccggtccattccccgcttttgcaaagaaagttgtagtggaacacagctaggcttattgatttatggattgccaacgtccttttgtgaaacagacagctgagctgagtaatcgtggcgcacaaaacctaaaatatttactatctcgtcctttacagaatgtttgccaatctatggtccggagtccaaggctgtccatttttcaaagaacacaaagtgacatgagactgtcccatgtgcagggagccctatcattttattatgaaaaaacggcctttctgctcaaatctgttttttaaaaagtcaacaaacagactctgggtacctgtcaggaacagtagggagtttggtttccattgtgctcttcttcccaggaactcaatgaaggggaaatagaaatcttaattttggggaaattgcacaggggaaaaaggggagggaatcagttacaacactccattgcgacacttagtggggttgaaagtgacaacagcaagggtttctctttttggaaatgcgaggagggtatttccgcttctcgcagtggggcagggtggcagacgcctagcttgggtgagtgactatttctttataaaccacaactctgggcccgcaatggcagtccactgccttgctgcagtcacagaatggaaatctgcagaggcctccgcagtcacctaatcactctcctcctcttcctgttccattcagagacgatct

SEQ ID NO: 891 - DNA, 1185 bp, Homo sapiens
gtataccatgcaggtttgcttgctaaattgagcctgtaaaccaaaaagtacctcaaacaggtctcaattaatttagaaagtttttgttgccaaggctaaggatgcacccgtggtacagcctcaggagggaggacatccttgccaagctcaagggtgcacccctgaccacaagggcccaaggtggtcggggcacagcttgcttttatacattttagggagatatgaggcatcaatcaatacatgggagatttacattggttccatctggaagggcgggacaacttgaattggggggcttccaggtcataggtagatttaaacatattttgattggcaactgactgaagaattattatcagcagaaaggagtgtctgggttatgaaataggggttgcagggagcagatgatgccttcaggtagcgggatttagagagaaaatagatggtaaatgcttcctatcagacttaaggtctatgtcgatgttaatgctgggggttatgatgtggcatggcctgaacgtcttccgggttaaagtttagagcaccctggcggacagggaaccccattcagatggttgctggggggccttcgaattttatttttggtttacaagccttcccatcagctgcgccagggtcagcaaaccacagtccatgggcccaatctggcctgccacctgctttttgtaaataaagttttataggaacacgcccacacctctggcagctgctttgcaagcacgcagcagggttgagttgttgcaacatagaccacagggcctgccaagcctcaattatctgtgctccgaccctttaagaaacacttctctcacccctgagctaagcagaataagaggggctggacgtgcaggactcagagtgggagcgaggagggctggggtgaggacagctttgtcacactctgtttttctgtcactcagccctgggggctccctctgcctgagggcttcgtcccctgctgcctggccgtgacccgcagcacaagcacagataagcctcagggaacaaaaggcagggctgccacggaagcccatccaccaatcctcacctctcacctctgtgtccgccctgctgggaaatattccaggctttggccaaggccagtgcagccccaggttcccgagcggcaggttgggtgcggaccatggcctctcacaagctgct

SEQ ID NO: 892 - DNA, 914 bp, Homo sapiens
ctagtcgaaagaaccgcaaaagataacaaaacacaatagactgaacgccctgagaggggcataagtgcagtgctctaggagctgtaaaagaggtctcgatatccactggaggaaagtgcttactggagttcatttctggagtgggtttaaaagatgaacagagggaatctaaaacattcacacaaaatcaatactacacgtacacattttattattttgtggaaagaccacttagaaacaccgcaatcacttctactactcagcagatactgagcagtaggtttcgtgacagagcacctgtcttttgtccagtctgtttactatacattgcgtgctctgggcagtccttatcttcgtgttcaggaacaaagtacacacacccctttccgaaacgaagggcccagggactccgagaagggtgggagccctcacggccaggccacacaatggggagcctctttaccctagtcatcacccacccttgcaggccccactttgccagggtgcgacttctcgggccccttcgcccctcccctgcagcccccaggagcgcagccacagcccggccgggcgccctccctgtctctctctctctttctctctcgagctttcctcctccttcaccgggagccggaaaacccggagcgaaccagcccagcacggcagcgcatgctcagtagcgagcaggttcagttcgctagtaggaagctccagcgctacaccggcggcggcggtggcggcggcggccgcggcggcacctcagggcagccagattccccaacaacgacctccggtccttccccttccccgcgagacctccgccccagctccgccccgcccggggctcttgcgtttcggagtcccaactacgcggagcgggcgccgcggccggagcgtccctccacacgtcctcc

SEQ ID NO: 893 - DNA, 959 bp, Homo sapiens
gggttgtggtgtattgcgacccggcgccccagccccacgcccgccctgccctccctgcgggctcccgagcggcggaaggcagagcagggcgcaccggcgccgggcccagcccggttcccccgggagaagtgtcccgtcccggtgccggcccgcgcgctagctccgcgtcccggctcccggcacccaccgacccctccacagctgcgcgcgtcctgcctgggggccggagaccccggccgccgggcccctccgctctcccgaggcgcggccgccgggaggaaggcaggtagaggcgctgggcggggtccgggcgcgggaagtcccgggctcacgcctcccgcgaagcgcaccttcagcccacctcggtccgcccaccgccccgcctcccgcccgctcccgcgcccgcctccagtctccgccttcctccagccgctctccccgctccccactcccctgcaggcgcggctggggcgaaagcctgcgagctgagcgggcgcaaggtcctccgcgcctcctttaagaaccggcccagcccggcccgcgcccccagagcgtacggcatccgcgtggcgggagggcgcgactttctccggtcccgggcgggacggggacggcggcgggacaacttgggaaacttctctggggcggacggcagggaccccgggcaccggtggaggaggatgtaggagggcggctgctggtcctgggtgttcccgacctcctaggccccgctcgtccaggccatggggctccagcgccctcggcgccgcccgaggggcgacgctcttgtctagccgagccgggcagcgctgtcgtccacggtgcgcactgggcgggcagcgctccctctgcccacctcccgccccgtcatggaccaccaggacccctactccgtgcaggccacagcggccatagcggcggccatcaccttcctcattctctttaccatcttcggcaac

SEQ ID NO: 894 - DNA, 954 bp, Homo sapiens
tggccttcacctgaaaatgttatccctgttgaagctttcaagccagtattttcataagaactatattttctttggtgaactgaggcattataatgatgactatacaggttcttgagtgactgaagccatcattagcattgtcattatttttgtttagttgcatctccatagcagctcacattcacaatgtgctttgcaattgttccttagcaatagccctcacaagattctcaggaggagagggttaatcaggattaacatttctgtgttgcctaaagaggaaccaaggtaagcagaaatgtagccagttggctggcatcactgttgcttcaggattcatccttagacacccaagcttctaccctagtctggtgctacacttacattgcttacatccaagtgtggttatttctgtggctcctgttataactattatagcaccaggtctatgaccaggagaattagactggcattaaatcagaataagagattttgcacctgcaatagaccttatgacacctaaccaaccccattatttacaattaaacaggaacagagggaatactttatccaactcacacaagctgctttcctcccagatccatgcttttttgcgtttattattttttagagatgggggcttcactatgttgcccacactggactaaaactctgggcctcaagtgattgtcctgcctcagcctcctgaatagctgggactacaggggcatgccatcacacctagttcatttcctctatttaaaatatacatggcttaaactccaactgggaacccaaaacattcatttgctaagagtctggtgttctaccacctgaactaggctggccacaggaattataaaagctgagaaattctttaataatagtaaccaggcaacaccattgaaggctcatatgtaaaaatccatgccttcctttctcccaatctccatt

SEQ ID NO: 895 - DNA, 964 bp, Homo sapiens
cattcattctacaaatggagggctcccctgggcagtaccctggagcaggcactttgctggtgtctcggttaaagagaaactgataactcttggttggtattaccaagagatagagtctcagatggatattcttacagaaacaatattccacttttcagagttcaccaaaaaatcattttaggcagagctcatctggcattgatctggttcatccatgagattggctagggtaacagcacctggtcttgcagggttgtgtgagcttatctccagggttgccccaactccgtcaggagcctgaaccctgcataccgtatgttctctgccccagccaagaaaggtcaattttctcctcagaggctcctgcaattgacagagagctcctgaggcagagaacagcacccaaggtagagacccacaccctcaatacagacagggagggctattggcccttcattgtacccatttatccatctgtaagtgggaagattcctaaacttaagtacaaagaagtgaatgaagaaaagtatgtgcatgtataaatctgtgtgtcttccactttgtcccacatatactaaatttaaacattcttctaacgtgggaaaatccagtattttaatgtggacatcaactgcacaacgattgtcaggaaaacaatgcatatttgcatggtgatacatttgcaaaatgtgtcatagtttgctactccttgcccttccatgaaccagagaattatctcagtttattagtcccctcccctaagaagcttccaccaatactcttttcccctttcctttaacttgattgtgaaatcaggtattcaacagagaaatttctcagcctcctacttctgcttttgaaagccataaaaacagcgagggagaaactggcagataccaaacctcttcgaggcacaaggcacaacaggctgctctgggattctcttcagccaatcttcattgct

SEQ ID NO: 896 - DNA, 984 bp, Homo sapiens
gtattacacactgttgaagggcgccatctgtggcgtggtggctgcgctttggtgggaagaggttctcttggggttcccgtttttctcccagctctgggtgggcaatactgaccactctccgacctaaaggggcttctccgtttgcctttgacgacctgagcttaggagaatggagacacgtgggagttcagaggagggcgttcagggtgactgcgaacacgagctgccggagctgtccacatctcccctaggcagggcccactggccccagcccgggaagggagcaagggcgggagggcagttggcagtggcacggtctgggtccaaatctttagccccccccaccccggctggcgccattctcgggcggtaaagtgagataaaagcagggcaaggttctgcaactccaaatcagggaggcgcagctcctacaccaacgcctttccggggctccgggtgtgtttgttccaactgtttaaactgtttcaaagcgtccgaactccagcgaccttcgcaaacaactctttatctcgcgggcgagagcgctgcccttatttgcgggggagggcaaactgaacgccggcaccggggagctaacggagacctcctctaggtcccccgcctgctgggaccccagctggcagtcccttcccgcccccggaccgcgagcttcttgcgtcagccccggcgcgggtgggggattttcggaagctcagcccgcgcggccggcgggggaaggaagggcccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccg

SEQ ID NO: 897 - DNA, 901 bp, Homo sapiens
ggaagttgcgggaaggtctggggactgagcccgctcgcgtgggccttgggggagaatccagccgcgtccccgggcccgagagctgggactccggagcccctaagtttgagcggcccggtgggcggcggggcaagagggggcggacgctggccgtctgagccggcgcggcccggcccttccggggctgcgcggctcccccgcctcggtgccggcaaaaatgtgcctagtcacggggccgctctcgggggaactgaggtcgccttcgggctgggacccggagccccttcgccgcgccccaagacctccttgagtgcgggctgcgacgcgctcaccccgctgggccgtctgtgggcgcggctttgcgaagtcatccatctctcggatcactctctggcagccttgagctctcttgaaagcccagccccgggacgagggaggagcgccttaagtgcccagcgggctcagaagccccgacgtgtggcggctgagccgggccccgcgcactttctcggccggggaggggttcgggctcgggcacccggagttggcccctcgtaacgccgcgggaaagtgcgggcgagggcagtggactctgaggccggagtcggcggcacccggggcttctagttcggacgcggtgccccctggtggcgctcaccgcgcgcgtggccttggcttccgtgacagcgctcggttggccgtcacagcagccctcggttggccctttcctgctttatagcgtgcaaacctcgccgcgccagggccaagggacaggttggagctgttgatctgttgcgcaattgctattttccccagagcggctttgtctttggatttagcgtttcagaattgcaattccaaaatgtgtaagacgggatattctcttctgtgctgtcaaggg

SEQ ID NO: 898 - DNA, 914 bp, Homo sapiens
gtagttctattccccatttgccccgtcctcccagcatgccagggatacaggggcggatagagacaggttcagttccctttggtctcttgcattcccccttccctcagcacaattcctgggctcatagcggatgctcaataagtatttgtagaatgaaccaaagaaatcagacccttggtgacccagggctacatgtactcggcggaaaactggggttaaaccggacccttggttggttgaaaaattaaaataatttttaaaaagtgggcgtgaaataatccagaagttggagggcctggacaaaggctggggaggggactcctcccaccaggcggcctcagggtcggcttagcaagaaaggaggcgctggggagacctctggggtcccagctgccaaggtactcgccgctccaaggagatgcggacgccggataccagctctgcccaagattgctgggtcccgccgcggcctttaaaggcccaccacgtggctgcgcggccagccctggtccggaggcggtgcccgggtggcgcctgcgcactgcctagcagaggggctggggttccgagaaaaagcgtctggagaggaaggggaggctgcttggggtgggacgccgtgggaggagtcggctccttatgcaaatcacagcggagcgcgcacggtccggaggcggggcttgcgatgcaaagacaggtccgtctggcgaacagcgagggggcgggccgcaaccctctgcctctttccgcgagcgctgacgtcgccgacgtgttgtttaaaagcggccgcgcaggcgcagtgagcccaaatgcgaacttaggctgttacacaactgctggggtctgttctcgccgcccgcccggcagtcaggcagcgtcgccgccgtggtagcagcctcagccgtttctggagtctc

SEQ ID NO: 899 - DNA, 1049 bp, Homo sapiens
cttcgctctggttgcaataaacttagtctttttgtgggggggttcccatgcccaggaatccctgagttctctttgggaaggtttttattattgtaaaaattaaagtgaaaagggaaagtgtgagaacagaaaaatgtcttttcctgatctattctttgtgtgcatgactctattttttggtctgtggctatagttaccttttatgccgttaaaaaatacatatccatttaagtcaggggtacttgaatatgcagatgagccgatatgtaatattcctggttcatttgagtaataaattctgcagcccgctctttatgatggtagatcatattcctcaccaccaataaatattgtaaagtactttcgctgtagccatgctaacccggggcatctgtcattccggttgctgctattaggaattattggactgaaccactggcagagaaagcagaggggggtgaatgtggtggttgtgatgctctctgcccttttgtgtgttttgctttttaaaaaaactcaatcatgctgcacattgagtatgaatcagtgtggacaaacataggcaccttctgttggccgaggctcagagcaggacacaggactccaccggactgggacacctctcacccccaattcagcagatccatctttctgatgctatactgtaaatttatttcacctcagagagtaaacagatatattggagccccaagggttcatgggtagcgtatttacaaaggagcctcctccgccagcccgtgccaccgctgctaatgagagcagtcattaagtaaatgagacgtcgcctttagctggcttaggagttcgcacactaaggggagaagatatttaattgaaacccgcacgcaggcttccccacatgtgaccgctgtacgggaggcagctgccttccctctcctcccccagtccaccctgcaccccccatgtaaatttcatgattgctttccgtgatgtcattttgaaagaggacagacaatagctgtggggaaaggtaagtcaacgttacgttctttctgacaaaggcagat

SEQ ID NO: 900 - DNA, 988 bp, Homo sapiens
tcaaaaatcaaacaaacaaccccctcgccccggacaaaagtagtttgcactattttctcatttcacaatatgtttttgaaatatttcccttgaaaggtaagtcatatttatcattcctgttgtatggaggcatcataaattatttcaccattctaccctccttgagtgttgtggcctttaggccagacaaaaacgcaggtgatgcctagaagccaactagttgccgtttggttatctgtagggttgtggccttgccaaacaggaaaaatataaaaagaataccgaattctgccaaccaaataagaaactctatactaaggactaagaaaattgcaggggaagaaaaggtaagtcccgggattgaggtgtagcgactttctataccctcagaaaactaaaaaacaagacaaaaaaatgaaaactacaaaagcatccatcttggggcgtcccaattgctgagtaacaaatgagacgctgtggccaaactcagtcataactaatgacatttctagacaaagtgacttcagattttcaaagcgtaccctgtttacatcattttgccaatttcgcgtactgcaaccggcgggccacgcccccgtgaaaagaaggttgttttctccacatttcggggttctggacgtttcccggctgcggggcggggggagtctccggcgcacgcggccccttggccccgcccccagtcattcccggccactcgcgacccgaggctgccgcagggggcgggctgagcgcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaagg

SEQ ID NO: 901 - DNA, 963 bp, Homo sapiens
agcagggaagcagtttgtatgacaggtgtcccagtccaggcggataccaggtgctgccagagtgtggaggaggcaggcggggacttagtctcctccctgggtttggacactggcatcctgctttatgtgtgacaccactgcacccctctgagcctcggtttccccatctgtaaaatagaagcgatctaccctcacaggtcagttgtagggatgaaccatgaaaatactagagtctctgttttttgacaggaactcaaaaaacagatcctaaatgtacatttaaagagggtgtgaggaggcaagcagtcagcagaggattccagcaggtgacattttagggagctggagacagcagagcctggggttgctaagttcctgatgttgcccaccaggctattgctctgagcagcgctgcctcccagctttctggaaccttctgggacgcctggggtgcatcaagtcccaaggggacagggagcagaagggggggctctggaaggagcaaaatcacacccagagcctgcagcttctcagatttccttaaaggttttgtgtgtgtgtgtgtgtgtgtgtgtgtgtgtatgtgtgtgtgtgtgtgtgtgtgtgtgtgttttctctaaaagtcctatggccagactttgtttcccaagggtcatatgactgctcctctccaccccacactggcccggggcgggctgggcgcgggcccctgcgggtgttgcaacgcccggccagaaagtgggcatcagctgttccgcctggcccacgtgacccgccgagcataaatgtgaccggccgcggctccggcagtcaacgcctgcctcctctcgagcgtcctcagcgcagccgccgcccgcggagccagcacgaacgagcccagcaccggccggatggagcgtccgcaacccgacaggcaagcgcggggcgcgggacgcgggacgggcgcctttctctcccaaccct

SEQ ID NO: 902 - DNA, 986 bp, Homo sapiens
catcttgtttgtgtgctaggctgggggggagagagggcgagagagagcgggcgagagtgggcaagcaggacgccgggctgagtgctaactgcgggagccagagagtgcggaggggagtcgggtcggagagaggcggcaggggccgagacagtggcagggggcccggggcgcacgggctgaggcgacccccagccccctcccgtccgcacacacccccaccgcggtccagcagccgggccggcgtcgacgcctaggggggaccattacataaccccgcgccccgcggcgtcttctcccgccgccgcgggcggccccgaacggagccccggggggcgggcgctcccagcacctggccgccggcggtgggggccgtagcagcggccgtatttatttattttccgcgggaaaggaaggcgaaggaggggagcgcggcgcgaggaggggccgcctgcgccgccgccggagcggggcctcctcggtgggctccgcgtcggcgcgggcgtgcgggcggcgctgctcggcccggccccctcggccctctggtccggccagctccgctcccggcgtccttgccgcgcctccgccggccgccgcgcgatgtgaggcggcggcgccagcctggctctcggctcgggcgagttctctgcggccattaggggccggtgcggcggcggcggcgcggagcgcggcggcaggaggagggttcggagggtgggggcgcaggcccgggagggggcaccgggaggaggtgagtgtctcttgtcgcctcctcctctccccccttttcgcccccgcctccttgtggcgatgagaaggaggaggacagcgccgaggaggaagaggttgatggcggcggcggagctccgagagacctcggctgggcaggggccggccgtggcgggccggggactgcgcctctagagccgcgagttctcgggaattcgccgcagcggacgcgctcggcgaatttgtgctcttgtgccctc

SEQ ID NO: 903 - DNA, 1045 bp, Homo sapiens
taacttgttctattgggagcggacgagaaaaaaaaaaaagacaaaccctagaaatgtcttcaggtcccagccatgtttaggaaaatacttgaaggcttctgcggtgagagtgctacctggtaagggcgtatggacacacgtggagggcaagaaatgaatttgggtctggtgccgaaacatctttccactgctgtgattttgttttctggtcagagtaataatgctcgttgtaaaataaataaataaataatacataaaaaggaaaaggaaaattcagagaaaatgaaaacaactcgtaatcaacgtgctttttggatgtgaactgctccctttgggagggcaatggagaagtgaggacgcactgggtatctggcccggaacagccggcagtgggtacaccctgcctggtgaattcgaccggggttttgggggacccgccacccaagggccgaagagcagggccgccctacgggcgctcccatttggccacctgagtggcgacttggcgccttcctcggagcagctccggggttccgtcgtcccggttcccactggtcccttacgcagagaccaaaggcaggaaccttccctcgtaactatccaccgactgaaaatagattctgagtccgcccccgcccctccccccttaaaatcctccccactcttaaaatcctcccctttaaagggagccacagggtgacgccgggggagtttgcggaagcgctaaccgcgttggggcctagggcggatcccgtgattgggacaggccccgcccccggctccacttcccccattgtgtgagcggctcgggcctaggccccgcccccctccggaggcccggccactccccttttccacccccccttggctcatttccggccgccgccgctaccgctagcctgtaaggaggattcggcagagggaagaaacaacagccgccatcttgtttgtgtgctaggctgggggggagagagggcgagagagagcgggcgagagtgggcaagcaggacgccgggctgagtgctaactgcgggagccagagagt

SEQ ID NO: 904 - DNA, 904 bp, Homo sapiens
gaacatggagtgtgctcaacaaacatctgaactaacctgattggcgtatcctctcagtgtctccttttagtctcgacaattgtgtttcacactttctcagtatgcaaatatctttctcggtctgggtcatgcctttcggtttctgccccagtgcagaggcctctaagtttatcagcgtgtggaccacagattcgcagaggcctgagctgcggcgctgccgggatatggcgcgtcgtcgggcctcaagcacagcccggggtccctcgctggctctgttcggaccctgctcggtcgctcgcctgggccccagccatctctcacttcagcccatgagttctgccccacgtctgtctccctgggtgtcttaagagacgcgacccgcaccgacgcccccgcgaatgcaccgcgaatgcacgtgaccgcgcctagtggcgccccctcagtcaacgccgtcgcagtgcccctcccgaagcccgccgcttccgccggcccgcgcggccccgcccccagccgcgaggaaccaatccgcatgcacacttcttgtccccgccccggcaccctcctcggcgcgcgcccctccctccgcccgcccgccggcccgcccgtcagtctggcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacat

SEQ ID NO: 905 - DNA, 1043 bp, Homo sapiens
agaaggcgttaactgtgtgaaggctggttgtgggtgggtgggctctgggcctcgaacccgggggctgagggagatagtaaacagcagggtgactgacgggaagatcatgttggtagccctgcgaagatgctgcagggctgtgggggtttgtgtgactttgcagttcaacaaattcaaattcagccaacgctggcagggcctgttgtgccaggcaaccagctaggaggaggagactcggacccagcttgcagctgaagggcgctggctgccgggttctgtgggttcaccttgcggtgtcttcccttgctaacactgagtccttacaatagccccatctccaggttgaggctagatggaggggacagagggaagtgacttgcccaaggtgacccaagctcccgagtgccagggcaggatctgaattcaggctctcagactgcagagcctgagtccctccctgccatgcctgtgccagggtggaaatgtctggtcctggaggggagcgtggactcctggccttggctctggagacatccccctagaccacgtgggctcctaacctgtccatggtcactgtgctgaggggcgggacggtgggtcacccctagttcttttttccccagggccagattcatggactgaagggttgctcggctctcagagaccccctaagcgccccgccctggccccaagccctcccccagctcccgcgtcccccccctcctggcgctgactccgggccagaagaggaaaggctgtctccacccacctctcgcactctcccttctcctttataaaggccggaacagctgaaagggtggcaacttctcctcctgcagccgggagcggcctgcctgcctccctgcgcacccgcagcctcccccgctgcctccctagggctcccctccggccgccagcgcccatttttcattccctagatagagatactttgcgcgcacacacatacatacgcgcgcaaaaaggaaaaaaaaaaaaaaaagcccaccctccagcctcgctgcaaagagaaaaccggagcagcc

SEQ ID NO: 906 - DNA, 924 bp, Homo sapiens
ctcaagaagtcacccaatggtttcattttttgcagtctttgttgtcccagaggagtaagaactaaaagcaccaggactgtgacatgctggaaacatggcatgttccaaagagaataaaatacagttttatgatacacgaattgtgtgtgatacattccaatttctcacattgaacaaattaccaatagcaatatgtgtgaagatggggcgaggtgagagtgaggaggaggagtagagaaaggacggggcggcgttaaggatacagcaaataactggaattccgcaaacactggggtgatgcaggcaatgcccttagcacggtcccggcaggaggcggtgggatcaggccgacccgggtcccaggggtgacagcgtcccttctccactgcagaatatcgaggtactcaaccctctgaacctcagttttctcatcagttcaatggggaaaacgggatggtaacccgtaatactggcggcgcggaggccggggagcgctccctacctgttggccggcggactggggactgtccgcacccgccccggggagcagcgagggcgcgcgggcggggtcgcggggaccccgcaagggctctggggaccgggacccgcagggtaggtcgggacgggcggggcggggcggcctgaccccgccccgggccggaggggcggtgctgcctcccgccgggccccaggcactgccctccggccgccgcgccgcccgcccgccggggccccgctgtccgccgcccgccgccgctggagctagaggtacgaggggccgcgccgatgttgcgggggacgggggctccagggggatcctgcggctcgcagtggggaggaggcgcctcgggaaggcaggggcaggggcggaggggctgggccgccgccctagcccgggccacctgttctggaggcgacatttgt

SEQ ID NO: 907 - DNA, 950 bp, Homo sapiens
caccagagtgctctgcacatagtaggtctaattatttttccctctttactaatcacccatgccttgtaagaattcagttagttgactttttgtactttataagcgtgatgattgggtgttcccgtgtgagatgcgccaccctcgaaccttgttacgacgtcggcacattgcgcgtctgacatgaagaaaaaaaaaattcagttagtccaccaggcacagtggctaaggcctgtaatccctgcactttgagaggccaaggcaggaggatcacttgaacccaggagttcgagaccagcctaggcaacatagcgagactccgtttcaaacaacaaataaaaataattagtcgggcatggtggtgcgcgcctacagtaccaactactcgggaggctgaggcgagacgatcgcttgagccagggaggtcaaggctgcagtgagccaagctcgcgccactgcactccagcccgggcgacagagtgagaccctgtctcaaaaaaaaaaaaaacaccaaaccttagaggggcgaaaaaaaattttatagtggaaatacagtaacgagttggcctagcctcgcctccgttacaacggcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccg

SEQ ID NO: 908 - DNA, 1053 bp, Homo sapiens
cagtaactgtgaagtctggggcttttggggtggggggctgcaggttaagtcctggggagagctagagctaccttaggaccctccccttgaatgttccaggcagcaacccccctctcttatttcttcccccaccaaaagaatgcaggccactaggagtgagtgaccagcgcctgcgagttagagctattttgggcaggagagcaggcgtcggattccagtgttccaggcagggggaggggacgagggttaggcctgaggcgctttccgactccccagcctgctgtgggcgaggctctaggagatgagctagcttcccgctcctcctgtccctggcctcagtctcccatccgtgtaagggccgggcagcaaggctttcatcctttgcaattgagagaacgcttcctgattgttctcatggcttagaaataccccttgatttgcattcgaaggaaataaggagggctgaacgcagtcgacgggtggccagttgctgggccagttcgcagtcctgactgtcccttgattagtcttagaggcccaaaggcctgaagttgggcggggagcccctcccccacactactggttctgaaggctccgagtgaccgggaccgaccgccggggtgtgtcccgggacggacttccctggccgtgggggcgaggcttccataatggggcgtgacttttagggcgggggagtggctagccaatgagcagagaggtgctggccggggcggggcttgcgcgcgggtgcggcgcgctgcggagcggccgacgcaggcagaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctg

SEQ ID NO: 909 - DNA, 972 bp, Homo sapiens
ccacaggagtatgcagataagggagtcttgatccttattaaaatgctgattctcagagccttgagatactgatttagaaagtctgtgctaggtcaggtatccgcatttgaaaagctgcccccatgtaattctgacggaagcagcaatgtgcttgtctaggttcgctattgtgagaatcaagttgatatttacctaacctatatcctccacaaaagcagacagtctggctctgctcttctttcctccatccttagcccacagcacagaaactggcacattgcaggtgctttttgctatgtcagttcctcacctgcttaaagaggtcagggaggacagtcttcctgggcgactcctggcctcaggaactcagatgtgtgagcctcgcccataagaaacaaggtggaggaccctgtagggcaggaaaatcatgttaacagctttggcgtggggcactccccaggataggcacaggagctgtgcaggcaagtagaaaagagcactgggagaacggcccagttcacagaagaggaggcagcaagtctgcacactttgtactatgctgaaattgttcaatcactcgacagttcagaaataaatataggaagattttgaaaatcctacctctctgctctgctccacagcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaaactccattctttcctaaatattttcaacaaaggatttctttatgcattctgcctaaatacctatgcaactgagcccttccttctcagctcaagattcgtctggtctttccctacagctttg

SEQ ID NO: 910 - DNA, 993 bp, Homo sapiens
ttttatgcagatttggtccaagctcataaaacagataaattcttccaaattaaattcttatttttgtttacttaaatttggcatgctagatatcatgtttcatatcataaagctgcaattaatcatttgttagacttttagaaatagtcatgcaccacataataatgtttgagtaaatgacaaactgcatatgtgatggtggtcccataagattataataacatatttttactgtacattttctatgtttgcatatgtatagatacagaaatatcattgtgttacaattgtctatagcattcagcatagttatagactgtacaggtttgtagcctaggagcaataggtataccatatagcctacctagatgtatagtaggctatatcatataagtctgtgtaagtacactctgtgatagtcacacaatgacaaaatagcctaacaatgcatttctcagaacgtatccctgtcattaagaatgactgtagtaaaaagctacatgttttgattcattttacataattcttatcctgatttactaaaagtgcactgtttgcaggacactgtgctgtgacatattgtcagaggaacaaagggagcatttagacacgttctctgccctcctggaatttacacaatgaatggaaaaaggcacagagttatgcacaccctaatgcctccaacaataactgttgactttttattttcagtcagagaagcctggcaaccaagaactgtttttttggtggtttacgagaacttaactgaattggaaaatatttgctttaatgaaacaatttactcttgtgcaacactaaattgtgtcaatcaagcaaataaggaagaaagtcttatttataaaattgcctgctcctgattttacttcatttcttctcaggctccaagaaggggaaaaaaatgaagattttgatacttggtatttttctgtttttatgtagtaccccagcctgggcgaaagaaaagcattatta

SEQ ID NO: 911 - DNA, 1033 bp, Homo sapiens
ccactgtcctagaaatacggtcaacccaccctttcctccctcaccttcttcactctcttcctccccttctccgcctgtttctccttttccgcttcctccaattcctctctggtcctcttctcaccttccaatcagctggctctgccactgactggatgcctgactcgggcaagtcacctcccgtctctaggcccgaggagaggcagtcggctaggccgagatgcccctgcccggctcccccctcgccagggcgctcggcctgggctcccccgtatcccagatcctctgtgcagctgtggccgagatgcccctgcccggctcccccctcgccagggcgctcggcctgggctcccccgtatcccagatcctctgtgcagctgtggccgagatgcccctgcccggctcccccctcgccagggcgctcggcctgggctcccccgtatcccagatcctctgtgcagctgtggccgagatgcccctgcccggctcccccctcgccagggcgctcggcctgggctcccccgtatcccagatcctctgtgcagctgtgctgggagggagctgctgcgtgaatgagatcatcctccagctgccctccagccccgactctgggattctgacctctccttccttccacgtctgagcttttctctctccagttagacacggtatctggagtctttctagggcgcgaggaggggaggataccctggaacgcggggtaggaggctgaggcgagagccccgagcagcggcgcccgggcccgagcgggaggcctccagcagggggcgcgccggggccgcccaggggcggggtccggggtcggcgggaggtgacctgcgccccaggggcgtggattccgcccgggaactcgcggccgcacttaaggagctcgggccagcgcgagggggagcagggaggaagcccggctgctgcggacctcctcggacccggacccagccccagcccggccccagccagccccgacggcgccatgcggggtccgagcggggctctgtggctgctcctggct

SEQ ID NO: 912 - DNA, 1024 bp, Homo sapiens
agctgtggttatatcttgggcagtggggttcaattgtttgacaagtatttattgagtgctttctaggtgccaagtacaatttaagttattgaagatatggcagtgaaacacaacagagcaacatgtctaactttatggaattcagcggggagagacaagcagcaaaatacatagttagtgtatcagattgttccatgtaccacggttgaggcagaagaatagggtctggaggcagggaacctaaggctgattcacactgacttcctagaactaaattgaaaggaaaacaccaacttttcacacctaagtaacaaaaggaccagaggctactccctgtgcaactccctccctccccttttactgcatggcagatggaaaattgaaagtccctctgattggttgctttccacaaccagtcagacaaattgtgtgccaagtcttcatttgcataggcgtgtaactttataacttcaatttatcctctaattggcaattagacatttgcatgggtataactttgtaacttcagcctctgattggttgctttccacaatcaatcagactgatctcaggccactacttaatttgcatggggtgtacatcaagtggccaatggaaaacttctagagaatatttggacctcagaagaccctgtaaccagggcccttgagctgttgatcagcccactcctaccctatggagtatactttcattttcagtaaatctctgctttcattgcttcattctctccttgctttcctgtgcattttgtccaattcattgttcaaaacaccaagaacctggacaacttgtagtcaagacactccaccaatatcatggagaaacatgaagctgagatggaagctggggccagatgtgaaggtggaggggaaaggtgagtgctattgcaaacaacattcagcaaggaccccgctgacaagagagcatttgcgcatagggctgaaaaaggtaagggagcatccccagaccagtggagattgtaaaattccttcttggccctctc

SEQ ID NO: 913 - DNA, 937 bp, Homo sapiens
gaaagggctgctatgattgagaaaagttcatggcagcaaaaaaaggacagacgtcgggagggaaacactcctagttctcccagacaacacattttttaaaaagactccttcatctctttaataataacggtaacgacaatgacaatgatgattacttatgagtgcggctagtgccagccactgtgttgtcactgggcgagtaatgatctcattggatcttcacggtgggcgtgcggggtggacagcctcacacccccattttacagatgatgaaaaggaggtgcagggagtggtgcagctgcttcaggcgtacacagataggaagtgacaaggctgggactctgcagcctgagtgtgtcatcacgacccacccgctgctctgctctcataggtatgacagcacagctctggagcaaatgccacgcacatttgcaaggtgcccatttccatgcagcaaaaataagtcaataagttattgacttacagaaaagcaaagggcctctcaataaagaggtcattgtacacctctccaaacaggcgattttctttctcatttttattcccctgctgtgtgctgaaggtcactggctacaagccggtgaagtcgcggaatggaatccttggcccgaaaacccaaaaatgggaggggcagaggaggtggggacagagcgggaggaggtggaggcgaagcaattctacaacccggggaggtctggcctgcttttcctccctgaactggcccaatgactggctccctcacgctgaccactcctctgggctggcctcctgcactcgcgctaacagcccaggctccagggacagcctgcgttcctgggctggctgggtgcagctctcttttcaggagagaaagctctcttggaggagctggaaaggtgggtgctaagttgaggttcattttgttcttctcggagtgtgc

SEQ ID NO: 914 - DNA, 1007 bp, Homo sapiens
tatgcagtccaaagacagaaccaggaatggtgagcccatgagcctgctggacccagcccctccgaggtccggagtgacaaccagtgccgtatttctagatcaaacctgaacccctcctacagggaaaagatttccaggggattttgaaagttccaacattttacagggaagaaggaagataagcaggatatgaaagaagagttcatgttatacagccctggcttccactgacgctaacactggattcagcttttgacactgataatctgttgccaccaaatggaaaacgtaaacaagatattctaagtgtggttagagaatatgcaacacaaggaacaagcagaacattcttctctggaatctgacataatggactgtactttcacagacagcactgatgttagatgtacgtgaaataggctaaactgaaaataagaaaggctgaggcagagaggataatatagctccagcctatctcccagcaccttgttaatttctctcaatctccagccacaaatccgagacacaacgctcttcctccaaagaggtcgcgccttctctgtggtggttctcagggatccgccccagctccttctccgttcccagccccacacactgggatcaccaggcacccaagatcccacctctcaggtggtatcttcagcgcaggctgccactcagcccccctccagggatctggggcagaaggcgaatatcccagagtctcagagtccacaggagttactctgaagggcgaggcgcgggctgcatcagtggacccccacaccccacccgcaccccaagcgctccaccctgggggcggggccgtcgccttccttccggactcgggatcgatctggaactccgggaatttccctggcccgggggctccgggctttccagccccaaccatgcataaaaggggttcgcggatctcggagagccacagagcccgggccgcaggcacctcctcgccagctcttccgctcctctcacagccgccagac

SEQ ID NO: 915 - DNA, 1040 bp, Homo sapiens
cagcactagaaaaggcagacctcctgagcccaacaggcccctcgcagctcccagtgacttccatggatcaaaacacagacttccatacaacaaaaaattgatgctactggaattactagagttcgagatgttccaagatttcaaagagagaaaggatgggggattgcaacactgttaactaaaataaacactgaattgacccttggcaatggtctgttcccgcacccaacacctggctccactacgttgaaacacacacacacacacacacacacacacacacacacacacacacacgtgatatttgcttttaagatcataaaacaccaggaaggagacaaaagctcttatgcgtcatctgagatgacacatgtactgttaaagcgtgcgtttatttcaaacattaatgaaatttgcagaacccaaactaaagagagaggatagataagacatgctgcagttcttgccctaactttcaatcccaacaactgaaatgtcttccagagaagtaactccccccggtaaggatgtagcgcggtccctacgtgggtctaagggatctgacccacgacgcactgcactgggttcacgaagcgcctcctcgcaggcggttatctcggtatctctgagagcggcgggctctcgctcccgctccagggattcggggcagaaagagaacatcccacagttggcgggagttacgcaagacagtcagacccggacgtcactcgtgagtgccccgacccccctccaccccagaggcggggccatcgccttccttccgaactcgggatcgatctggagctccgggaatttccctggcccgggactccgggctttccagccccaaccatgcataaaaggggttcgccgttctcggagagccacagagcccgggccacaggcagctccttgccagctctcctcctcgcacagccgctcgaaccgcctgctgagccccatggcccgcgccacgctctccgccgcccccagcaatccccggctcctgcgggtggcgctgctgctcctgctcctggtgg

SEQ ID NO: 916 - DNA, 708 bp, Homo sapiens
acctgagggtaacccaaagaaaggcctcaggtcatcgcagaggagacagaaattaccggtgggcgtcccggcctgctcctcttcttcccagagctcaaactgggcagcaggcctggctttgtctcccttctaggtacccgttgggcctggcgcggtttccaagtctccctcaatttccctccagaatcccgcgctgggagcggaagcccgcggactctcaggaagacctagatttcaaatccggggcgggggagccgggccgagcctcagggcgggaccaaagcgggaggactggcgcgggacgcgagggcgggaccagggcgtgaggacgcggggcgcgggggcggggcgcgctgcggtgggcgggcgcctcctggggcccagcctggggctgggttctcgggcgggcgggagctaggggacgggccgcagcggaggcggcgcgaggggccgacaggggcgggcgggaggcggggctggcgctggagcacatctcccggcggcgggccgcggaagcagtgcagacgcggctcctagcggatgggtgctattgtgaggcggttgtagaaggtatgaggaggctgtgcggtgactgccgccctcgctccgggccgtcagccctgcccccgctccctgcgttctcccaggccctgcgcccgcccgggtacctgcccggtctggaaggcggagtgtttgttttgccacctc

SEQ ID NO: 917 - DNA, 1040 bp, Homo sapiens
acaagcaggagttagacgtttggaggttttcacacggtgctataaatacagtttccagggccccggtacacgtggccttcctgctctgccaggatggagagtcttgctttccacattgctgatgtggtcagactaattaaattattgcaaaaagacacattccctagtcaaccttatgtgtctgccttcttcccttgagtcacagttgttggctttacaggccaaggcaagtaagtcttgaaccctcagcagaaacagggcaccagcatcggatgcctcataacctgaacagttaaggacgccccaccacagagcttctttctgagtgtgataaactataaggcaagactgtaaaggggtggatcttcatttcgatttagggtaggtgacacctcaagggtgtttcttcccttccagcgtaactggatgggaaacctacaccaagtgtgcttgggagggctgcttgggtcagctacctgtaagtggaaatagggggtgccaccttccgatgaaaacccggatcccgtactgtcaacggagggcccttgaattcacatccctcagcccgctagaaagcccctgaaaccacgtggcctttaacccattccggcaacagcgccaattcccggaagcgagagggcaagaaagctcggcgcgacgcttcccgcgtcttctaggccgcgcgctgaaatcaaacgcgacgccggctagctgtgggccgggccgagcgctcaacgctccagcggctgggtaagccgcggccgccgcccaccccgctgcagagctgggcggggccgcctggaggcagcggggagaggccagccgaaaaggaagaagagacgccggaggcgcgctctgcgcaggcgcgcggcgccccgcctccccagcgtcggctccccggcgggcggtgcgggccctcccactctaccccgcgccgtctcacggccccggccctagcttcaccccgactacccggcgtgcgcgtcctcctgccggcctgcaggcccggggcctccgcctgcttccccacagctgctcct

SEQ ID NO: 918 - DNA, 1028 bp, Homo sapiens
agtagcgaagatgggttcatcagtgaaatattttgcaaagataaatatacctccactctgcattctgatctatagcctctttctttttggaagaagcattttctttgcccagtttttttaggcagtcacattaaaattctcattaataatgttgacagacaattacgtttattatttctgctaataggcatctgcattcctattcagaattttcattgttagtctataaagtctagttttaactttggaatgtttggtagaggaggacatctatacattttcttttaactgtcctttctaatgtggtacatttgtgacagtgtttgaattctgggttttcagtgaattatggaggactaaaataccaggagtagtccgtactgcttctcttatacatgagagatatctaaggactataaaacataacttaagtatacccttttaatgcctttgtaagatttttaaaccaaggaatgactgggctatctataaacccagatgcactaagtggggagaaaagctcggagctgcagcatatcagcttttgtcaacctgccaacagcagagcgtaccatgctgcaaggagtaataaacaaggaattagaaaactcgctgctggagaacagtcaaattaaacacctttttgaaaggatgagcatgtatatattgcagttctattaaatgtagcttcttagtgaggttggcattatgttaaggctggtatggaagagaactgatgaagcaggagtggtctggtgacatttttctgacttgattggctggggcgtgtgatgtaataggtttcagtgcagccccttataggttttaaaatgaattccaagacaccattacaaagaaagccggactcttttcttataactgagctcagccaaggaaactcttgcacaaatgtacaatactgtttggaatatggaagacctggatttagaatatgccaagacagatataaattgtggcacagacttgatgttttatatagaaatggacccaccaggtaatactgcagt

SEQ ID NO: 919 - DNA, 1004 bp, Homo sapiens
ttgtccctgtacctgagatggatgcagccacagccctggagccagcctgaagctcctggtgtcttctgggggctacatataggagtgtagtccgaacctcagaggggcaaacctgctctgcagagggaatcaaggttcacataaccagagaggggagtcactcaggaaggtggctccagagccaagagtcagactctgggtcccgacttgacccagccacaccccctctgaagcttgctgagagtggctgcagtctcgctgctggatgtgcacatggtggtcattccctctgctcacaggggcaggggtccccccttactggactgaggttgccccctgctccaggtcctgggtgggagcccatgtgaactgtcagtggggcaggtctgtgagagctcccctcacactcaagtctctcacagtggccagagaagaggaaggctggagtcagaatgaggcaccagggcgggcatagcctgcccaaaggcccctgggattacaggcaggatggggagccctatctaagtgtctcccacgccccaccccagccattccaggccaggaagtccaaactgtgcccctcagagggagggggcagcctcaggcccattcagactgcccagggagggctggagagccctcaggaaggcgggtgggtgggctgtcggttcttggaaaggttcattaatgaaaacccccaagcctgaccacctagggaaaaggctcaccgttcccatgtgtggctgataagggccaggagattccacagttcaggtagttcccccgcctccctggcattttgtggtcaccattaatcatttcctctgtgtatttaagagctcttttgccagtgagcccagtacacagagagaaaggctaaagttctctggaggatgtggctgcagagcctgctgctcttgggcactgtggcctgcagcatctctgcacccgcccgctcgcccagccccagcacgcagccctgggagcatgtgaatgccatccag

SEQ ID NO: 920 - DNA, 1022 bp, Homo sapiens
tacagtgtcccaagaaccaagtggccgtgacttcctatcctcaatttcccagcgacacccggaaagacaccgtgccatagatcgaggcccggggtcaaggccccgcctctcctgggcggcccctgcccaggcgggcccagccgctcctcccccgcactcccggttcgctctcacggtccctgaggtgggcgggcgggccctggatgacagcgatagaaccccggcccgactcgccctcgcccccgctctgggtctgggcttccccagcctagttcacgcctaggagccgcctgagcagccgcgcgcccagcgccacacgccacgagccctccccgcctgggcgtccccggatcccgcgagcgctcgggctcccggcttggaaccagggaggagggagggagcgagggagcaaccagctgcgacccggaaatgccatataaggagcaggaaggatcccccgccggaacaacccttatttgggcagcaccttatttggagtggcccgatatggcccggccgcttccggctctgggaggagggaagaaggcggagggaggggcaacgcgggaactccggagctgcgcgggtcccggaggccccggcggcggctagagctctaggcttccccgaagcctgggcgcctgggatgcgggcgcgggcgcgggccctagggtgcaggatggaggtgccgggcgctgtcggatggggggcttcacgtcactccgggtcctcccggccggtcctgccatattagggcttcctgcttcccatatatggccatgtacgtcacgacggaggcggacccgtgccgttccagacccttcaaatagaggcggatccggggagtcgcgagagatcccagcgcgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttcc

SEQ ID NO: 921 - DNA, 960 bp, Homo sapiens
cacattgatcctggaatgtgtgtttatttggggttatataaatctgttctgtggaagccacctgaagtcaggaagagatggagggcatccttcaggagtgagatgagacctcatcatacttgactgtccagcatcatctctgagtaaggggaccaaaaaatttatcttccaaactaggacactttcaagagtggaagggggatccattaatattttcacctggacaagaggcaaacaccagaatgtccccgatgaaggggatatataatggaccttcttgatgtgaaacctgccagatgggctggaaagtccgtatactgggacaagtatgatttgagttgtttgggacaaggacaggggtacaagagaaggaaatgggcaaagagagaagcctgtactcagccaagggtgcagagatgttatatatgattgctcttcagggaaccgggcctccagctcacaccccagctgctcaaccacctcctctctgaattgactgtcccttctttggaactctaggcctgaccccactccctggccctcccagcccacgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccgcacagcaggtgaggctctcctgccccatctccttgggctgcccgtgcttcgtgctttggactaccgcccagcagtgtcctgccctctgcctgggcctcggtccctcctgcacctgctgcctggatccccggcctgcctgggcctgggccttggtgggtttggttttggtttccttctc

SEQ ID NO: 922 - DNA, 1014 bp, Homo sapiens
gccttaaggacggcctacatactaaggaaaatttttttctaactcctggttgcagctgaggggagcggctgagggcggggacaggggtgcggcggacccactgctcccattacccgaccagcgcctcccttcctccttggatgggtgcccctgtcttgctaagaactgcctgtttacacaactgctttccttgtgaaaatttaaaggctcctattcccagttgttctatccttgtaggttaaagattatgtcaaaaactatattgcattatctctttccttctccttcccattaagacggaaaaaacatccgggagagccggtccgtttctcaggcagactaggccattaggtgcctcggagaaaggacccaaggctgctccgtccttcacagacacagtccaatcagagtttcccaggcacatcgatgcaccgcctccttcgagaaacaaggtaactttcgggttctggttgtctccaaagtcatccgaccaatctcgcaccgcccagagcgggcccttcctgtcaattacctactgaagggcaggcggccagcatcgccatggagaccaacacccttcccaccaccactccccctttctctcagggcccctgtcccctccagtgaatcccagaagactctggagagttctgagcagagggcggcaccctgccctctgattggtccaaggaaggctggggggcaggacgggaggcgaaacccctggaatattcccgacctggcagcctcatcgagcttggtgattggctcagaaggggaaaggcgggtctccacgacgacttataaaagccgaggggcgcgcggtccggaaaacggccagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctc

SEQ ID NO: 923 - DNA, 969 bp, Homo sapiens
atgtggggagtattcaggagacagacaactcactcgtcaaatcctccccttcctggccaacaaagctgctgcaaccacagggatttcttctgttcaggtgagtgtagggtgtagggagattggttcaatgtccaattcttctgtttccctggagatcaggttgcccttttttggtagtctctccaattccctccttcccggaagcatgtgacaatcaacaactttgtatacttaagttcagtggacctcaatttcctcatctgtgaaataaacgggactgaaaaatcattctggcctcaagatgctttgttggggtgtctaggtgctccaggtgcttctgggagaggtgacctagtgagggatcagtgggaatagaggtgatattgtggggcttttctggaaattgcagagaggtgcatcgtttttataatttatgaatttttatgtattaatgtcatcctcctgatcttttcagctgcattgggtaaatccttgcctgccagagtgggtcagcggtgagccagaaagggggctcattctaacagtgctgtgtcctcctggagagtgccaactcattctccaagtaaaaaaagccagatttgtggctcacttcgtggggaaatgtgtccagcgcaccaacgcaggcgagggactgggggaggagggaagtgccctcctgcagcacgcgaggttccgggaccggctggcctgctggaactcggccaggctcagctggctcggcgctgggcagccaggagcctgggccccggggagggcggtcccgggcggcgcggtgggccgagcgcgggtcccgcctccttgaggcgggcccgggcggggcggttgtatatcagggccgcgctgagctgcgccagctgaggtgtgagcagctgccgaagtcagttccttgtggagccggagctgggcgcggattcgccgaggcaccgaggcactcagaggaggtgagag

SEQ ID NO: 924 - DNA, 801 bp, Homo sapiens
aatgcttagttgtcccatgaggtaataatgtctttatctaatttcacctttccatttattagcttatcagaaagttgagtcctagaggattgccagagtgtcagaactcaatgacgccttcccatgtgaaggtcaagaactatctgcagccctcggtgggacccttgattgctgacatcagtccttctacttaaagcagttcttgtgcaatctttgatgcaaagtaatttcaaaagaattgcttcaaggatgttcaatggtgattattattgattgtggcctgggtaggtggaaaagctactcagagaccgaatacagcaacccaagctcccatagttattcattattggaacttggttttcaaactaggtcaaatgaaactgaacaacgtttggaataatccgtcactggttgtggacagggaagggttctagaagggactgggctggagaaccctgcaggcttacagtatgttatgggttggtgctcccctacctacagattcttttaaaaaactgtccctacaacttactgaactggaatgtcagctcagtggagtccttcttctctggccactcttaggggactgagggatggttggattcagaaaagggcttctaaaaattcaggtaatgtttgaactctgctgagccagtggcatgggtctctgagagaatcattaacttaatttgactatctggtttgtggatgcgtttactctcatgtaagtcaacaacatcctgggattgggacacactttctgggcactgctggccagtcccaaaatggaacataaggaag

SEQ ID NO: 925 - DNA, 1034 bp, Homo sapiens
aggaactgacctgtgtcttccagagcacacaggttcagagcacacaggttcatttaagtgagaacccacacttacagagcaagctgcccaaaaaccacgaccaggagggcccagagaaagagctgtccccggggccttggggacagggtgacagccacccagagatcatggagaaggggacgtaaggaagacctcacagaggagtcatcctgcgactgtgttggttgggtccttcaggaagcagagtcccaggagttggaagcataagaggaatactgcgggcaatgcctgagaaagataacagggaccgggagcaggagtgagttgggcaggggaaggatcaggcccacaatgccaggctcacacctgcagaggagggaagaagaagaagggcctcacatcagcccagcgggggatgttacgcccacagacgccccggggctcagttactgtctaagtgttagaaataaattttcggtgccacaaaagaaatagcactcagatataaatgttcccagcaaggcaattttacttctatagaagggtgcatctcacagatggagcaatggcaagagcacacctgaacaagggaagggaaggggtttttatccctaaggcaggtagcccctacagctgtgttgttcccctattggctagggttggaccacaccgtctgagctaattgttactggctattttaaagagagcaggggtaagagccggattggcagggtaagtagtttggcaggaaggacggtcacagaacaggtgactcaggatgactcaggtcagagcaggtgaccagtggtgactcagttcggagcaggtgatagaagctaggagggggttgtttactgaaactaggggcaaggagacgaagagaacatgaaagttaaactttaagatgaagaacaaagctgaacatactgatgcattggatctttggagaggatctcagaactcattgtacttaatttacaggctaaaaccttagaagaggaatttattatatcctacacaagactccagggaag

SEQ ID NO: 926 - DNA, 975 bp, Homo sapiens
agatggcacagaactacaaaccccagcatgcactctggcctgaagtgcctggagagtgctggtgtaccccacctgcattctgggaactgtagtttccctagtcccccatgctcccaccagggcatcaagctcttccctggccggctgaccctgcctcagccctagtctctctgctgacctgcggccccgggaagcgtgcgtcactgaatgacagggtgggggtggaggcactggaaggcagcttcctgctcttttgtgtcccccacttgagtcatgggggtgtgggggttccaggaaattggggctgggaggggaagggataccctaatgtcagactcaaggacaaaaagtcactacatccttgctgggcctctatccccaagaacccaaaaggactcaagggtggggatccaggagttcttgtatgtatggggggaggtgaaggagagaacctgcatgaccctagaggtccctgtggtcactgagagtgtgggctgccatcccctgctacagaaacggtgctcaccttctgcccaaccctccagggaaaggcacacaggggtgaggccgaaggcccttccgtctggtgccacatcacagaaggacctttatgaccccctggtggctctaccctgccactccccaatgccccagcccccatgctgcagccccagggctctgctggacacctgggctcccacttatcagcctcagtcctcacagcggaacccaggcgtccggccccccacccttcaggccagcgggcgtggagctgaggctttagagcctcccagccgggcttgttcctgtcccattgtgtatgggataggggcggggcgagggccagcactggagagccccctcccactgccccctcctctcggtcccctccctcttcctaaggaaaaggccagggctctgctggagcaggcagcagagtggacgcacagtaacatgggcaacttgaagagcgtg

SEQ ID NO: 927 - DNA, 981 bp, Homo sapiens
gcggtatgaccttacattgttgaataaaggaatggcatttatagatataatctggaacatgtatcaacatttacaataatactcaatttgtgtacgtatattccataatattcatccatatacatccatatattatatatagagttccatgaagttcactactgtattcaaaatgatattcaaatgctattcaaacaattctaaatgatatattttgaacaccataaaatgttacacaaatccataaatagcattactgtataataacctgtaaaccagagttactacacacacatacacaccacacaaattctatttaaaaagctattttaccacaaagtaattctaagaccttataaacactgcctaatggaaaagtctggagattggagccaggcaaaaaaatctgcatttcggttgtctagaactacctgagtgacttcggctgcttcctaccgaacctgaattttctgtgatgtggagacatttaataccacctttagggaactggcttaaggactggaggtaataacgtatgtgaagggctgatgaatgtttgcagtcacactgtagtctctctagagttccttcctcggttgcaaactaagggtttttttgtttgtttgttttacacattatgagtctcttatagtcaggaaaactacacggatctcaactttggcaatacagagagtccgaataacaaggtagagaccaaaaaaaaaaaaaaaaaaaaatcacctctacaactcggaaaaagcgctaaccccgcaggaagcgctgggccgacctccagtatcccagcattcctcgcgctgctcccgtattctttccccaagtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagact

SEQ ID NO: 928 - DNA, 972 bp, Homo sapiens
tagaatgaggccatggagatgttgtacaactgtgtcgtttggcagcagagtcctaaggaattggtggtgactatgggatggtggtagccactggggctgcctcaaatggaaaggaaagggttctaagtatttataaaagaaaattctagtgtataactgagcatcttctatttaccagcacttgatactactaaatcgtcacagcaccccggtgttattattatctctgtttacaaatgaggaagctgaagctcaggtcacacaggtagacaggaagtgatggggtcagattcccagctaggtctgccttggagctttccttcttgtgagggtgatgttcagttcactctggaactggtgtagccatcgccacatttagagtgcattttagagtttgagccagttttgatgattttacttcaacttactgatggaactccttgttcatccctggaactctctaacacttctgctgggagtttagagggatggccacaccaagctgcttgggtacattttctaaaacaaaatttattgtaagaaatggaaattatgaacaaaatataccactatctctttttgctgtgaagttaagtttattggctactgttaacaatttatttacttacttacttactattcttttgtagagacagggtcttgccatgttccccaggctggtgtcaaactcctggattcaagcaatcctggtgcctcagcctcccaaagtgctgggattacatgtgtgagccactgtacctggcctcaactcttgttaaaattaaagcaccttaatacgtttagcaaactcatcagaccaataaatattttcaagatgtatgcagaattaccagtggcacatcccctttttctgtggctccaccccttcaactttttgtccaagaaaacttttcgtgtttgcctgtagctgatgtgcagttgtttctgctcccaaatcaacagggtttaatg

SEQ ID NO: 929 - DNA, 1010 bp, Homo sapiens
ccccaagccatgtaagaatgataaatctgattacatgaaaaccttaagcttctacagagtgaaaaaaacaaattaaaagacaagttagagactgcgagaaacatatgtcactcataaatcagaccaaggagactggacgaagacatggagatgtgaagtaggaggtgtgctcaggaacatagtttaatgtcatccacgtacaggataaacggcttcccacgtcatgtcccagaaatcgattagtcgatgggatttgggtgagtactttcttctctctgttttcctgaatttttcttttttctttcttcccctttcttctttctctttttttcagaatgatggtgtgtttgtaatcgacattttaaaaattctgtaacaattaaatttgggggcggccttcccttgtttcccgtatggagtgttgatgtttcagcagctttatttggagtttacacgtggaggcacctgggtttggggattcctttgtgtccccaagacacctattgcagaagtgagtcctaagaggtagaaaacagatgcgtgcgcagggctgggtgaagcactgtggagcctgtgtgagaggaggcacgggcgcgaacacaggagcgcacttcctcattccgtttctcctcatcctctctcccactgccactggcatcactcatcccatccggtcatcccaagtcacacgcaagagttcgttcccggcgcgcgcgtcagcctgactcgagcgtctccacgtccggggcccgcaggggagcgcccctgccccgtccggtcgcttgttgtgttgtcatcacgtggcctgggcgggccctgacgtcaggggcaggggagggacggcgcaggcgcagaaaagggggcggcggactcggcttgttgtgttgctgcctgagtgccggagacggtcctgctgctgccgcagtcctgccagctgtccgacaatgtcgtcccacctagtcgagccgccgccgcccctgcacaacaacaacaacaactgcgaggaaaat

SEQ ID NO: 930 - DNA, 1091 bp, Homo sapiens
tttgaatctgagaaaccccacattcacgaattaaggatctccagttctgtgtctttattctacccctccctgcctgcttttccactcggcagaactgagtgactttcagcggctgcagtaattttaattattctgagtcgtgctccgaactatgttttttatcagttcctctgaaaattaagttgtagtaagagacgtagtttaagggcacccccttagaagaggccaggttattttttaaggaaaagctgaagatttctaacaggcacttactaaacacacacacacacacacacacacacacacacacacgcacacggcgcagacccagcaggagagcgcaacctagcatctttaaggttcgcttagcccttcctgtgcacctggaaggaagccttatcttaaactcccttccacctagagtttattttcgcctgcgtgcgacagggcttttgtacttaagtgagttaaggaatgaaccccgaactcttctgggaaagccaccaacgttccccccgcacccctcccagggttcctgaccacggagactctgcttggggcacaggtgtgggagtcgcaaacttttctctgcgccgtccttttccgcgtggaatgggacggagcagccctcccaggcgctgcctggctgcggaggggagcgggcagcgagagcctcgggtctccgcctgggttcccgggtctccggggcgctggcctcggtctccgcgcagcgtccagcgacccctgtcgggggttcccggcagccgcgccgccaccccccgcccggccagcgcgggaggaaaaggggctgcgcccgggagcgccgagcccaggctcctcccggtggcgtgtccgcgcctcggggtgggggtgtggtggggaagagggagggggcgaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctct

SEQ ID NO: 931 - DNA, 927 bp, Homo sapiens
atttcagtaaaagaaaaggcgggggtcatgaagaccgaaggatcaaaggagcatggagtagaggaggcgtcacatctgaagtgcacactgtgtgtgcgcgctgcaaggagagagagcgttataaagttgttgttttaatcgctgcttgtcgcctgcgaacatgttgctcccttttaagtgtcaagcaacgggttcacccaaaacttttctgcaccgaggacccgcacgcccggggtcccacctgcccctctctgcctgcctcccaccggcgcctgggcatcctgcgccggctacaggtccttgctcactgaagcgtcacctctcactccccagtaagcctccgcagcccactcggactgcagcctgtttgccgcccgtcctcccattgcagcactcggggcgacagagagggaggaggcgcgcggggacggggacgcccaggaggacccactcgcgggtcccgctccgctccggcagcagcatggggaaaggacgcgcgggccgagttggcaccacaggtaaacaggctggcgaggcgcaggacgctgtcgccgccgcggccacccagcgatttccaggcacgcaactccgcctccagggctctctccctcgcgctctctcccagccgcttgctcgcagccccagcagccgccgcagcatcacttcacacaaaggactgtcacccgcggagcagctcctccacctccacgtcctcctccggtgacagcagccccgacagcagggctcgggcgcggcggcggcgcggggggtggggggacctgtcactccctgtaactgaggcggcggcagcggtttttttgccttttctattttgccttttttttttttgcccttatacctcttcgcctttctgtggttccatccacttcttccccctcctcctcccataaacaactctcctacccc

SEQ ID NO: 932 - DNA, 1071 bp, Homo sapiens
ccagttttgcctttcctttctctctgtctctctctgtgcccctatgcctgccttccctgctgatcttgatctctggctagttgggggcctgtaacagtgatgagatgcgggtctgccccggctaagagctccctgagagagggggcttagaccatgatgaagagttgcttttaggcggtgctgtgagccctggtaggggctgtgtgcgtgtgtgactgcgtgagtgtatgaatatgtgtaagtgtgtctgagtctgaggcggtgtggctgtgcccgtgtgactgtgagtgaccgcatgtgagagtgtatgagtctgagggtaactgtgggtcttgtgtatctggcaccaagggaccaaaggcatttcctggtgctggggcccaaagaatggagggggaggtgagaaatggctggaacttccaggggagggggaactggactctttggcctctccttatatcccccaacctggggcctcccttcccctggaagcacagccagctgtaccctaaggaaacatttggtgaggagtgaaaagagggggagtttgtatctgatttttcatttgattgtgtccacgtgtgttcaaaggcatgcccttttgttaactgtgcctcttgagtctgtgtgtgaatgtgactgtgtctggctgtgtgaaaacacagggcatctctcactgacagggacataagtattagccaccctcctttccctcttgctggccttggctgtgtctgtggcttcctttccagacttgggggaggcctcttcccttcccagggccttgggtgggagggaaggagggaggaggcaggagcagggagggggcctggctaggggcggcagagctccagggcttagagggggcggggcagggaaggggaaggaggggatggctctggggtcccagaactgagtggagtaggagacgggggctgtagctggtgagaggaagtcctagaggctatggacactctgctgctgggatcaccgaggtagggtggggctaagcagggtaagtgtggctgggtggccaggggtgagccaactggacacactcagacagacaca

SEQ ID NO: 933 - DNA, 1041 bp, Homo sapiens
tgctcaaatacctcctatggctccctagggcctataatacaaattccaagttcaacccacctcaccatctggggctgctgcctgggctcccatccctgcccggctacatcactgagcacctactactatgtgccagtctccctgcaaaacgctggataaacacgtggctttctaccagggaacctcccgcaaggtatttgacatgctcgcctcccgttctctgctgtgtctaaggattcacagatgcggctggagtctgctgcttagcacagtgagtgctcattatgggagctattcttcttatcaagaccgcaaatcccctctctggctatccacagccttctgaatgtcccgggcaactccaggggagcagggctggttttctataatcttctaccttactgggtggtctttggggtcctggcgggttccagtcccagaggagctcgaagggtccctcccaacaggggaagaggagtcccaggtgggtctcggccagggcctctgggcaggctctgagggcgggcttggggactgtggccagcaaagcccctgagtcgatgcctcagccctctcgctccctggtctggcctctctctggcaccaatgcgctgtgggattttgcggaaagagccgctcttctctgagcctcagtttctccagctatcatagggaaagcctggccttgtaccctggagtgtaccttgagcacagtcggggtatcgcaatggaaaactcttggcaaactgtaaagtgtagttcgcgtgtgtgggcacagccacctgggggtccacggtgcggggcacacggtgccgggtgcggtgtcgccgcgcacccgggctcgggctcggtcccgccccgcttcccggtccctggtccgctctccctccctccttcccgccctccctgccttcgggaacgccggctcccggcatgccgcgcgctgacagccttataaatagtcgcctttgccggccgccgcgaggacgggcagggcacgcactggccccggcgcccacccgcacccctccccaggtcagt

SEQ ID NO: 934 - DNA, 1020 bp, Homo sapiens
ctgacccactcacttgcttctttcaccatcattcatggccacccccttcccaatgctcattcattcacccgcaccattccctgcttgctaggacggtgccactcctgagttacaaccctggtgccaggtagcctctgtttgaatcccggccatgccctgtgatcttaggaaaattctacagttcctctacgccccatatttcctcatccgtaaaacgggaataagaaccggtacccatctcagagatttgttgtgagctttgagtgagataaactatgctgagtgcctggtatacagtaggtgctgtataaatgccggctatttgcctgtgttatttgagaccctggctttggctcctggccacctgagttccagtctcagttctgccatgtattgactctgtgatcctgggtaagtcacttaaccactccgtgcctcagtttccccattttgtattcctcccctttcacctgccttatctccctccactgctgctacttaatttgtttcctctctgccacccctcaccagcatgtcagacatacaaaacaagggatttttgtgtgcttggcacacagtagatgcacaataaatgttgaagggctgaactaatttgggtttgagtcatagggagcttgggggatgtgggtgattggatagattctggagactttaggggactgggccgggggaaatgcggcctctaagctctccgctgaggcggcttggaaggaatagtgactgacgtggaggtgggggaggtggctggcccgggcgaggcccagggagagggagaggaggcgggtgggagaggaggagggtgtatctcctttcgtcggcccgccccttggcttctgcactgatggtgggtggatgagtaatgcatccaggaagcctggaggcctgtggtttccgcacccgctgccacccccgcccctagcgtggacatttatcctctagcgctcaggccctgccgccatcgccgcagatccagcgcccagagagacaccagaggtaagc

SEQ ID NO: 935 - DNA, 954 bp, Homo sapiens
gggaaaggatggacagagagaatcgcatttaagctccatttgaagtagagttatttttattttttgtataattccttgctttttggaatgtgtgtgcttcatatgcagaaaagtagtttcccgatctagactgccatctctttgaattccactgccacatctgtctctcttagttttctgtgtattttagagattccgtcagtttaacctgcctggctgacaggtggtgtcccaaatcgaaaccgttttttcccccgaataaagtgtgcccgtgtagctgtacagatttcgtcccctgaaaattcatctgaaatctcaattctcctgaggggagcaattaaggaagatacatgaactctcccctcctctccatcctgtcaggtgcccctcttttttgatggccccacctctgtctagacaaccctgacagtgtagaagtttccatctcctttccctttccctctccatgttccctccccttcagttttttccccctcccaggcgcttcctgcctggaaacaaaagattggtccccagtagcccactcagggcgattttagttttatgctcaccatctgattggcctaggtaaggtgcagagctcgggtgacgtaatagcagagaagggctagggagcggttgccgagcaggggctctaccgcgggcgggcagctgtgccagctaaccgtctgggatctcgcactgggggctgcagcttttccccgcctcgagccagtgtgcgggggcgggagaagagccagggggagcgggctgggcccggggctgcggctgcggccgcggggctgcggctccccagccccgccagctggagcgctcggaggtagaggaaaggtcttgacggggtggctggatccgtggcaggtaaatcccgcgactaactgcacccgggctaccgcgggggagggggtggctgttggatgatgctttaaggct

SEQ ID NO: 936 - DNA, 920 bp, Homo sapiens
ggaaacgcctaaggactcttgttttccttcctcccagcctcactgaccctcataggcgcccaagtatcaatgtgtattcttccgattcacctcccatccctttgaaaaatatgtagaaagtttgtcgtgtgctttaaaaaatgcacgtatggtatcctccctcatgtttggaatgttccttttaaaatcaacattatgtattgccagctttcaaatatgccctttgtccttttcacaaagcacagtactgccagtgtccccaactccacccagtgaagtagggctggtattactaaccctggagtcagcgctagcaaacaagggctcagaggtcaagggctggaagccaggtctccagactcccaggccaaggctcttttccgcagatgactctgtcctggtgtccagcagggcacagcccctagcacctccgaggccccgcaagtgtgctggcagcggcgacgccggctccgccacgcggagggaggaggcccaggcagcgcccggagtgggcggcgacgtggtggaagaagttttgttcggtcagagaccggacgcgggagctgcgggtgggccaggtgtccagccttgggagccgtaggagccgccagagccgccagagccgccggcgccccgccccgcctcctccggccgctctcgccggctcaggttacctgaggccggtgggcggggcggcccttcccgtctgcgccggcccccagcctccagggcggcggagccgggaagtggaagagggagcgaaggaggcggggactgccaaggctccagcccggccgggctccgaggcgagaggctgcatggagtggccggcgcggctctgcgggctgtgggcgctgctgctctgcgccggcggcgggggcgggggcgggggcgccgcgcctacgggtgagtgcgaccct

SEQ ID NO: 937 - DNA, 941 bp, Homo sapiens
tccctgctaagatcctccatttaggaagtggtagtggtaatggagagattagatgggagaggagttgaggaagactcccaggtttctggtttgggcaactggaaggatggcgatgccatttactaataaaggaaacacaggaaaaagtggaacaataatgagagtagatggaaataaaaaattttaattaaaagaagtaattaaaagaaaaaaggagcaaagaagaaagtcaatcgtccagcagggggcgaaagagctaaataaacactttttttaaactaaaaaaagaaatatttatgaggaaacagagcaaagttttgaactctctgaggcttcggtttaggttctgagctttctcagtggtcaaataactttctattttattttattttattttatttatttatttagagacagtctcgctctattgcccaggctggagtgcaatggtgggatcttggctcactgcaatctccgcctcccgggttcaagccattctcctgcctcggccttccgaatagctgggattacaggcgcccgccaccatgcctggctaattgtgcatttttagtagagaaaggatttcaccatgttggccaggctgtctcaaactcctgacttcaggtgatccacccgcctcagcctccgaaagtgctgggattacaggcatgagccaccatgcccggccgaaataactttcaaatacttttttctttttcttttttctttttttcccctcagaaaagagtatttgactgtgttttatgtgttgctaggggagacggttgctatggagatggatgatatcataactccattgtgaaccagtaagaacactctcgtgagtctaacggtcttccggatgaaggctatttgaagtcgccataacctggtcagaagtgtgcctgtcggcggggaggtgaggagctacaagggttttt

SEQ ID NO: 938 - DNA, 1014 bp, Homo sapiens
caggcacattgtatgttctgcatgcagccaaaacattatttccaatttagcttatatctggcagagtcaaaacacttatttacactcagcccctcaccctactcccataactgaaagttctgcttagcagacttctcttcccagaaagtccgagaagcacgaacgctttttgctaacatcctgctcccaagcacagaaaccacagcaggagactgtgtgtatctgtagcacctggtatacagcatctaggacacacaactgaactaataaataaaggtgacaggcgggaagaagagcgcagaattacttgtccaggaaacgggttgggtgggaaagagccggcaactggtaaaagatggaagtacacgccggatctgggaagccaggttccgcgcctcggactcatggaaaaactggatctggatcactgcaaaagaatcaggaaggcttcggtatcaagtaactggtgtcctaaaaccaaaaaacaaagtgcgatgccggggctacgctgttgtgagatgctgttatcagttctcgtcaccaacacagcggcagcaccaggcacaaccgccaatcaaagcggccccacgagtccctccttgaacaggttccttaactcgttcagtccaacactgtgccacaaactcgcgaaaaccggctacctagagccagcgtctttgcgagcttgcggccagctagtgcatgcgcaaatcctctcgccgtgcggaccaatcgcaatgcggcagcgagtgctacgcctgcgcagtaggcctccggtcgccgttccccttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagct

SEQ ID NO: 939 - DNA, 1200 bp, Homo sapiens
caacaccataggggaacaagaaggctgcaaagtggcagcacagcaggagtctttaagaaataggtatttgtttcagcttaagaagtgtctggctgggcgtggtggctcacacctgtaatcccagcacttagggaggcttaggtgggcggatcacttgaggttaggagttcaagaccagcccagtcaacacggtgaaaccccatctctactaaaaatacaaagaaattagctgggcttggtggcaggtggctgtaatcccagctactcaggagctgaggcaggagaatcatctgaacccgggaggccgaggttgcagtgagcctagatcgcaccactgcactccagcctgggtgacagagtaagactcggtcaaaaaaaaaaaaaaaaaagaccgggtgcgaggtggctctcgcctgtaatcccagcactttgggaggcctaggcaggaggatcacaaggtcaggagatcgagaccatcctggccaacatggtgaaaccccatctctactaaaatacaaaaattagccgggtgtgatggcacacgcctgtagtcccagctactcaggaggctgaggcaggggaatcgcttgaaaccaggaggtggaggctgcagtgagccgagatcacgccactgcactccagcctggcgacagagcaagactccatctcaaaaaagaaaagaaaacaaacaaacaaacaaaatccccaaaaagcaaaagtgtctgcatggacttgtgcctaactactcacagtggctacttcttgggggaggtgaaaggggaccctgttaaagaatttttcttctgtattgtttttcttcaactgagtctgcattaattttatatttaatactctccccacccctgatgctcacaggttgctttagctggtggaaggagaacctgcacctctggttttggcaaagtgtagaaggggacaagggcactgctctgcacctgcacaggttcttgcctcctggggtcagtttaatgaatctcagtggtgtttcttgggaagaacacagtggacactcacttgccagtcagtagacaaatcactgaagtccatgtctggcagttctcaatgtcatggggactgtaaggttgtcatgtctcacagttccctgacttagaagattagtggtgacagacacttctcagctctgctcgggagagcagctctgtaatgcgcttgtggttt

SEQ ID NO: 940 - DNA, 984 bp, Homo sapiens
gggggtatgaaacagagtcagtgaccttgcaattatcctgtccactggcattggggaggtagggggtgttattgacccttgacctcacaatggatcccgtccaacggtggtggtggggggacatgaaatgcaatcagtcacttaatcttgtgcgggaaggaggggaaaggaaccacgaaaaagagaatcagcgaactaacaatccagtccaaaggtgttccaaaggtgttctcttgggagtcaggcagggaggtgggggtggggctgggccacgaaacagagtcagtctagttaggctgtaaaatctaagtgtcaggatgcagcgaacggcaagtcctcctcccggaaaaggcgcctgcggttgagaagggtcttgagcagcgcggaggatcggattccgggctcctggcctcttcccggtccgcgggcacctcggctacctttcggcagcggagaacccagccagaggcggagctgaaagcggctgcacttgctgggctgggctgagtcccatgagccagggaggggggtctctggcgccgcgcccggacaaaacacaaacgtcacagaggcagcggcggccaatcagtggagggcgcgcgcggccgcgtgcccctcgcgctcctcgcctcccctcgcgcgccgcgtacgtgcagcaaccgactccgcccagcgaggcggagcctagggaagccgcgggcggcccgccgctgtcctggagctgctgctgctgctgcggcggctgcaccggcggcgccgaggccgagatcgaggccggggtgcgcgcttcgcaaacgtgccctatccgtgcggcttggctgcgccagcccttgcggccacccgggcgtctaggcgggtctgtgcgccgcccgggcgaggatgcggctgttccggtggctgctgaagcagccggtgcccaagcagatcgagcgctactcgcgcttttcgccgtcgccgctctccatcaaacaattcctggacttc

SEQ ID NO: 941 - DNA, 808 bp, Homo sapiens
agtgctcacgtttgggcagctgcacttgggcgctgctggcacaggaggtaagttagtttggcctattgcagcgtcccagcatctgtcgcgtttctcatgtgtgattgggctctggcggcccatcctggcggagacttcggctagcaggccccgctgcagaccccaggccggctcgggtctacctgcgccagcgctgtacctgggcgaccttggctttgcccccaccggtgacccggcccgcaggacgtgtgggtgccgctcagctccccccgcctcggccgccgacccccagctccccggcggggcctcctcctgccacgtgacgcccccgccaggggccccagcgccctcctcgcggccgcgccgttccggctcccgagccccgcctgcgcgcggcctcctcggcgcagccatcctcttggctgccgcgggcggcaaagcccacggcatctgccatttgtcattcagcccgtcggtaccgccccgagccttgatttagacacggctggggcgtgctctggcctcactctccgggcgggtgctggacggacggacggacggggcagccgtgctcacagctcagcagcgcggggccttggcgcgcggggcgcttccccgggtcgccgtcatggccgcggaggtggcacgcccgagcggcctcgcctgagctccgggggtcgtcgccccgcagggtaggtgtttgggtgctcgcggctgcggcgggcgggctgggggcagcggtggccgtgcattgccgcgctgcgaggacggcgctgggttcgcggccgcgaggagggtgtgcctttgc

SEQ ID NO: 942 - DNA, 1099 bp, Homo sapiens
ctcctgccccactctgactttccagcgcccaggccggggcgccgccagggcgtctctgagggtcgcgccccgataccttcctccaccccacggcttcttccccccaagggcggggctgggggcccaggagcaccacagcccccatgggcccgggaaatggcagcttcgtcatggcccagcccgccacgctcaccttttcccaccacctggaggatccactctccgtccgtccttcccgacctcaggctgcagaggaaacctgggggcgggggtcgaggaagccgagccccgaggctcccagcgccgccccaggaggaatcttgcgggccactagaagctgtgcgcgcggccgggctcggcccccacaacggcccgagcggccgggcctgccgcgagcctccgcgtccaggtggggtctccgcgcccccattccacccctccccgccatcggcgctccccgcaactgcggggtttccacccgccccggcgctcgcgcccactcacggtctccctcgcccccccgggagatgctcccggcgttctatcccgccccgccctggcgcgccccgcaaacgatgtgaccccggccccctgcggtctcccctcctccggacgctgcccctgccccacctgtggcgctcccgtcatctctagagcccccaaccagagtcctccagcccacccgcgaggctcgcgcacctgcgatgcggccccactagcagggacccgcccacctgtggcgctacccctgcctctgccgcctcccgcaccgctagcgcggcccccacctacgacgacccccgcgtagatgctcctgcccacacccgccccagccccggcccctgcccctagccgcgcccgcgccccctcccccgcagcccctcccatacgctcgggccccgcccgtcaccgcccattggcgctggggccgggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctcc

SEQ ID NO: 943 - DNA, 1041 bp, Homo sapiens
ctcctggacctcactgagtgtttgcagaagaagccgcagagctacctggggccaagttaggatcctcgactgctttgctagggaatttcgtaattatactggaggagcgatccacgccttagcagcaatcactcacacagttttccagtttacgacgtgctatcccatcccgtaccacatctactccttacaggagccctcagagacaatcagggataagtcattgactcattcaactgaggccccgagtggtggctctgactttataatgcaggaattagagcagaaagaagaggcagcgggcgaggaggccaatgatggaggctcaggccacagcctaggccaggaaggccgtgagtctgcagcaggggccaaggcggtgcggaccgaatgatctgagcctccccagccaggccccctcctactcaccctcgcctcctccaggactgacgtcccgggggcggctccaggaggcgcaacccggaccgggccgcccctcctgccgggccggtacactatatccagccaggtcagaccccacggcgctgaagctagccgagcccctcaaaaggccgcccgaggctttcggccgcacatccttctgggaattgtagttcccatcctctgaagcaccgcgtacacccgccctccgcccttctatcccacaggaccccgcgcgcagaggactcagtggaccggggccgagagcccaatgggaaaggaagttctagatgacggacgacgtgcggggtgaggctagtgcaggactacatttcccgaagtgcaccgaggtgggcaggacccggaagtgagggtgtgagaggcctctctggaagttgtcccgggtgttcgccgctggagcccgggtcgagaggacgaggtgccgctgcctggagaatcctccgctgccgtcggctcccggagcccagccctttcctaacccaacccaacctagcccagtcccagccgccagcgcctgtccctgtcacggaccccagcgttaccatgcatcctgccgtcttcctatccttacccgacctc

SEQ ID NO: 944 - DNA, 1028 bp, Homo sapiens
atctcgagaccctgcctcttttcaaggccacgcccatcccctgggtccccacatcttctcaaggccacacccttctgtgaggcgccacctcctgtcccagccactctcatctgaggccccacgtcctctccaggccatgcctcttccctgagactccaccccctctctgagagccctcccctccctgaaagccccccaccctcaatatccttctcctctctgaatcccttgtcctcttgagaacttttccacctcctcgttctgatcccccaccctctttgagtccttccctttttaaggtcccctcctcccagaacccctccgccaccctgagcccctgtcccctctctgcaccccgcccctgccctttctggcgtgccccctctgctcagccccggctcttttgggggttcctctctcttctctgcagggtacacccagcagctggccttcagacaacccagctctgcctttgcggccttcgtgaaacgggcacccagcacctggtgagtcccaacagccagctcaggccatgcatactccccaccctcaacccccagcagggcccggaccctggccaggggtggtcccttaggccagccttgcccaaacagccctggacctgcagagtccaggcaagcgctggctgagtggccggcggtcattaagcatccttaagcacggaccgcatacaacagctgggtcctggggcctgggaaggcaaaccaggcaaactgggccaggccctggtccctcccccacgctcattggctggttgacatggcagtctctggatctcagagccgattggctcatgctctgtgcccactccaggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattgtaagaggctgggatttagggcaaaatggaagag

SEQ ID NO: 945 - DNA, 900 bp, Homo sapiens
gtttgacaaggaggaaattggtgtgattgggaacctgacagggaaactgcggaggatggctgaatatggattgcgagtggggttaatagtgtaaggaactcgagttggcagtccaaggtaccccaggggtcactggccctctgtctccccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatggggtatgtagaggaaggggtgatgtatgctatagagaagttgagcagatggggtgggagatagcgtgcaaaatataggtgcagcagaggggcattccctctcatcctgctgttacggcggtcaatctgagatgcggtggaagtacgggccgcgtgagtttccccccccaactcccaccctcaacaccacactggccctccgctccagcttactggggaactggcatggaacacagtgtctgtggaaaggggggggaatctcgtggggggagactgtctcccggtctcaccgaccccagaacaatgccccattgtccctcccgcgcactggtgacgtcaccagggcaacacttcctgcaggccggtggtctcctgggcaacgcttcccgcctttgagggaccagccggcccgaatagcccttcccccaaggccagaacccgtgggaaaccggaacccaggcgtctggcccccaactggggtaacaacctcccacgtcgtcccctagggaaaactgcgctgcactgggctgctgccgtgaacaacgcccgagccgcccgctcgcttctccaggccggagccgataaagatgcccaggacaacag

SEQ ID NO: 946 - DNA, 965 bp, Homo sapiens
gcccagtgtagatacctgtgtcccaaaccactgatctgggctaggaagactgaatcacaggtgtggaaggtcacccgggttcaaccatctaggtgatgaattaggccaggacctgggcaggtagaccatttattctggggagatatgatgcgagcttgaattacatgggagaaatatttgtaaggcagatgggataacaggacttgataagtctgtagtgtggaaaggctagaaaagaaaggaatcaaaggaatcctgatttctgacttgacagggtagaaggaggtgtgtgtgtgtgtgcgtgtgtgtgtgtatgtttatgtagggacagtgacacccaagagaggctaggaataggtttgttttattcctgtttggggtggttgggtaggcagggttaagtttttgacttggtgaatttgagatgatggccaatatacaattgacattccagctggggggaccattgaagatcaagtctggcaagtctactagctggcgcctgggtgagctgagcccagcaggtgagggaaaacgcgggaagagggtcttgcagattccaaacttaggaagggtcgcggctccgcgcacgtgctctcggggtcaccttccccgcgcctgtgagggtgccaggagttcgtctccaggtcccgcccctgtgggcggggcgaggcagcgtcgccgcgaggccacccggaagaccaagccgggtaggcgctgtctccgtcgcctccaacccccccggtccgaccagggaaggtgggatgctctgatggccgggcctgcggcgctgagcgcggcggcggcggctgctctggcggccgccctgctcctgctgcgtcgtgaggacccggggccgggggctggccccaggtaacccctccgcgtatgggaccgagctgggccaggtctcctggccgggccggggataccgtggggtatgcccagtgatgccagcagcttgt

SEQ ID NO: 947 - DNA, 1082 bp, Homo sapiens
ctgacctgtggttggaataccggccctggagcccggaggtcggggcccacccgccgagggaggtctgggcgctgtcctggtctccacggagctcgcgcactcacggggccgaggcaccaaggcgaccggcgcagagccagcgccgtctccacaacagggcagggcgcgcagctgcgggggaggcctcgcccctccgctcccctcccctgccctccgccccggccctcggggcgcggcgtcccccacgtgctcccctcacgcgaccgcgagggcagtgggcgtgcggcacccgggagcaggaaactccgtggcctctgcggctctgtggagagctcccctccaccgccgcagcccccgagcccgtgtatcttcctgcctttaaggcatcgcagcctcctcggcctggaggccccgggctcgctccgtgcggaccccgctccagaacccgcccagcgcgcagatgccgtgtcccggcgcaaggccagagagggcgcaactctggacgtggggccgccaccgagcctgcccttcccggctcccgaaaggccccgggctcagagccaagactgcgcttgcccgaggcccgtcgggcccgccctccctcggcgcccccagcgcagctgcccgccgcccgaccggaagcccgcactcgcgcctgcgccccaccccgtccgcgcgccggccgcggcactgcggcggttaccaggacgctgaagcagcgcagccaatagcgccagcctggcggcgtgctcccggcagccagccaatgagacggcaaatcaatcatttgaaacacccaatggacggagcactgcggcgccaggagggggattgtgatagggagataggaggctgcggctgaccaataaagaccaaactggcttaaaaaggcggaccttaggcagcttgattgacgggggcaaggccaatcaaacgagggagcttgccagcctcgttctggcagcccattccgagactagcggaggcgggcagggagggtatataagcgttggcggagcgtcggttgtagcactctgcgcgcccgctcttctgctgctgtttgtctacttcctcctgcttcc

SEQ ID NO: 948 - DNA, 1079 bp, Homo sapiens
gggagcaaggtaactccaaacttttacagaattaaaggtagggggtctggtcagctacagtccatctgttatcaagaggcctggctgtgtgtcttcattcagtttattaggcatttactgagcacagcctacatgccaggttcttcattttttgacacagggtcttgtgttgcccaggctggagtgcagtgctgcgactgcggctcactgcagccttgacctctccagactcaagcgatcctcctgcctcagcctctggagtagctggggatacaggcgcgcaccaccatgctcggctaatttttgtatttttagtagagacagtgtctcaccctgttggccaggctggtctcggatcccagagatcaagtgatccgcctgcctcagtttcccaaagtgctgggattacaggcgtaagcctccgcgcccggcctatgccaggttctacatgtgttctttcttgactcttgtgttacagaggctcgaatgaagcctggcttctacagtaccgcacccagcacctcgctgcgatgcagcctcctgtaccctttccgtccggcagctggagttagggcagagtgccgggtctctaggagggcaacactcaacgcagtcggctcctaggcatccagtggggctgcaaccccgccgccggggacgaaaggcgaagggggaaaactagagctttcgccggccgggacagcgcagccgggtttcagctcgttctacggtccacgtcagaagatcgcctccggcgccgcggacgccggagaccactgtctgcgcccccgcacgcacgcacccacgtactcgcgcacgcgcgcgccggccccgcccaccgccccgctgtggcccctttggaccgcacgagccaccgtccgcacagccccgccccgcacggccaggcgaagcggagccggccgtgcggtgtgtgtgtatgtgttcgcggggcgccgtctcagccccgggaagatggtggctgcagcggcggcaactgaggcaaggctgaggaggaggacggcggcgacggcagcgctcgcgggcaggagcggcgggccgcactgggactgggacgtgac

SEQ ID NO: 949 - DNA, 968 bp, Homo sapiens
agctaggttctgtggcaatgaagaaaattgatcaatgactgtttttggtattactttgggaagtagggatggaataggggcaagggaagggcttagcttcaaactgtagacagaagtgggaagcccaaatctttgcatggtgagaagtgggatggaatgtaggtgctagagatggtgcaccagtagggactgtcactggattggggaaaaaaatccggggctgtccttatctgctcccttaggcaaaatcgttctgtgttagtctggagggtgaacctattttaatgcaggagggcatagacttttgggtggaagcggaccctggagatgtactggcaggtgaatagagtgtggaaaagtggggaaaggagaagcacgattcatgagcctgagttcgggcttccatggatggaaaagcatcaggagtggaatttaaagacggtgtgtttcaggtgatgtgaggtcctggatgcccgaagcttcaagaaaatactggttgggcacttagctttccctgtggttgccaatcccacgcaggccgcctctagcgtctcgattcgcttttctctgacctggaacctccgccaagcccccagctctcttcttcgacccagccttgcacggggcagctgtcggggcaggacccgcctctggcctgtcgcagcctagctcacggtcaagggcgggagcctgctgggaagcacggccgcgggggctcgctcggggccacctgcctggaactcagcgcgaggtccagagttccctccggctgcgcagcggcgcacgtgccccgtggaaggggcggttcccgcaccccagaaggagggggcgcccggccgcgcggactttcccttttgcttacttcctagtcccgggcaggccggctcggaggcagcgagaaagcgcagccaggcggctgctcggcgttctctcaggtgactgctcggagttctcccaggtacgtcgtg

SEQ ID NO: 950 - DNA, 1079 bp, Homo sapiens
catcagcccccaaaattattgtagatatctaggtcaatcatttaacatgttctgtttcttcctctgggaaatatgtataacgacaattctcactcaaggggctcttgcaaaggttaagtggcatggctgacatgtgtcaagtctgtaccatcctgcaagcagcagcccagtctggcatttgtgtaaggcggtttcagtggagagatgtgtggaagggtgcaccccacgatgctcacctggtgcttcctcggtggggaagggaaattcagaagtggtggaaagagatgattgtcgtttcgtatatctttgtattgtttcccggatgttgaaattgttactgtagtaactttttatactcatgtgttattggtagtttggatactatcaccataaccacaaacactgaattaggaaaagcagaaacctagaaacatgccatgattcaaagtctggtatttttggaagaggaatttaataacgaacgttttaagaggaaaaagtcaggagagtcctaacccaggccaaccttgtgtgtccacagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaag

SEQ ID NO: 951 - DNA, 850 bp, Homo sapiens
ggagcgagcaggagaggagcggggctcctgcggagcggcgcggcggggaggccgagggcagggcgggctcgagctcgggctcttctggcagcgcctccatccccgttccgttcacccggcagccgccccgtggaggaaccgcgccccatctttagccctgtgaaacagaaaggcccttcctccggcaggcagctgagggaaagatcgccctgcaggggatgtcgggcctgtcactgctttgttgcgggccacagttccctcccttctccgagcgggtcgcacgtccgaaggtcacccccgccaggtggctaggccctgtcgccactcgacagaggaccgaggaggaaccaacccactgcccagactgcagcgccgccacgctagggcccgcgccgacaaccgtcatgactgggcatgcgcaaacggccccgccgggagccatttcgccgggctgcagggctcgaggagagagcaggtgcgcaggcgccgggcgagaggctgcgcctgccctaccctggagcgcgcgtgcgcgcgagagccggaaggggcggtgcctggcgcggcgcctgcgcagtggggcggtgccgggggcggggcgcggcggctgtcagctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggtgaggcagccgggcgagggtcgggcgggggcggtgacctgcggttgcgggcggggccttgggtcagggctactgctcagctg

SEQ ID NO: 952 - DNA, 1001 bp, Homo sapiens
gacagcatctgctttgctctgtcaagacttgtcatggactgattgattgattggttgattgattgattttaagacagggtgttgctctgttgcccagcctggagaggcagtggtgtgatcacagctcactgcagccttgaactcctgggttcaagtcatccttccacctcagcctccccaagagctgagactacaagcctgcaccaccacgcctggctaatttttttattttttatagagatagggtcttgctttgttgcctaggctggtctcaaagtcctggcctcaaatgatcctcccacttgaaacttccaaagcacagggattacaagcatgagcccccgtgcccagctgacctctcattgtctgttacacacacttgatcacaaatctgtctccccattagagtcctcccagtgcctggcacagaccacatgcctaataaataattgggtgaatgaatgaatgaatgaatggaagggagaagatagggatgactctgcccattttcagctgaagtaactgaggctcagggaggtgagtgacttatccaggatcccacagggagtggccaacacagccaggatcccatgggccttctgacaatgcatccaacacctttgaacttggcctaggtggggtgatgtcccctcccccagttctttcgttcggagcccaagataacccttgactcagctgggcaacaacgggacaacaacttcctctttccagaccacaggcctcaggattttcaaggaagcgtggagggggctcgggggcgtgtttccttctagttgccccataaagggcagagggagggagtttggggtactctgcaaggacccgagctatttatccctaggtcctttcctcctgcacgtcagctttgagccccgagctggtgcttctgctctctgagacatggcaggcctgatgaccatagtaaccagccttctgttccttggtgtctgtgcccaccacatcatccctacgggtaagac

SEQ ID NO: 953 - DNA, 1016 bp, Homo sapiens
cttcgtcatcactggaccctatctctcaaaattccagcgaaatctgctcttccctttaaggagtgaaagaagggtcagcattccagaagttcctggtcatacccaggcttttaatgaattgccactggggaatcagcatcccgttgctgtaaggactataagatggcggattgtgagagcatagggaaaggtctcggaggtctcttgtccttgctccacgcaggtctttctggcctgaaaatcccgttgaagagagcagctcttgagagtttgctccaagttccctcggggtgatcagcaccacggacagcggccagggcgcccccgaggacccgcaggcaggcagggtgcacagcggcgagcaggtgctgcgctacgtgcgggccagggaactcgcgcggggaggggagaggcgccgcgggtggcggggtcttggccggggctgttttcgctgtgagtcaccccgtgctccccgcgctcacgtcggtcctcggaaagccggggtcctccctgccttttccagcaacggtggggtggggaggcaggaagaaagcgccaacctaggacacctggacatttgcaggaaaggaagaagcgggagacggggacttgtctgtgtctccagcgcgttcctgccccccggcccgacccggcccatttctatacaaggtcggctctgcccggtctccacctcccacgtcgcaggcgcggaggggctcattcccgggccctgatctcagaggcccggaatgtggctgataaatcagagataaccctgcatggcagggcaggcccgacactcagctccaggataaaaggccacggtgtcccgaggagccaggaggagcaccccgcaggctgagggcaggtgggaagcaaacccggacgcatcgcagcagcagcagcagcagcagaagcagcagcagcagcctccgcagtccctccagagacatggatccccagacagcaccttcccgggcgctcctgctcctgctcttcttgcatctggctttcct

SEQ ID NO: 954 - DNA, 1047 bp, Homo sapiens
gtctgagtgccagagccttaaaaccatggactcttaggtttgaaggaaatcaaaatattcctctctaaaaacctgcggattttagttaaaggtaaaaggttaaaacccaggggcaccctctgccccttctctctgtcttgatcagctcagaagcagagctcagaggatcctggatcagacttgactgttcccatacattcaccttcccacatttccagccctttggaaccctgaagatatcctcttctctgtcctgtcactctatgggacttacggctctttgttaaaatactatttaagcaaggcccctaagccactgccttgagagagaaatacttctcaactgaggcctctactgcataatgggtacagcatgtgttaatcaactttggctgatttttcttttgttaagttgacttttgtttccaggggagcgtgtcaactaagaacctaaacagggaaagaaaagaaatgttttcacccctgcacgtcgtccaaacttcctcctgcgtgtttgagacgacataacggaggccagagaagaggacttgtctgagctcaccaagggtgcacagcccctttctgcacccactcatctgtggatgagaaggggagacaaacaaaggtgtcttctgtttcaaagtgctttcctgtctagggagtggacatttgcctgtttcttgaaacattcaaagagccttatgaatccaaaggcctgcccagaaacaagtgatgagggccctgggcagccaatgggatcgtgctggcctttctacctgcctggggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgag

SEQ ID NO: 955 - DNA, 907 bp, Homo sapiens
cctggcctgacaactattacctatgttatgtttattattttaagctttattattactattttatttattttattttattttccttccacacacccgtttccaccctggagaggccagatgagccagactccagggaggcctagaagtgggcaaggggaaacgggaaaggaggaagatggtatgggtgtgcctggttaggggtgggagtgctggacggagttcgggacaagaggggctctgcagccattggcacacaatgcctgggagtccctgctggtgctgggatcatcccagtgagccctgggagggaactgaagacccccaattaccaatgcatctgttttcaaaaccgacggggggaaggacatgcctaggttcaaggatacgtgcaggcttggatgactccgggccattagggagcctccggagcaccttgatcctcagacgggcctgatgaaacgagcatctgattcagcaggcctgggttcgggcccgagaacctgcgtctcccgcgagttcccgcgaggcaagtgctgcaggtgcggggccaggagctaggtttcgtttctgcgcccggagccgccctcagcacagggtctgtgagtttcatttcttcgcggcgcggggcggggctgggcgcggggtgaaagaggcgaagcgagagcggaggccgcactccagcactgcgcagggaccggtgagtgtcgcttctgggggcagcgcccagtaaccgcgctaggagcgcggagaagggcattgggagagcggcgttcgtggcggagactagcgctccggagcacgggcacgacgggggcaccttctcggctgctagtaactaacaataataataatcataatcatagcaagggcgctgatgggcgggctcggagcacgcctgattctggtt

SEQ ID NO: 956 - DNA, 1018 bp, Homo sapiens
gaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgttttaattgtgagagtatctgatattcttgactgaacaatgtaaaaaacccaaagggggctgcgcacggcggctctcgcctaaatcccagcactttgggaggccgaggtgggcagatcacctgaggtcgggagttcgacaccagcctgaccaacatagagaaaccccgtctctactaaaaatacaaaattagccgggcgtggtggttcatgcctgtaatcccagctactcgggaggcttaggtaggagaatcacttgaacccgggaggcggaggttgtggtgggccaagattgtgccaccgcactccagcctgggtaacaaaagcgaaactccatctcaaaaaaagaaacgcaaacggtgcagctgcccctttttcgaggcacgtccacctcccattacccacttccttttttttttgagactgagtcttgctctgtcccctgggctgtagtggagtggctccatctcggctcactgcagccactcccaacgccctccactcctccctactccgcgctggccggggcggggttccgctggtcgcatccaataataagaacaggcggcgcgcgcccttcccggaaactcccgcctggccaccataaaagcgccggccctccgcttccccgcgagacgaaacttcccgtcccggcggctctggcacccaggtactggggaccccagacccacgcggtgcaggccgggagcgagagcctccgtgggggctccgtgaccccggaggggtagagccaagagctg

SEQ ID NO: 957 - DNA, 1001 bp, Homo sapiens
tcagagaaagtctgggcagaaaccggagccgggcctgaacgtgggaaggggaggaggagagggaggaagaaggagcccggcggccgggagagggagggagggatcgggatctggggccgagccgctcaggacctgccgcgagccccggggtgggggaggcggcgggggaggagcgcgaggggacgggacagcgggatccctcccaggagccaagccgccaagcgcctcgttcctctgctgctccccgccctcttcggcggccgcgagagcggacccaccctccggcttgacctgcgacctccctgcgcccgccgctcagaaacgccccgcgcttcgctgccaaccctgcggctccctctgtgacccgggaccagccccgcgcccgctgcccgtaggcggctcgcggcttcccctttcctcggcgttcaccgagcgccgcgaagtgacccaccctcccccgaggagagggaaggaggatcgctccgggcgcatcgaaaccgagggcgggtgggcgggcgagcgggcaccgcgcggggcattgtgtgtgtgtgtgtgtgtgtgtgtgtgtgtgagcagcgctgtgtctgtttcggaaagcgctctggggaggtcttgtccctagggggcggagcgcaaaggacagaagctccggcaccgagtcggggcagagtcccgctgagtccgagcgctgctgaggcagctggcgagacggcacgtctggaggcgaggcgggcgcactgaaaggaggccggcgcgcccgcggccccggctcgcgttctgttcaggttcgtgggcctgcagaggagagactcgaactcgtggaacccgcgcaccgtggagtctgtccgcccagtccgtccggggtgcgcgaccaggagagctaggttctcgccactgcgcgctcggcaggcgtcggctgtgtcgggagcgcgcccgccgcccctcagctgcccggcccggagcccgagacgcgcgcaccatgagcggtggtgaagtggtct

SEQ ID NO: 958 - DNA, 946 bp, Homo sapiens
gaaacccaacagagacctgaagacgtgcctgcctcccccatctccgggacctctcccacctgggtgaagggggcacgtgagcctcacctgatcttgaccatctcagctaaaacactgaaccacccttggcacccaccagcagcagacggagaagaactgtatagggtgcaaaagcgccccgccaccatcaggtccagatgaaaacctacaagttgaatcagcaaggtgctgacggatacgcaagcagaaaccctcttataggaggttcaaggctgggcgcagtggctcactcctgtaatcccagcactttgggaggccaaggcgagcagatcacttgaggtcaggagcctcagaccagcctggccgatatggcaaaaccctgtctgtactaaaaatacaaaaattagccaggcatggtggggggtgcctgtaatcccagctactcggaagcctgaggcaggagaatcgcttgaacctgggatgtggaggttgcagtgagctgggacagcaccatttccctccagctcgggtgacagcaagaccctgtctcaaaaaaaaaaaaaaagtttgagaatgtcagacaaggcagcaccctgtgtaggtgctcaggttgggcggagtctctctcgggggaggggggtaacaggacagcgcctcccggggcctccttgcatgtctgtgtcctgatgcacagcaggcgggggctgcggggaccagagaaggaagaagcgccccagctgggcacttcccgaggaggaagtggtgccggaatttcccccaggtgtggcctcaggtataagagcggctgctgccaggtgcatggccaggtgcacctgtgggattgccgccaggtgtgcaggccgctccaagcccagcctgccccgctgccgccaccatgacggtgagcctctccacatgccgctcggatggatgctgcttggatgtg

SEQ ID NO: 959 - DNA, 903 bp, Homo sapiens
attcatgcaagcatcactgaaggcttaaacataagcatgaaagtaactcagtatgatttctcttcctaagagctttctcttcttcatggaaaatgggtcagaggctgctagaatgaactgggagccctaattagttatcaccattattggccaggcatggtggctcatgcctataatcccagcactttgggagcccaagccgggaggattgcttgagctcaggagttcaagaccaccctggacaacataggaaggtcccttctctacaaaaatttatttaaagttagccaggtgtggtggcacatgcctgtggtcccagatccttgggaggctgaggtgggaggattactagagcctgggaggccgaggctgtagtgagctgttatcatgccactgcactccagcctgggcaacagggtgagaccctctctcaaaataaataaataaaaagtatcattattattttccttaagaggagacagtgacatgttgaggtctgctttagggaaggagagttctctggctttgctggcgggagccccacatctgaggggggacgtgcagttgggttggagggagagagttggttgccttctgccctgcagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctcatcccccagttccaaggtcagagctctcctcctgctcccagggcagctgccgccccaaatccaggcttatggcctgggatcccccaccatttaactcttgccttttccgccctgcccaggccgcctggttgccaatctcacttacactctgca

SEQ ID NO: 960 - DNA, 934 bp, Homo sapiens
aggaagaggttaatcttgcgaggacagtggaggtcagcgggggagggaggcaaagtgggctttcaggagcgtggaaggcgtcgtccggttcttggaaaattcagaattggagggagtcagagatggttgggggtgggcgggggtgttccatcgatgagggtcttaagagacctgccgagggcaaggaccaggaggggttaaggtagtaacttgggaattttgatcggaatggcagcactttgggaggcctgggacgatcgcttgagccttggagttccaggctgcagtgagccatgattgcaccactgcactccagccagggcgacagagcgagactccttctcaaaaaacaacaacaccaacaacaaaagaagtagacttgagaacttcgttaagacattggccagggagtaaggtagccctgggatttgaggttgaggagaacgtgcaggaatggtgggggattttggctgagcaggttgagagaagtctaggagtgagaggcaaaaaaagacgcaggcagcgtcggggaaatcagaattatgtgtctggagagagttttgcggggtgaaggtggcccagtggggctgttaccaaacttttgagtggttatggggctctaagaggtgacatgacaggacccagcccagtaaacacagcacctctttttgtcgagtttggagcttcagagtggagaggtgggaggcttgtgtttgctggacaggtctgtccattaatctaggagaaaagggtggtgtctcagttcctcacttctgtctttccctgtcttctccagggttgccattaggggactcctgaggtcctatctccaggctgcggtgactgcactttccctggagtggaagctgctggaaggcggaccggccgccatgtccacgttcaggcaggaggacgtggaggaccattatgagat

SEQ ID NO: 961 - DNA, 976 bp, Homo sapiens
agggagcaacacctgttttgtaaacctatatcttcatacagggaatatgcttaatcttgctacagtatacatgaatgcgggaatgtatcttcctctgggctgcctttcgttaccacttggctgggtggaacacctgttcactccactttccacttgggctacaaacctgaaacgaaatctttgcaaccagtacagcctgcgcggggcgcggcccagtccatcccccttcggatgcgcagaagcagaggtcaccacgccggacccctcgattccctcgcgggcgattcctggctccttcaccaccccagcactccaagacccccgccctttggcctgaggctcccactgccctagccagttcccgggctcacttccagcttttccagaaagcttggccacgcccctcggcccagactctcaggccactcggccgcaattaacccgcgtctctgcgcctttttaggcccctccccctcggtcgtgcccttgtcatctcttaggccccgtctcaccctttcggatgcctcccctagaaccctaccactttccacccctttccgtctgttatttctcccaaacttgcgcccgcacaggcccctctggaacactcctgccccgtagtgcccctcgtccccgctccgtagagaaagagcgtgcgtgccgcgcatttctggcctggggagcgggtggagtaaacctgcgggaaccattttacgacaacgtgcggctgtgcggtgtggctgacggcaacgccgctgctcttggagaggtcactccggagacggcgttggttttggggtgtggggggttggtggcactatgtggcgcgtctgtgcgcgacgggctcagaatgtagccccatgggcgggactcgaggctcggtggacggccttgcaggaggtacccggaactccacgagtgacctcgcgatctggcccggctcccgctcgtcgcaacagcgtgactacagggtatg

SEQ ID NO: 962 - DNA, 1189 bp, Homo sapiens
taattctcagttcattcgtcccggtgtgggaacttaattccctcacttactcctcccaacaactccttgaggtagggattattttctttttaactttttattttgaaataatttttgcctcccagaaaatctgcagaaactgtagggtttcctaatacgcttcatccaactccccctaatgtgaacatcgtctgtaacccctaggacaagccaggttatcaaagccaggaagtgaacacccacataatcctattaacaaatacacagactgatcgagcgtgatgactcacacctgtaatcccagcactttggaaggccgaggcaggcggatcacttggggtcaggagctcaagaccagcctggccaacatggtgaaaacctgtctctactaaaaatacaaaaattagccaggggtggtggtgaacacctgtagtcccagctactcgggaggctgaggcaggtgcatcacttgaacctgggaggcggagagtgcagtgagccgagatcgcgccactgccctccagcctgggcaacaagagggaaacaaaagcaagcatcctgcttctcatcctactttccctctgctaattttgaatatcgatgcacacacatcttggctgcaacgattatgagaagttcgcctaatggtgaccttcgatttccctcactccctgtacatctcctaactgaaagagctgcagtcagtcacacggctggtgagggaccctgagaccccaaaacgaactccattaccacctgagggaccctccaaggatcgccgggctacgcagggtccctagggtacgaggccgccccctcggcggccccgccccctcggcggccccgccccctcggcaaaagtcccgccccctcgacaaagtcccgcccccaagatggtggccccgggcggtggacagggcggggcgtgccgggtcacgtggacagccgacgccgacgtggcctccggcggacgctccacgtgtccctcgccgcgccccgtctacccgcccctgccctgaggaccctagtccaacatggcggcgcccagcggagggtggaacggcgtcggcgcgagcttgtgggccgcgctgctcctaggggccgtggcgctgaggccggcggaggcggtgtccgagcccacgacggtggcgtttgacgtgcggcccggcggcgtcgtgcattccttctc

SEQ ID NO: 963 - DNA, 1087 bp, Homo sapiens
gtaaaaccgaagggtgattttcctgggctggaaagtttaagaaagaagagagagctgcgtacctagggcttaaggggcctcaggctggcactcgaaaccaggcgttctcatttccctttggcatcaccctgaacggctgtgcctggagctggcgcggggctgaagaggggaggaaatacatgtgaggaaaatcagaggagagggtcgggaacagatgtgggcataaagggaaggcctctgacttgaaataaacaaataggagtcccgcagctggaaggacaaatcctttcacgtcgcgggtgatgtgggattggggcgattttgctctccctttgttctttcccctgccttccacgtttccagggtatttgattgatgtctgtcttctctgttaagttattccaccgtgaggagagagccggtggcagtacctggcacgcagcgggcgcccagtatagacctgctgaacaaacgaatggattcaggggctgctgtgtccccctcacccaccccccgccccctatgtgtccacagcgccccgcacgtagtaggcgacccctaaacatctgtacagcaaatgatttgcaagttttcggcgctgagcacgtggagctttggaaaccaggacagcaaatgagtgtctcggagaccacaaaagcggttccggcgcgtgcgaaaggcggtggctgggcgacggcggagggaacggcgcagagcggggcgccccgccgggagcgctgcctgcgtggcgcccgaggcgggggcgcggggggccgcgcatagcacgtgctcgtctgggagccggccgggccgaggcgggcgcgcgtgtgcgcgtggggcgtggggtgtgtgcccgcgccgtgccccccgcgtgtgctgccgggcgggcgccggcgtgagtcacggcggggctagcctttataacggcccggaggctcgcgggagccgccgcgcccgtccgcccgccgctccgcgctccacccagcgcacccgggccccgcgcccccaactgcctccggcggccgcccagtcccgagggcgccatgaggagcctgtgctgcgccccactcctgctcctcttgctgct

SEQ ID NO: 964 - DNA, 902 bp, Homo sapiens
gggatattagcagcttgtgctgtgcagagatcagcagttcccactgcctcagggatgagaggatggagcttaagagagaggcctttggatgtgggcattagggacagaacggattttcccttcacatattcattctttcagcaaacctgaattgctgtctgtctgtgctcagctctggcaggaactggggcacagagaggagccagtcctgggctcgctgattatagcctatgttaaggatgtggtaaaggtggcatggaaggagagagagactgagcccagagaaggtgtagcggacatcctagaaatcttccaagaaggggcggctaaactgaatctccaaggataaaaataaatttctggcagagggaacagtgctgaggggagaagctggaccccaaaaaagctctcgttgaccatgctctgcgctttatacacctagtcatatttgctcctcactgtaaccgttgctacgagggagggatggtgaacaccattttacagacgcagaagctgggactcagagaggtggaatcactcagtcagtatttcacacccgctagagggcagaagcaggacttagggctctcttatcccagccaagcctgtaccttaatatctgtggcagcccaggtggagagtgggggagcaagtgggcggatggaagaactgagtgctgacagcctgaggaagcagaatggagtccatgtgttctgagcttgggctggggtcagagttgagatgggatagtcacgaagtctgtcttggttccacagataccatctatgatgaagatgaggtcctcctggccctggcagaacagctgggaaccttcactaccctggtgggaggcccagagtacgtgcactgcctgctggtgagtggaaggcaggaagtcctct

SEQ ID NO: 965 - DNA, 1093 bp, Homo sapiens
gtgcaagaacattttccacacagcggcgcatacccccgcccgggggcgctcggcagccgcacgcggccctcagagcgcagcccccacacgcctttacttctggaaggcggagaccgccacagtgaggagctaagccagctgaggcaacacagaaaaacccccgttcctacccaaaaccaaaaagcggggcgcggaggcgcgcgcctgcggtcccagctaccggggaggccgagaagggaggatcgcctgagcccgggaggcgcaagctacagtgagccgagactgccactgcactcagtctgggtgacagagcgagaccctgtctctaaaggggaaaaaagagctaggaagaagcgggctgcctcttaacttcggagaagtaaatgaggaactataaccagtgtctaccgtttaggaaccaaacaaaagctgacaggaatcccgccaccgacccagccgccccagactttgccctggcctatcccgcgccgctcctcaaactagacccgccccgacgtcgccctggcctatcccacgccgatcctcaaacgaggcccgcccccgatgcacaagctccgccctcgttgcaccgtcctgaccctcggcctcgcccccgccccctggctcttcccgcgcagccgaatgccgcgacctggctcccacccttcgtcgcttcgcgccgcataggaaccccgcccctagtctctcctcccgcctatcctgagcggcgcgcgcacaaatctctcccacggacccgcccaccctgatcctcaacctggcccctggcctttcccgcggcgtcgagtccagtacaccgacgcacgagtcccacccccgatctctccctcggcctatcccgcgccgctccgcgcaggagtcccgcctcccacttcgcccgcagcctatgacgcgccgcgtcgctccctctcctcaaacccgctctcgcccgcggatgggcgcgcagctgtgacgtcacggcgtcgttggtaaggggctggcggccggggagctgcgtagctcccggccccgcggccatgcccaagcggagctgccccttcgcggacgtggccccgctacagctcaaggtccgcgt

SEQ ID NO: 966 - DNA, 1081 bp, Homo sapiens
tttgctcctacatttgtcaagtcctgcttgtacatttcctagttgccaacctggtgtcacagcgggcaaatcatgggaagagccctggttttggagccagaccacctgaattggcctcccgcatggacttagctgtgtggcaatgagacaaggcattttattctttgaatttcagttttgtaagcataaaaaggggaaaaataaaacccagagtttagtaaggtttagaaacgctacactcagcaagtcatagctaagtcaccgtcaccaatggtagtcaagtgtgtggtgcagcaggaaacatttggagtcgactcctttacggaactcaaatgccctcacatttagggagaaatagaaagaattacgactcatgaaatcgagctggggctggcacttctgaccctcccaacaggtttccagaaagctatttacacacgatgcattcgccaaaccactggaaatcattctaccctgtacttttttccaccctgcctcacgtccttgccctatgaccgggttcctaccccaacctctgccccaacacttagaggaggagttgcgggcctctttttacagtggataggattccgaaggggagagtaaatcagtaaggctccacccatttcacaggaggcctagagaccggcgctcccctttcccctcccgccggacctgccaggaggtgggctggcgcggagggagggccctgtcccctgtccctttaaggaggagggccaaacgccggcctagagtgcggcgtagcccccacccgccgtgccctcaccccagagcagctgcagcctcagccggccgcccctccgccagccaagtccgccgctctgacccccggcagcaagtcgccaccatggtgaagatcgtgacagttaagacccaggcgtaccaggaccagaagccgggcacgagcgggctgcggaagcgggtgaaggtgttccagagcagcgccaactacgcggagaacttcatccagagtatcatctccaccgtggagccggcgcagcggcaggaggccacgctggtggtgggcggggacggccggttctacatgaaggaggccatc

SEQ ID NO: 967 - DNA, 1010 bp, Homo sapiens
aaagccctttcttgagaaacacagtttgggcattgggtgtgtggtggtgggggtgtggggagagatcgaatgtgaatttactgacgaatgtgaaaaggattttaacaaggaatgtgagggtcccacaaaagcctcaagaaggaagcaagggagtggccttgagtcggaaagcccttcagccctgaattgctctgatacacatgtcagcatgtgattaattttaagaagatttcaacctctttatctgccaatttagataggaagtgaaggtggttggggaggtagaggttttatttctggctgtgatgtgtgttttctagatccatcaggtgaattcccactctaataggattctgtgcgtagaattgatttttacgtgcagtttgatgatgatcatgatcatataaaatacacccaattgagaattgttcaactgattttgtcatccctgaaagtgatttcagtaaccccagactatgaaatatctttttgaaacacatcctcaaagaacacctgcttgaaagggggttttacgatcctcacttacaaatgagagaactgaagctcctggcagagaggtaagaaaattagtgagtgcccaagctggaatctgaaacaaatctttctgcctccaaagcccaaaattatttcgtctggctgcagggccctgtgagtaatcgagcccttcatcttgggaaaggcatatacagacctggagcaaaacagtacgcagccatgctctgcatttagcaatactttggtttatttttgttctcacagaaatctcctttgctcttcccctcattagctgcttctggttgggcccagacctgccttgaggagcctgtagagttaaaaaatgaaccccacggatatagcagacaccaccctcgatgaaagcatatacagcaattactatctgtatgaaagtatccccaagccttgcaccaaagaaggcatcaaggcatttggggagctcttcctgcccccactgtattccttggtttttg

SEQ ID NO: 968 - DNA, 1081 bp, Homo sapiens
gaattaccatttcggagcttgtgatcaccatatgtagttatcactccaagctgcttaaattccagtctaaaacaaacaaaacattctaattattctgtgctaccctgacaggggtaagtgaaaactttccattcaggtttgtaagaacgagctcccagacctccacctcttccccttgctgcctctgaggactcttggaggtctagggaggccagtttgggttttcttgctcaagaaagtagccaccccacccaatttggaaggattaaagcttgtcctagttttgcttcattgttgtacttctagcatgctaaagagctaaaaaatgggaggaagaaaatacaacagaaggcaccattccagtaccaaactgaaaagaaacacaaaaacaagagagcagcatgtttttaacagcttgcgtggaaaaaatattgactggggagtttggacagcactgttcattttctctcaccgcccgcgttatttgtcttacggagcaggagccagataccattctggagaaagagccgcgggaagaggtggaggggttctgtggaagtttgagtctgagcggagaaattagggctggagatccagtggctcagggccaggaagaagtcaggggaggtgctaaagcctttttcctcctggcctcgggcactctctttggtccgcctgagtcttaagagggcacagcgcagatcattcaggtaggttcctggctccttcagactacaacgagctggatgaatccctgtccctgtttctttcggctggggaaaggacgcaggggttccattcgctttcttagcccacccgtcttcttgagttcagacctacaactcctgcagtgggggtcagaagggagccttaatcatcgggacagaaacgcggctccccaacttcggctaaaccagcgtggcggccttcgtccctactgcctgggcgcggggcggggcctgggcgcggggcgggaggcggtgaccagcagcaggaggagaaagaacatggcgggcgcatcagagctcgggaccggcccaggagcagcgggtggagatggagatgattcgctatacccgat

SEQ ID NO: 969 - DNA, 944 bp, Homo sapiens
ggcatttttgaaccaagagacagcacttgggatccggaatgtctggacttgggcacggcgctgtggagctggcgccgttgggagccatgcgagttctgggtcggtaggtcacctcagaggtggggagaaggttctctgagaccgacatgggggctagtgctggcaccaccggacatggggcatttcagacacagggcgagcacattccctagttaccagggttcattcgagtcagtcacgtcacaggctggcaatgggctaactcctcctcaacaatcacacggggcttgcctcatagaatgttttaaaaaaggaaaggaggctggcgcaggcgccaaccgtctcagaaccctgagcactgccccacccccaccctgcccgccatagcctgggctgttgtgggggaggggtgaccatttatcacgaaacaaaaaattgcgccacagcagctccctccctcccccacctttacggttgcagctgcacgtcccacgtgcagcaccaccccctgacacgtgcggcaccaccccctgacacgtgcggcaccaccccctgacacgtgcggcaccaccccctgacacgtgcggcaccaccccctgacacgtgcggcaccacacagctagtgccggaactttttgtgcagagaaagaagaccctgcacccgcgcggagggagcccttttgagattgcaggagagaagatgagaatgggactattttcaataactgtgcacatgcaagtcacaaacattccagatcccttgacttgcttgcggagggagcggccggcggagggagcggcaggtggagggagtggcacgaggcatgcggagggagctgcaccgacatcacataaacgcactgggcagctcgcaggcgccattcgctcttcagacgccggagacgtaggagtgggtcttcagactccaaaggggttggactaat

SEQ ID NO: 970 - DNA, 930 bp, Homo sapiens
gcatcaaggaaaagctgaagaaaagtctgaccaacagcgaaagataaatgcgcagaggagaaatttggcaaaggctccaaattcaggggcagtccgtactctacactttgtatgggggcttcaggtcctgagttccagacattggagcaactaaccctttaagattgctaaatattgtcttaatgagaagttgataaagaattttgggtggttgatctctttccagctgcagtttagcgtatgctgaggccagattttttcaagcaaaagtaaaatacctgagaaactgcctggccagaggacaatcagattttggctggctcaagtgacaagcaagtgtttataagctagatgggagaggaagggatgaatactccattggaggttttactcgagggtcagagggatacccggcgccatcagaatgggatctgggagtcggaaacgctgggttcccacgagagcgcgcagaacacgtgcgtcaggaagcctggtccgggatgcccagcgctgctccccgggcgctcctccccgggcgctcctccccaggcctcccgggcgcttggatcccggccatctccgcacccttcaagtgggtgtgggtgatttcgtaagtgaacgtgaccgccaccgaggggaaagcgagcaaggaagtaggagagagccgggcaggcggggcggggttggattgggagcagtgggagggatgcagaagaggagtgggagggatggagggcgcagtgggaggggtgaggaggcgtaacggggcggaggaaaggagaaaagggcgctggggctcggcgggaggaagtgctagagctctcgactctccgctgcgcggcagctggcggggggagcagccaggtgagcccaagatgctgctgcgctcgaagcctgcgctgccgccgccgctgatgctgctgctcctgg

SEQ ID NO: 971 - DNA, 1004 bp, Homo sapiens
tcctagccaatcaaaagcaagagctagtgaggcttcaggatgatttggttttcagactttttttttctaatgccacaatccttagatatggtgggaaaggcacttcaaagtgagtactccagatttaattcaaatgcacccatttaagtagctcagaaaattgcatcatctagggttctggagtgacagtgttttatatgttgaaatcttttggagtgggattgaaacagcaaaatcattttatttcattaaaatcggtctcagcctcttctttttcctctcattcaccgcaggcctttccatctaagaaacaattcatagctgcttcttcagaggatgtctaattttccctcattcagagggacacatttggtactttgccctgtgttttaattagtaagcttcagagaaagaaagtcgtcagagccagggcccccagttgtggaagtttctatatccggtaaattggatccattccagggcagaatcatttatcaacaaatgaaacaccagccacttcccacacgtcctctgattgcattaaaaaatcactccccttcctacccaaattgagtatacttagagtatggagctgacaaacattctctttccttctcctcctcctcctcctcattctgttgaattgctggtttctgtagtctattaggcttcttattaatagtaataaaatgttcattcattaactctctcatgcctgcataccagctatagtaactgtctttgcccccaagttatgcagtctttataaagtcgttcagtagcagggcaatgagttgggaaaactgatattgcatctgtagcatcaggtactatttaaccagtgggagggactgataaaattagcaagttgactaaccacttcccttccttgtggctctttaatattataacggatacagaaaagttcagaaggactgagctagtttgcgaaaccacagcacactttggcaaagagggaatgcacaacaaaacgggtaagtttc

SEQ ID NO: 972 - DNA, 924 bp, Homo sapiens
cacacacggagtaaaagatgtcgtataagttttgctgttagagttgaacttaaaaatctctaaattgttacatttggaggctctcattttgggggatcctagtgtgagatgctcctttgttggtcaattttaattatacagacataaataaaggatatattaattatagagaaaaagatcagaaatgtaaacaaaatgcagataagatggagacattcaatgatttgtccaataatataaaaacagtttttgtgtgcgggtagtttgttgtcattagtggaaggaaatagagagaaggataaataatatttgaatttgaaagagcggatgtatgaatacaagactcccttgaagaagaaaggatcgtctgggaccacagcaggccggggacagggagaagaatgagcaggctgtgtggaagaacaaaacgacctagtatcccagtttattttttttccagtgctatgatttctttcctttatcttaaaatctttggtaaacatgtaaatgaggttttgagaagttaagattgaaattccatgttcatgttcgctgcaattgaactggagaagtgaaaatatgacaaatggaagtggcagccctaagggctggaacaagagatgcaaacaaaggctgggatggatttgtggaatttgtaacaaacacttcctaggagtgatttctcagtaaaagggggcaacgaggctggtgtagtaagttagcaaacaaattccagcagccttccctgggggactttcatgctgaaatgcaatccctagtgttggaggtggggcctgatgggaggtgtctggatcacggggggtggatccctcatgaatagcttagtgtcatcccgtttccctcatcaacatgcattcccagaaatgccatgaaaggaaagaccaagtcttgactgagaaacgg

SEQ ID NO: 973 - DNA, 1082 bp, Homo sapiens
gactcacagaagagcaggtttgggcctgtgccttcctcctgcccaaatgggtctctctccccttccccttccagccagggccgcagctggggctgcagcttgagtgacgggaaaagaaaggtttactccaccagcgcattagcggcactcacagcattaaaaatgcaggaggtggtgggaggagcgggccagggaggaaaactcatgcagctgcggggcgcggggaagagccgggcttctgcctcctcagcccggatcagagccgaagaacgagggcagtttgggttgagaaggattctccagtgtaaccgagaagcgagcgtccaggaggctgttggggaggtcggcactgtgggcttcctggccttcgtttgctgtttcgagggccaggacctcgtgtgttcccgtccgcccctctgggacggcgccagcccggcaggccgccgaccgtcctggggctcccgcgcagcgcgatgccggcctcgtccaccgtccacgtgctgcagctgctgcgggagctgctcgccttcgtgctcctcagctacacggtgctcatcggggcgctgctgctggccggctggaccacttacttcctggtgctgaagtgacagcgccgtcgccgcgcccggccccgcctcccgcccggccccgcctcccgcccggccccgcctccctaactcaccaggaaattcccttcaagccctggcccgaactgagtccccgcccacccgccagcgtcacggcgcccgactcagctccgcgccggacccacctccgcgccctcaggccctgcatatgccccgccccgcgcggaagttccggcggttggttgccttgcgcggccgttacagcctttgccctaagcctcgccccctttccccctgcctgcccaatcccgactgcttccttgggtgggggcgtggctatggggcgaggcgctctcaggtggaggccgtgccccgctccgcgctcacgaagctgcgtcacttccggcgtgtgcgtctggcgtccgcgcgctgcacaatggcggctctgaagagttggctgtcgcgcagcgtaacttcattcttcaggtaccgctg

SEQ ID NO: 974 - DNA, 1006 bp, Homo sapiens
gtgctcattaaagaccaaggcaggctggactgagctagacacccaggctccaggttccttcctctgaaacatctgcaggtttttgggaggcgaagggctctcagctgccatggctgatgtctggggactttttcttcagctccagatggtctacacagggttcgtatacacaggccccctagccgcacgcatgcgtgcatgcacgcgcgcacacacatacacacacacaccccagagtaaattcactgatatacaccactatgaacacacacaatgacttacctatacacacatattaatagacacccatactgctcttaacacacaccttcagacatccacacagactcacactcacccacatacacacacactgacacagcatattcacatacaaagatacacactgatatgtaccacacagagacacgctgaaacacatccatatgcacaccacacacactgagatacagtgacacacacagtcacagatgcacagacatatgctgatgtaaatgtacaaatgtggtcacactgacacatacatgcaatcatctacgcagactcatagaaaccgacacaaatacctgaaatacacagccacagacagacacacacggaagcactctatgcacaaaacactcacacagtacacaccatgctgcacataccctgacccaaacagtctaacaagccctgagggtctccagggctgccctggggctattgcccacccctcccaccgtccccgctagggtgagatggtgttccccagggaacagaagtctccagtcccatcttaagctctgccggatcccgcgtgacatcagctagccccctcgcggctgccgggagctgtgagctctgtgctggggccaggccggcaccaggcacagacacttaggcccttgttgggagaacagagagaggctctcttgtccactgcctgtcttcggttccaactgctggttctcctagaggcctctcctcagactcgcaggtatgt

SEQ ID NO: 975 - DNA, 973 bp, Homo sapiens
gaaggtgtgtccttgaactgaggccctgtgatatggcggcctgcagtggtgtgaaacacacaatgtggacgtgcactgacagccttgcccacccccaccatgcagcccctgggcccttgtgctcctctcgcacaatgcatgtgctgtctccatgctggatactggacacactaaactctggggcttgtcctgtgcttgcttagagtgcccagcagaggtttgctgacaggtgatgctctggcttgccccaggactctggcacttccattggttcttcctttccctggagctgaggtttagatgtgcaacctgtggctcaggggagcaagcttacacaagaagtgagggaaggatgtttagcagtggctggtgcccatgaagaggagattggccagtgagaagctgaggcctatgcagacatctctggagccagagagaacaacaggcaggggcccacttggggccttcccccttgtgggggtcgttttttttttttcttttcttttttttttttttttttttttttttttaagataaaattgttcaaagccacagttgtctgtttttcttccttttgtgggccacgggctggaagggaggggcacattgctcttcgaccagtaagggctgtgccaagttcagggtggggtgctgctcctgcatttattacccggagtcctggttcctgggccagaccggtgtgtcgtttttggcccaagctagagaatgttaagggcttctgcggtgggttggtgctagaggcgccgcgaacaggtgctgcgggggcggcgcgggaggcggtgcccttgcttccggatccggtctcagctctgggagggaacgggagatgttgcaggcgccgagagggcgggccagggccgcactccggagactcgcggttgctacgcgcaccatggctggaggtacctgcgggggattcctggggccgcggttctcttggtcctctgggttg

SEQ ID NO: 976 - DNA, 702 bp, Homo sapiens
tatacaactctgcctccagacccctctcccagtgtacggagatcaggatctcatcacccctccccaccacgtgaagtcctgcttacagctcaaatgccttttattaaccgaagtgcctccagacccctcccctcctcaccacgtgaagtcccgcttacagctcaaatgccttttattaaccgaaggtcagcttttgtgactctcagacgctcaacaggtgcgcaactctgctaacgcagtaggctgtcctggccaaagggtggtgctgtgagtcgcctccagcctccgggccgtcccgaaagctgcaccttctccccctgagctgcagagggcgcgcgtgaggcatcgggcgctcaggaccccgcgggagctcagcgagggggcgggcggccacggagtgaggccggggcggggtcgggcgcggggcggacgtggggaggggttggccggggccagaagcagggtgcagggcaggcgcggggcggtcacgggggcggggccggtcgcggggcgcggggcgggcccgagctaccggtagtctgcctgccgcagtccgagcgccgcgctggggagagcgggtgtttgaaggctccgcggaccggcactaggagccgggggcgggtccgtgaccctccggctgctcggagtgaacaggcggccaggaaagaagcgggcctgaacaccatgatccctttggagaag

SEQ ID NO: 977 - DNA, 947 bp, Homo sapiens
agagaccaccaaccacagagaagttctggccaatctaccagggactcacagcgagggttttcatgtcctctgctttgccatttgacatcagagggctgaaaacttcacactgggatcatgctaacaccaccattttttgaatatgggtcccatagagaggcaggaagcttaattgtgcatgtgcatatttctcctttcataaatattcatgaatcctcctacagctcattgaatatatttggccaccctgctcagcataaatttctgttccctttgtccttccttccaagtgtctgttctcagcttctgaccagaggctatgcttccaagcctgtcagaaaggccaccctgcaggctgtaacccttcatgagaaataaagcccttttctaaatttattaacctcctcattcttcagttgacataagtagagcatcatagtccccacaaatcatttctgggatactctgttcttatttgtaaaacaaggagataggaaatgcatgctatactaaaagtttgttcaaagaacatccgcacgtgcaaatgtctgagaccagaggctgcaagcctccctgtcgctcttagggcttcggtagccacattgccacagctctccacgccctcaggtaacgcccctccgcaggccgagacgtcggcacgtacactgtcaggtcttcccgctttccgtcgcttcctgttccgtcttggtcccgcctgccgctggcgccgttgtttccggctcaactggggagctgctggagctcttctggcctctggttttccgactgcttatccgacgctcctccctctgtctctgtagctggagaaggtagtttccaggaaagttttccggtttgcaggccgcgcacatcgggcaggggccatcctcggtccccttgctcgttgctcgcagccccgttcggctacaagtgagtttcagggcgtc

SEQ ID NO: 978 - DNA, 900 bp, Homo sapiens
tgatagcagtgtccacaggaagagagtgagtgggacatgaaatttctggttctgcatgcagacttctacatttctaccagctaattattattatcattaaattattaagcaaagagcttactcgcaaaggtcaactttttataaagcataagtcatccttggaagtgtcgtttggtcattctagtaattcttgcttttaattctttaacaactatgggtagaactgcagtgtaccattattccacctttgtttgcactgtcaaaatacccaagacgttgccaaggacgactgaattcttaggcttggccgcagccacccacagggcaggtgctcacttcctcctccggggtagaagagatcatgggtccctttccagtccaggctggaatggagaagtcgtccctgaccacagtgcgccaggcagaggccaaggttctaaactgatagaacccacccaccagggcggtgccaagtcccagtaagggccgcatctccccagcttggctgatgaagaggcggggaccgaaccctccagtgcaggagcctgtctggtgcctggctctcccaccgatccgcacgtacctcttcctcgcgggtcctaccccacgcaggtatctagcgcccagccctgttcatttcccacacctggcccgctccgccccggggccgaggagacgcacgtctgattggccgagggcggcgggggcggggccggggcgcccccagaggcctagacagaggtgcgggcggggcaggccgcgctcagcaggcggggcgggagccgcgtgcgcccgaggacccggccggaaggcttgcgccagctcaggatgaggacaggctgggcgacccctcgccgcccggcggggctcctcatgctgctcttctggttcttcgatctc

SEQ ID NO: 979 - DNA, 1044 bp, Homo sapiens
ctaggggaagaggttcagctaccatcccgctgtccgctggggcagcctgacccaggcacaagactcctgtggggtcacctaagggcgccagggagaagagcgagggagggaggaagaaggaggcaggacagctggctccagctccacgtgctcccagcccctggctgggagcccacgtgagggtcgccctaagaagtcgggggcgaggagagagggtgcaaagccccggcccgggctggacggagagaagcgcggtggagacttccctgcgccccctctgggcccgtacggcccacctcccacaccagagtgctgcgccgcaaccccttactccgcgtcctctgacccctgatccctgccctctccctcgggccaagccgtcgcatccctcggattcttacacgcgccgccccagcaacccggaccgcgcgccggggtccgcaccgcgcagcctagcccgccggcgccgccgccaaaaccccgagcccgaagctgttgcagccgccgcagccgccgaagccgccgccacttcagccactgccaccagggcagctgcgccagctctcctatccaccgcctaccgtcctctcaaccccgctggccccgccccatttccccttcacagcgtcctactggctaactgggctaccgtgatgaactctgattggccaactatcacgtccttccgcaggtctcgcccgccgccgatgcggtactccctgcccgcctccttaagaaggggcgggacgaagaatccacgccccttactcctcccttgttccccgccttactcgttgagtccaacccagagggagtcccaagtctttccattggtgaaaggtcaaaatggcggtgcttctgattggtcagacttcaggaggtggggacaactgagcggaacaataaattgaatggtgaaaagaaaggtcagtcagacaccgagtctcgccttctgagattggcgggtaacctagcaacgcagggaccgcggcggtaactgtggctagggaaacctggagcggtcagagcaggtgagtagccagt

SEQ ID NO: 980 - DNA, 995 bp, Homo sapiens
ctttgtctcctgcgctgctttcgtggtgacggtcagggggcgcccggtcggcgaagggcgcgggccggacgccgcggggcttggtccctggcccggacgctgcgctctgaagggaaggcgcggacgtgagtttcggtgtgattgccttctgaggggagggtctgtgggatgaaggcggcgcggcgcgcaccggtgtcgcctagcctgcggacctagttgtagaccttgcaggcgttcgcttcgtcgccctccgccgccccctccccatttagagatgtgcacctcacggtgtgcacctcagagaagttctgtctgattcggtgcggcgtgcggtacgggagcgggagggagggagcacgggcggagagagcgccagagccgggccgagccgcgctggagttacaaactctattgtgacgcacttactacgactgacggccgctgccagaccttccccagacttgctgccctcagcattttcggcaaacaatggggccggagcagggaacgcggccagccgcctgcaatcgctgcatctgcgcccgctcctgtgctccggcgtcctacctaaccccgggaagtcagagccgctgggagtttctgacttactcgaagaagtctgtcctgggcaaagagcacacacgaatagacttcagattagctgcttctctggaaacgcatgtgtgtgtgcaccagttccgcaagctgttgacattgttactgtattttgtttgggggtaccctctaccaaaaaaaaattacacctttattattttaggtgcaatttttttatttgggagattgtcagaaaagtatagaacaaagtatttgggattaaccctaagaatttttaatcgctaggtgagagctaatttgtttattcatcgatttttttttttgcttaaaataatcttagtttttattttacttgcagaaaaaaagaccaaatggcaaagcaaccttctgatgtaagttctgagtgtgaccgagaaggt

SEQ ID NO: 981 - DNA, 1058 bp, Homo sapiens
tcatggagagagcagggttttaggattgggggagggtgccagggctaccgactgctttgggagatcccagagggggcattctgaagtcctgcagaagagatgctgtgccgtgaggggtgaggggtcgctggaggccagaccagggctcccaggagtcctgcattgagaagggagagagtggacacaggaaggatgcgcctctgtccagtcctgaggctgggcgcacacaccaggcccttcgaaaagctcacattttttccagcttttctcacccagtatcacttcctttgttaagaggagggggtgggggaggagacggaggatgaggagggaggggctggcgggtgccgccgccgcccccgccccctcccggtgtgcggagcccgattgtcactcagctcctgcgccgggggcgacagagccgcaggcgcccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggtaagtctgagtctcggttcacccctggggctccccaatgggggtgcaggagagggttgaaagaagagaccggaatgcccccttggggcaggccatgggcaaggttccccgacagagctggaacgggaccagaggactgctaagatccaggcaccagacgggtctcaagtgggtgggcgcagggcaggtgcgggcacgctggggaatagggagaaacgccccagccttgtcctgggctccgtccccagacccacgtctgccaccccagtcccaggtgcgaaacaggggcgctacctctttaaaagcgtccggggctgagtctctgccgtaccatgtgattgcttgaaaggccgggctgggagcgctgcggcgggagccggaggactatgagctgccgcgcgttgtccagagcccagcccagccctaccgcgcgcggcccggagctctgttccctggaactttg

SEQ ID NO: 982 - DNA, 946 bp, Homo sapiens
ttgtgagcaaggaattctactcgactttctgtctgcgtaaactctacaaatccacttggcctcagccacagtgtctttattcgtaaagcagaaacagtgggaccgtcagagcactgccgggcaggcgagagaagacaggaactgtatgaccacggaagttgttgtccctacaacctatttgctcatctggaacacagaatagtggtcctctaaagcttgcagggctggaggtcgccattatcagcagtggtgtcactaaacctgaacccaagggtctctgcaacttgggaaacgacggcccggatctgaggagatggccccttcctcccaccccgcctaaggactctcagcctccctgaccctacctttccggagctcagagtcccctctggcctccaagggcagaaggaatgggtttggctgaggtcgggggctcgggtctgggacgcgctccacctccccggctgcgcgactatggccaggctccctgtcggagcctctgcctggggccccacctggaaaaatggctcctctaaggcgcttccagcctaaagcccgtcctcttccacctcttgggtgcagactggccctcccactccgaccgcaggtcccccaccggccacacagacggctacgctagaacccagccaaacaccggggttgccaggatggtcccacagctttcctttccgactcccggaagtggccgtgatctcacgagatcccggaggcgagcgcgaccggaagtccggtcactctcgcgaggccccagagagcaggcgctgggcagtgtggaggtcgttggagtcacttccccgtcaccagctcctgtgcctgccagtcggtgcccctcccgctccagccatgctctccgccctcgcccggcctgccagcgctgctctccgccgcagcttcagcacctcggcccaggtaggccagacgaggg

SEQ ID NO: 983 - DNA, 919 bp, Homo sapiens
cacttcgtccttggagtctccttggagtgcgttcctgggggcttgcagcctcgccgggagtctcggccccgggtctgcttcgttacgaggaaaaacgggcccctccgtggggacatttcccctcctcctccccgtgcagctctggccatttgagcaggggctcctttcgcagttgtgaagagaggccttggctgacgcagcaagcgggaaagggctgtccctttccatccgctcctggccacatgagcttgggagcgtctgcagggcgggcagcccgggcgggggtgtttgagggagctgggtggaaggatggagacgtcgggcgtgattcctgcagaagacacctgtgcacgaccgggaagtgggaaggagtgtttgagcaaatcatgggcgggagtgcggccaagggagctctgatcactgatactggtggaggcgggggaggggagcgactgtggctccgggctagacgtcccgatggccatccctgtcatctggatgggtgcctgagtaacttacggcagaaagtggaagccctgggaaggggtggtcccccacttcagtccgggctcctcatccagggtctgcctgcatctacggtctgtgaggatggcttctttctctgggctgctgttgcagatcatcctggtgggccagcaggtgacagacaccaccactgtgctgggtggccgcggcccttgtggggcgtgggtcagggaggatgtttcttctgggaacagctcctgcttagggcatggctccccgctagggagaccagggtgtggtcagcagcatctccatctttctgcagcttgaccctcaacaccaaccatgggcatatcctggtggattactccaagaacctggtgacggaggacgtgatgcggatgctggtggacttggtaatgttctgcttggg

SEQ ID NO: 984 - DNA, 702 bp, Homo sapiens
cccagaagctgccttcttttaatttctgtcagactctagactaccctcaaatttcactggacctgcgattacaatattacctagcaataagaatcaaaagaatcgaacatcattgagtgggaaaaatcctctgcaagtacagccaagccttttctgaggctatttttaaacttacaaatcagaggacaatcgcgacattagaggaaaattacccaggtttacgccatcactaacgatgatagcttacgatgatagctaacccagctcttcaacttcctttcaatctccagaaaaggctctctgcgtgctaatggtaacgtggctttacagatttttacccacttcaaatatggccgccaagctccgttctcttttaccgcctgatctgcggctacaattctggcttcatgcccgcctccaaaagtgcttcctctcgaggggttgtggttcttactgcgcaggcgcaaaagcaagtcctcttccgggcaaaatggcgatgggactaatgtgcggacgccgggagcttctgcgcttgctacagtccgggcgtcgggtaaggatgccccggggcagagcaccgggatgctgccctgacccagtgaaccaggccccaggacagctcgtgctaggggtatcagcagacgctgacctgctcaccgggacctgaatgtcatgacctcgggtcatgtgaggacgcgctag

SEQ ID NO: 985 - DNA, 1004 bp, Homo sapiens
gctcttgcctgagtttcagagtcccgccggagttagagctggcagagtccaattgctcagagcgccgaggcgggggcggggcagggggacgcttgcaggtccggtggtcccgcgggctgcgagcccccacggccgaccctagctgcagaccctcctggagaacctcaggcctttcccccagaaacatccctaaaaggcgttccctttgttcattcattcaacaaatatttgttcaatctcatatgcccttctgtcttgggaaaaccaattagggcctctgcagcctcaacacaggggcactgttcccgcctattaatgacgcaatgaacccgggaagacgaatctcgaccactgtttcgcaaataccgcgtgtgatttattaaatgccgtctctccgagtcccaagcggccgggagcattatgccacctcccttgccctcatctctcactgccatgcaagaaagcgttaatggcaaatagggcacgtagccacactccgtcgttcctgcttccaagcaaaccttgtgccaggttcctcatttcgcgaggctccactctcttgggcttcaggctgccgctgggcctccagcaccaaagggcaataggggtctgagagtccgggcctcaggcatcttcaggccgcaggtgggtggagaatagcgcccgcgcgtggcagcggcccaggccgtctcagccggatttttccatccccggggtaggcttggtcccctgtacactccagcggaactacaactcccagcaccgtggctgcccggactcccggaagccgaatcccggctgggaggaagcagctgagacccggccaacagactgggggttaatttagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacggtgagtttgcttttg

SEQ ID NO: 986 - DNA, 1079 bp, Homo sapiens
cgtgtcatgtgccagatagtctcccgtggtttaaggactttcaagactcttaacaggttaggaaaatccagaagaaaggcagaattgggtccctcgggcttgcctgacaccagggacggtggagttgaggtgacatttcactggcatggagacctgaaaccaaaagcaggatgagccgggcacggtggctcacgcttgtaatcccagcactttgtaaggccgaagcgggcggatcacgagatcaggagctcgagaccagcctggccaaaacagtgaaacccccgtctctactaaaaatagaaaaaaaattagccggacgtggtggcgggcacctgtaatcccagttactcaggaggctgaggcaggaaaatcgcttgaacctgggaggcggaggttgcagtgagccgagatcgtgccactgcactccagcctgggcgacagagcttgactccatctcaaaaaaaaaaaaaaaaaaaaaaggcaggctgaatcactcgcccggtagtgacggaggaggccgtaaaagcctcttagaggccagaccccgcagtggcctctgtgtccttcattccgccacccatccgtccaccgagcgcctgctgggtgccaggaactgggtcacagaaaggctgaggtcaactcccgaccgagaagcctggcgctgggaccaagtggcaaaacgactccgaatgcagcggcatccacgcggcggccgtggttgaggaacagaagctgagagcggcaagggcggtcacagaggaaggaagttcagggttagccaacaggagccgcaggtgccccgaaaagggggcggggtcaggggtgccctgaactccgaatgcgaagttctgtcttgtcatagccaagcacgctgcttcttggattgacctggcaggatggcgccaccaccagctagagtacatctaggtgcgttcctggcagtgactccgaatcccgggagcgcagcgagtgggacagaggcagccgcggccacacccagcaaagtgtggggctcttccgcggggaggattgaaccacgaggcgggggccgaggagcgctccctacctccatgggacag

SEQ ID NO: 987 - DNA, 903 bp, Homo sapiens
atagacatgaaatgcgtgagccttggaacaccttctccctctcctgccccacgtgagctggagcttacatgccttcttgttttcagtactgccgtaaccctgatggtgatgtaggtggtccctggtgctacacgacaaatccaagaaaactttacgactactgtgatgtccctcagtgtggtaggttgccttctttttggtaaggaaactgcttacttaatatggatttgcaacaaaaaaggaaaagggcttctgagcagactgcttctggggaggagatagctgccctctccatcagaccccactcttcatcatgggcatcttgaatctgccctactattggccacatttgttagaggaacacctgcccatcgccccaggcacacataaataaaataaatgtaaaattcccaaagagcaagcttagaggtaatctagtcagccccaggatggtcccactgaatgctgccatgtctagcgtgggatgcatgaaaaatttagagtcattcggatgaaaaactttccctttccacagctgagaagtaagaaagaaaatacaaacagcaggaaacaggtaagcatgtaacgcacattgtaaacctcagatggccatcctaggaattcaatgaaaggtagtgcagctctttagccccagatggcctttcttataagtttactactcacaagtcacattagtgacatagcttagagactgcttgttgggttccatcctcattgctctgagactcttgttgggagtatgaggcttggatcaggggaaggggagttgacattagttcttaaagaattggaataacaaatccatgggtatttctgaaaaaaaaaaaaaaaaaaagaaaggaagctacttggaattgtcccatatttaacattctgctgacc

SEQ ID NO: 988 - DNA, 1083 bp, Homo sapiens
ctgagtattctggcccttaaccagttagaactccccagttatctgtcctgctgatggggttgaaatctacattcctgaccctggcccaccaaagcccctcccttagctcccatctccctcctctctccctgtcttctcctctgctccagacactctggcttcatttctgcgttttttgtaccccataagctccttcccaccccggggcctttgcctttgctgttccccctgcggggaatgccggatctctgctcagatatcctcttctcagatcagcaagctaaagcagccacctgtgtctgcctaacccaccaccgtagtttaactttctgcctagtctttatcactagctgatatttctcaggatcctttagttacttctttttcgtcttcccctcctagaatgtaaactcttcccctcctagaaggtaaacaaaagacctgttctgttttgttcttcggcccatcccaagcctagcgtagtgcctggtatgtggtggtgtccaaacccaagcgtggagtgaatgagggatgaatccatgagagagtgagcggctccagtgggtatgcgcgagtgtctcactcggtgtagatgtgtgtgttgtgtgtgttgtgtgtgtgcgcacgctggggaggccagacaagtgtggaccagtgattggggcacctcttccctgcaaagaggccaggggaagacagtgcgtgtggggtcttctaccagggaggatggcttgctggtgtgtcccccccaggggaggactaccaacgaaggggacccgggagatggcgggtgggggcccccgggaggacagtgggcgagggagggggtccttgccaggcctggggcggccgggggcggtcctgggctcccctccgtcccgcctccaggcctcggggcctggctggccgacgtggcgttggcggcgctgcgcgcgggagggcagggcaggagggacagaggcgggggcgggccggaaagtttgtccggcggcagcggcgttggggactccggcgggggatgcgcgcccggcccctcagcgcccccagcacgccgccgagtcccgctcgccatgggtaagtccc

SEQ ID NO: 989 - DNA, 921 bp, Homo sapiens
taccggcataaggaaaatttctgagaatattcagagtgaaaaaagctcgcagtgcaggggaaatgctaaaagctaacaagaactgtttcaagtgctttatatttaataattcatttatttcccacaaaactttttgaggtgggtaccattattctcatcatcacgggcagaactgggattctaactcggagtctggcttcagcacctgcgctcttcaccacctatacttactcttgatgattataatgacttctaataatggttaacatttacgaggtaccgggccctgtgctaaactttttatttatcgccgcttcggttaatacggataaccattatcagccatcttgcagatggaaaaactaagtcttgtcagcacgtccggcttccaggcacccgcctttaacacgtgcgataccatctggcttccagaaaagcccaacagaagtgagatgaggccgactgcctggattagttcatcgggaagcgggtgagggtaaaagcctttctcgtttccgcattttaatgacgcagaaaggtacctgtggggattatcccatctcagggcagatgaggaagccaaggttcggggcgcggagccccagaggagaacgccgaccgcggcccggacttagagattaggccgcaggggagcggggcctcgagagactacgaccattgctccacttactcaccgagaagccgtcgccgcccgtagttttcgactttcccgccaggcccgacgccgctctgacgccaccgaggcgcgccatgacgtgacgccaacttccgcgccggaagtggaaggccgggcagcccagctgaaggcaataagctgggctcaccgctgcagcagagttctgtgctagccgggcataggggcgagagaaggcccagaggcgacgtcagagagaagcaact

SEQ ID NO: 990 - DNA, 1041 bp, Homo sapiens
gtagagagcttcggcctgacctagcgcaggtctggtgcgcgcagagaacaactccaagcgcaccgacgcccgcgagctccttccaaacaccgaacgggatccagagcccgagcccacaggcggcggccgggggagggagcagggtgctggccgccgcccgggagtgttcgcgtcctgggtgacccctggaaggacgtggggcccaaactccggctggggttgggagagcagcccccagaggctctccgcgggatcctctgccgggcgggaccgtggctccacaggagaagtgggtggcaagccctgcttggcggaaagcagccgttcccctcctcctgggcctggggcggcgcccctcacccctgttccccgcccctcacccctgttccccgccggccacatcccctgccccttggattccaagcgccccgcgcgccgaggagcccagcgctagtggcggcggccaggagagacccgggtgtcaggaaagatgggccgtctgggggacagcagggagtccgggggaaacgcaggcgtcgggcacagagtcggcaccggcgtccccagctctgccgaagatcgcggtcgggtctggcccgcgggaggggccctggcgccggacctgcttcggccctgcgtgggcggcctcgccgggctctgcaggagcgacgcgcgccaaaaggcggcgggaaggaggcggggcagagcgcgcccgggaccccgacttggacgcggccagctggagaggcggagcgccgggaggagaccttggccccgccgcgactcggtggcccgcgctgccttcccgcgcgccgggctaaaaaggcgctaacgcccgcggccgcctactccccgcggcgcctcccctccccgcgcccatataacccgcctaggggccgggcagcccgccctgcctccccgcccgcgcacccgcccggaggctcgcgcgcccgcgaaggggacgcagcgaaaccggggcccgcgccaggccagccgggacggacgccgatgcccggggctgcgacggctgcaggtaggagg

SEQ ID NO: 991 - DNA, 978 bp, Homo sapiens
caaaaccacgttaaaagagctgcccctcccccacaggcccgaccacccgccgggagtttgccaggaagaggggcaattctgaatgggagtcgccaacgccccactgagtgaagcctgtctcggaaccgctcgcccagaccctggaggctccagacagccagctcccggaccccgcgcgcaaacgctgcggcgaaggaggggacccgggtaccgccagagccccgcagcggcagcagcagcgcggactccccggtcgctgcctctcccagcccggcggcctgggccgtcaatcaagctggccctgccccgccctcgggctgcagggggcggccaatcagagctaagctccgcagcgatgagctcagccggctggtttcccattggacggctatattaagaaagtggccggactctttaaatagcgggcgctagggccgcagccctcatctgccaccgcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgag

SEQ ID NO: 992 - DNA, 1033 bp, Homo sapiens
ccacggtacccttgtacttcttggatgtggccaccttcaccttggagtagctgccctctccaattgtgcggcccagcttataaccgagttcgctcagaagtttgtctcccgacatggtggcgcctagggcgcacggggggcaggaggcggctgctgtcggggggcggccggactccaatctcgggtctaagccatggcgcttggcacctacacccccgcacccccatgtgcccactgccagacattggccgctgttgtgccttttattgccccgtaacaatttttgccttgtgaagtgactgcgggcgtcactccgccttagggtgggggtccgggaccccgccccggggccaccctagcctccctgctttgtgactcataatcatcctgaatggtcagtttccgatgagaggccactagcaagggatacccatcaccaccagggagcagaatccgttccagggattggggtgagtccgacttcgagcagcagctgccccccaacatcatgtacccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcgagggcctataatgcaagaaccaaggcgagtcacgccctgtctgggcaaaagaggagtaaagacccctcagctgcagcccggcagcgcattcctacccagggtccgccgccagagctttcccgcgcggtcggatagttacactactgtccgggacttcctagccgtgccgcggaccatctcaagtgcttccgccacactcatcatggcggtggcagtaagtcacttccgcccgggaccggaagtgtgggatactgcgagtatggcggcgtcaaaggtgaagcaggacatgcctccgccggggggctatgggcccatcgactacaaacggaacttgccgcgtcgaggactgtcgggtcagtatcactc

SEQ ID NO: 993 - DNA, 828 bp, Homo sapiens
gactttgtaagcacgcaaggtttaaactgttcaggtaaagaccaggaagccctccagctgctctgtccagaccgaggccggctctccaagtccgcgctggggacgatgggaggtgtgcacctgcgacagaacacaggtaccgccaggtccgggtagcggtggcttttcgccgaggtcccccgcctccgcatacttcttgccctcgctgcttccccggccgcctctcctggccccactcctcgcccggcgctcgccgctacaactcccgcctgggctggcgcgagacccgcgagcgccggagtgggcgcgcgggatgcgcgcgggccggcgcccggagctctgggcatgctcagtcgcgcgggcagggctccgggcgcgagctgggctccttctgcaccacattcagcggctgccaagaggagccgacgggcgctcgcaggctcagcgcgcgctgcccgcggcaggacccggccgcctccgccgccgccgccgcccctaagcctcccgaagccatggccgggctcggccaccccgccgccttcggccgggccacccacgccgtggtgcgggcgctacccgagtcgctcggccagcacgcgctgagaagcgccaagggcgaggaggtggacgtcgcccgcgcggaacggcagcaccagctctacgtgggcgtgctgggcagcaagctggggctgcaggtggtggagctgccggccgacgagagccttccggactgcgtcttcgtggaggacgtggccgtggtgtgcgaggagacggccctcatcacccgacccggggcgccgagccggaggaaggaggtaactgccgact

SEQ ID NO: 994 - DNA, 918 bp, Homo sapiens
gtcgaggttgggctactctatgatcacatcttgagaccatccagagctccacacagagataagcaatgcttagaaaggaaacaaaactttgcccaagagccagaaacctatcttcaacaaccaattgtgctataaagtaacttagttcagttcactggaatattacttaatttcctctgctttttctttttaaacaagaaagtgttgactcagccaacagcactgggaaccagactccctggggcctgcctgcccctgctcttctcccaaattctcttctttttttgtccctgttgatggaattcaataaagggatctctaccatctgtcacttgtttttttttgttgtttgtttgtttgttttttttttttttggcagagtctcactctgtcgcccaggctgcagtgcagtggtgccatctcagctcactgcaacctccacctcccaggttcaagtgattctcctgcctcaccctcaggagtagctgggattacagttgcctgccaccatgcccggccaatttttgtgtttttagtagagacagggtttctccatgttggccaggctgatcttgaactcctgacctcaagggatccgcccacctcggtctcccagagtgctgtgatcacaggcatgagccaccacgcccagtgccagattatctttcttcactgtctaatttcattcctatgagtattagtttacttttcctttgttgggtcaaaagtgctgcttctgttcccaaccacagaattctctggaattgttttcagggccgtctcagtctcataaaaggggatcaggcaggaggagtttgggagaaacctgagaagggcctgatttgcagcatcatgatgggcctctccttggcctctgctgtgctcctggcctccctcctgagtctccaccttggaact

SEQ ID NO: 995 - DNA, 995 bp, Homo sapiens
ggaacaatgctttctggtccttatttcacatctaaaatagagaggtcaattgatttattcctaaatatctttgaacactaaaatagaagttttacagcatatatactacctggttgctctagacttaagccagggaaaagtacagattcaacatttaaaattgagatagacgctttccacttaatgctaccagtcttgctttatttcatgagaatgagaatataataatatggcatacgttcatttgggggaaagattgatgtcttataacataatttataattacagaaaacatgtgagttcactgggaataaataaattttgaagataataagatactttcacttatgtcgtaatttctatgtcatttggtgtaggatgtagagatattaacgtttacacctaacttaagtttgtcatctaagacctgaaggggttttgtctatcagctgcacccctgggtagagacacaaccttggggaaggcctcagccccatccctcgtacagcaggaatgagaacagccctgcctgttgggaagcttgagggaggctatggacgtgcagcgcttggcagagggtctcgtcatggaaggttccagcaaatgtgagatacttttatgatttcattttctccaaaagaaagggaataagagaagaggggaggaaataagactaattgcgagagataaagtacaagggtgagggaaggaataaggagacatgacggcagcgtggagcagccgaggggggagattgctttcaccacttcccagcatctattgcagattccaccctcaaacatgttgtaaggactctttattcaaggtaatgtttgaaccctgctgagccagtggcatgggtctctgagagaatcattaacttaatttgactatctggtttgtggatgcgtttactctcatgtaagtcaacaacatcctgggattgggacccactttctgggcactgctggccagtcccaaaatggaacataagg

SEQ ID NO: 996 - DNA, 913 bp, Homo sapiens
agcggctctgattgtgtgttcgggcccgcccgggctgaggggtttggggtccagtggcgaggacagccccacggctaaactgcctttcactgcgctgacccttcgtctgccccttgtgaaaaccaggccgcggaggaccctccgcgcctggctgggccagggcctcggggcgcgcgcgcccgaggagggggagggggagggacatggcgcgcgctcccgagctctcataaggtgcctccgccgcgcgctcccgagcctgcaggagttagggcacgtcccggcgcgcacccctgagccctcgaggtggtctcacgcccggggtgggggtgccgagccctcaggaggcgcgcgccccggggccctcaggagggtgtcccggctcccgatcccctcaggaggggtgcccgcggcacgcatccccgagccaggagggggtgcccggagccctgggggcagggtctcggtgcgccccccggagccgggggtgagggtcccgatccctcaggacgggagtcccggcgcgcgccctcgagccaggagggggtgtccgaatctcttagggggagtccgatccctcaggagggattcccggcgcgcgttcctaagccctcaggagtagccgggcgcggcggcggttgggctcgggcacgcgggcggggcggggcggggcgcgcgaggaggacggggcggaggccgcgcggaccggggcgggcggagcggagctcggcgggcggcggcgctcggggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaac

SEQ ID NO: 997 - DNA, 936 bp, Homo sapiens
ccactcactccctagctgtgttcccgccgccgccccggctagtctccggcgctggcgcctatggtcggcctccgacagcgctccggagggaccgggggagctcccaggcgcccgggtgagtagccaggcgcggctccccggtccccccgacccccggcgccagcttttgctttcccagccagggcgcggtggggtttgtccgggcagtgcctcgagcaactgggaaggccaaggcggagggaaacttggcttcggggagaagtgcgatcgcagccgggaggcttccccagccccgcgggccgggtgagaacaggtggcgccggcccgaccaggcgctttgtgtcggggcgcgaggatctggagcgaactgctgcgcctcggtgggccgctcccttccctcccttgctcccccgggcggccgcacgccgggtcggccgggtaacggagagggagtcgccaggaatgtggctctggggactgcctcgctcggggaaggggagagggtggccacggtgttaggagaggcgcgggagccgagaggtggcgcgggggtgccaccgttgccgcaggctggagagagattgctcccagtgaggcgcgtaccgtctgggcgagggcttcattcttccgcggcgtccctggaggtgggaaagctgggtgggcatgtgtgcagagaaaggggaggcggggaggccagtcacttccggagccggttctgatcccaacagaccgcccagcgtttggggacgccgacctcggggtgccgtggtgcccggccccacgcgcgcgcggggctgaggggtcgggggcgtccctggccgcccagctttaacaaagggtgctcctctccaccccgcgaggaggggcagctccggagacccggtcttcagcgagcggggtcttagcgccggggaggtctacttccttttggggttg

SEQ ID NO: 998 - DNA, 948 bp, Homo sapiens
ctcagttgttcggaatctgctcttgaatgtaggacgggggtaaatttgcatttcttccggagttagttacacctctcccccgtttgccatgaaacccatgaaaagtgaaacacgactgtggtccaccgtccgaggtgagagactcagtgcaaaccttttggtgcctgatcgaatctgtgagcatcagcttatcgaagttgtgcaggcaccaacatcttcgccgttcagtatttccacaccgcgataaccctgcccatcttgcggccagcatcttatctcgggtgttacctggtgtcgcgttctaacagggaaccggacaccggggctggcccagagcccggcgggcggacgcgcaggccagggaccccctggtaccaggcgccctgcccggagtcagggaggccacgccgctgcgctccttggagcgtcgggggctgtgcgctcctgccgctcccccttctccctcctctccccacttcttcctcctctcctcccttctccccccttctccctcctctcccgggccagcgccgcgctttgttgtcgttgagactctcgggagggaggaggagcccagcggggacagcagcgggagcccgccgagtcccggcccacggcgcgcgcccggacacccacgcccgcagccccgcggagccgggccgcgcaggcgcgcgcgagctcacacacgcgcactcacacacgcacgcccgccgcgcgcccggcccgccgcccagcccgccgcccagccctccccctgggcggggacccgcccgccgtcagcctaggttgaggcgccctgcgtgtgtctataactttgtgctgctgccgcggccgccctgctcgtggaagggaggaggaggaatgtggaaggtggcggcgcgcgagctgacaggcggttcctcgggcgggctgcggcgacggcccgagcgcttctccttcgccgaggtt

SEQ ID NO: 999 - DNA, 990 bp, Homo sapiens
cccccaccctattgtaactaagcactgcattctcacctctctattcaggtggtccgcagagcccatgtctgattgatctctatgtctccagcagccagcaaggaagcacctctttagagacctgcacctatacaatacctaccaccttttatttctcgatatgtgaactccattgagaacaaacgagtaaatgtaggtaatgtgccttcttcttttcttttcttttctttttttttttagatggagtctcgctctgttgcccaggctggagtttagtggcacaatctcggctcactgtaacctccgcctcccaggttcaagcgattctgccgcctcagcctaccaagtagttgggattacaggtgcccaccaccacgcccagctaattttttttgtatttttagtagaggtggggtttcatgatgttggctaggatggttttcaactcctgacctcaagtgatccacccacctcggcctcccaaagtgctaggattacaggtgtgagccacagcgcccagccagtaatgtgccttcttaagttctgtgagccattctaacaaattatcagaacagaggaaggggttataaacatccccccacccccgatttatagccagtcagtcagaagtacaggtggccacctgggacttggattggtgtctgaagtgaggacagttttgggagagtgagccctttaacttgtgggatctgacactaactccaggtagacagcgtcggagctgaattgaattgtgagatacccagtggtgtccccagagaactggagaattgcttgatatggaaaagacccacacatttgatgccagaagtactgcataagtcgagaattgagtttgacttaatcatcatatttgggcttgattgcgtggctgaaactcttcccacttcagtaattgtttctttcattttcatgaaactctgaagaaggaagggctggacattcagattccttgacccttgacatttg

SEQ ID NO: 1000 - DNA, 1050 bp, Homo sapiens
aagtgctcaggcagctgtaattctccaggacatcagataaaaggtaaaaaacagatgggagacgcgcctagacagggtattgaataccagcccgaggggcttgggtttcatccaaacagcaaggcaactgagctcaacacagtgagactcggtctccacaaacatttttttaaaaattggccgggcctagcggcgcgcgccgatagtcccagctatttctgcaggctgaggcgagaggatcatttgagctcggggaggtccaggcggcagtgagccaagatcctgccactgcactacagtctgggcaacagagcgagaccctgtctttaaaaaagtaaaaaaaaaaaaaaaaaaaaaagaaagaaaaagaaaaaagagagaagggcaagtcgctcccttctctgggccttggcataaatcaagcacaaatcaaagtctcactccctcctcctgccgcgcaacggcgcggagagccagccagccagccagcggaaccacggcctggtaacccaaaacctgcacaccctccagctccccacaggacgtcacgtattaccaccgacgcacgcgcagaagccttcccggggactcaagaaagggcaggcttagcctcctccccatgtcgcccctcattggctagaaactactgctcgtctcggtcgttgttagcagcgaccagggcgggtacaatcttggtcgctaggacacggctaacttccgctttcttccccctctcctaggctcaaactagtcaaatcttgttcactcgaccaatggcaaatcggaagtgggcgggacttcacaagtccggaccaaagaaacgcgagcttagccctgggtagcgcggccaatggccgtggagcagcccctgtaaactggctcgggcgcccccacgcccgcccttccttcttctcccagcattgccccccccacgtttcagcacagcgctggccgcagtctgacaggaaagggacggagccaagatggcggcggccgacggcgacgactcgctgtaccccatcgcggtgctcatagacgaactccgcaatg

SEQ ID NO: 1001 - DNA, 948 bp, Homo sapiens
cctggcctcacacttgatttttaatctccatgagagcaagcactaggtcttgcctgggcctttatcaatagcagtgagcatagcacctggcacagaggtagttctgaacattaattattgaatgaaataaaataatgaatgtaggctgggcgcggtggctcacgcctgtaatcccagcactttgggaggccgaggcaggcggatcatgaggtcaagagatcaagatcatcctggcctacatggtggaaccccgtctctactaaaatacaaaaattagctgggcatggtggcactcgcctgttgtctcagctactggggaggctgaggtaggagaatcacttgaacccaggaggaggaggttccagtgagccgagatcatgctgctgcactccagcctggcgacagagcaagcctctgtctcaaaaataaataaataaataaattttaaaaataatgaacgcaggcccaagaagagttgtgggaaatggggtgatatttttgcatagacttctaaggctaagaaggaaaacaaacagacgtggtgggcacaaatctacccccaccccaactgggtcccaactctaggctctctggcctggcaccaccactgaaaggccccgttccccaaacctcagggtattcttagtccctcctgttcccagcgctgccaatcccccgcccacccccactttagttgcgtgttccagcctctccgccccgcccctccccgccctgaaacggacgtgctttttagaggagtccactgggcttggagtcagtggcaataaccaggggcaataaccaggcgtgtcccaggggggagccccgctctgcagccctgtgcgccgtagagagctggacttaggctggcagcatggccgagttcagggtcagggtgtccaccggagaagccttcggggctggcacatgggacaaagtgtctgtcag

SEQ ID NO: 1002 - DNA, 908 bp, Homo sapiens
ttgacaggtaaggaaactgaggcaggagaggcgaagcaactcgcccaaggaatgggctgtgccggtagcttctccaaggcctggtgcgccctggcctgtgcgcgtgatcccgggcggggtctcagtacgaacaggggcttcgcgatgtggccagcgcgggcttatctccgtgccgtgacgacaaggctagaagcctgggcggccgcggtggatcctcgtggcgaggcggggagggcgccgggcctcactggcccgctcgaaccagggctgcgcagggcagagcccaagggagagggccgcgcggccgccgtaacgtcggagacgacgcctggcaggcgccagcaaacgcagaagacccgcgagggcgaggcagggagggcgcgacgcgacaacgaccacgtgccccgcccgcccaggcgcgcggcctgccgggagacgcagtccaaacctttcgggagcaggactaggggtcccagagagcctcgcggcgcgcatgcgagccccggccccctctcgcgcagcctgccgggacttgtagtccaacgccagcaggcttccgggcccggagtgggcggtgggactcggggtcccagagagccgtgcgcgggccgcgacgccgagcaccgccctcgccgtcgcctccgggctttctccggtcgctgccgccaccaccgttgcttcgcgggctgggaggcccggggtccccgggcgaacagaggctgcgggtgggagccttcgcgggcgctgcagagcgggccgggggaggccgggatggagccccgcggaggtgggcgcgctgccgggcggggcgcttgcggcgattggggagggggcagagggaggggcccggggcggggctcggtggcggggacaccggggcgggggcaccgggaggaagctgccttgga

SEQ ID NO: 1003 - DNA, 904 bp, Homo sapiens
ccctttatgttgcctgggtttaaattctagctcatcacttatgcatgtgcctcagtttccctcctctgtaagatggggatgactgcagcacccacgtgatggggctgtggtcctgcttgaaaggggcttggcacagcgcctggtgcatagcaagtacttggtgagggctggctgcctggttgcgtgtgagttttccatcctcctgtgcgggaggcaagagggacaccttctatcctcataatacaggcaggaaaactgaggttccaagcaagggaaaggacctgcccacggccgcctaatacgcagtggaaccaggactccaaggccacagacccagcgactcccaggccctgaacggtgacggaggtgcagggtcagtgatcccagtcacagaccagagcaggagggtcggggaggggaagcgccaggccaggccagggcctcctgcctccggttctgcccgggtggaaactctgaaacaggacggacttggccctgggcacctccaggctgtgagaactgaggtttttcagtctctctgagtctcagtcaagtggagatgaggaaaagataccaagaatgacaagcacctggcacagcccgcgcctcacagcgtggtcaatggatgattttttggaaagggtgggtgatgggaagggtgtgagtagaaagagccacgagattgcccgccatcccccacactgcctggaagcagagcccacaggccccagctggcccctccccggggacttggccaaagtgtcagacctggaagaatcgttgcatcactgggcactcacgggttaatgacagggagtggacaggacctgggtatttaactaattaggaggctccctgagatcagaggtggccctgctgctttcttctgctgccttttatgctc

SEQ ID NO: 1004 - DNA, 1095 bp, Homo sapiens
gccagttctgtgaccatcatctcagccttgaatttttttttttttttttttgagacaaagtctcactctgtcgcccatgctggagtgtagtggtgtgaactcaggtcactccaacctctgcctcctgggttcaagcgattcttgtgcctcagcctcccgagtagctgggactacaggcgcccaccaccaccacgcccggctaagttttctatttttagtagagatggagtttcgccacgttggccaggctggtctggaactcctgacctcaagtgatccaccagcctcggcctcccaaagtgctggcattacaggcgtgagccactgcacccggcctagccttgtgatattaacagtaactgtcatttgcggtgtgcctactctgtgtcacactccttgcagttattccatttagggtagagcaacattattctagtttacagatgagaaaactaaggccccagagattgatttgcccaagcagccagctggcagtggaagtgccagtttcttcgtgtgtaaaacaagagaaggcaatctactgcctactggcttgtcaagggtcacttgagatcggacgacaggaaccacaaagaagtgaggccgggaatttgcggatccacagtaaagcaagtttgtctttttccagacgtgcattaagattcctttttcaagtgttctaaagcgcaggcgcaggctgttttgcggttgcctcccggcgcctcttgtgcaggccggggtcgccctctgccgacccagggcgggagcgcgctgagtgaacgtttccaggcctgagggcgggcggagatttttctcgcctgtagagggcgcagatcggcgtgcagagtaacccactctagttgtcccttccttaagcacttcctgtttgatctctatgatccatcctgttgggacttgattcgttcctcaaattttcaatttaccgtaaacaaaggggacgcgcgctgacccggaagtgaaagctggaacccggccggagtagctctgagcgccggctgtgaggaaggaggttctgggcaagctatagccatggctgtggctgtagccatggcgggagccttaatcgggtcggag

SEQ ID NO: 1005 - DNA, 901 bp, Homo sapiens
gctcttcttttgcattgacttggcccttggcccgccccaaacttgaggtttgaactgttgaggtcagaacctaccatgaactccagcctggaggaaagatttctaggaaggccttgaagttcagttataacctgagtgatggtctcattagcattataaaagttccaggatggggttctgcagcactgggcccgggcagtggtccagatgctgacgagtggtgtagcgtcgggcaagtcttctcacctactgagcagactcagttacttcatctgtaaaatgggactaaacgtcccggttgcctcagcatcaaatgagatcgttcgaaagcaccttttaaacatcattaccgattacaaaaagcaaatgggaagtcggagccgacctcagagggctgacttggcacagcacttcaaatttctcgttttacaaagcacgaggcgcgagtttgtctcgctgtcaggacctgcttccctctcacctagcacccgccccgggcccgagagccgcggtgcggccgtgcgtacaggagggagggaggcggtgtggggtcccgggcagagctgctgagagccccggccccgcatctgactcgcgctctctcggcgggactccgggccagggcccccaggccggcgcgcagggcggggagcggctgcgggcgggaggacgggcggggcggcgggcggctacgcggcctgggcggagccgcccccgccctggccctcgcggttgccctgcccccgccagccccaggctccccgggcccgcgccgcgccgctctttctccgacagccgccgggggtgccctgcaagctgttccgcgcgtcctgcccgtctgtccccgcgggtcgtcgcccgccacagccgcgccatgaccacccagcagatagacctccag

SEQ ID NO: 1006 - DNA, 953 bp, Homo sapiens
ctgccctctgatctccaactctcccgctctgcagggacagtgtccctggaggtacggctcctggaggcctcccgtgccttcgaggtgtcagagaacggcaacctggtagtgagtggtaagcagggccggtggcacgggagctgcggaggctgtgcccgctggccatgccgcccgtcctcaggcccttccgcacctccctttccacagggaaggtgtaccagtgggatgaccctgaccccaggctcttcgaccacccggaaagccccacccccaaccccacggagcccctcttcctggcccaggctgaagtttacaaggagctgcgtctgcgtggctacgactacggccctcatttccagggcatcctggaggccagcctggaaggtgggtactgactacactgctgcccaagccaccggggagggcggtcgtcattgtggggaccacagagggcacccacagctaggcatgcagcttgggagggagcagaggggcccggtgggctctgggaggtggccccagggacctgggagttccacagcaccaaccaggccctgtgtgcaggtgactcggggaggctgctgtggaaggataactgggtgagcttcatggacaccatgctgcagatgtccatcctgggctcggccaagcacggcctgtacctgcccacccgtgtcaccgccatccacatcgaccctgccacccacaggcagaagctgtacacactgcaggacaaggcccaaggtagccccgccccagccccagcccagtgcccccacccaagtatgccgcactcacccagcctgtccccacagtggctgacgtggtggtgagcaggtggctgagggtcacagtggccggaggcgtccacatctccgggctccacactgagtcggccccgcggcggcagcaggagcagcaggtgcccatcctggagaagttttgcttcactc

SEQ ID NO: 1007 - DNA, 800 bp, Homo sapiens
gaagggagggaggaaagaaaatttccctgggggtaggagtctataagtttagcaaaatagtcgatctttcagtgtttccagcaacaacctaatcaagtttatcagtgtctgagaatgttcaaggtaccatcttgggttcaaacatgtaggcgaaaacatgcagctggccaggttacagagtggtgaaggcactctgcatttcttggttgagacagagaaaaaaagtggtcagaactgggtaaccctccccccaccatattatcacagtgatcccttttgtctttcttcaggctccagccccaccctacagcccctgctccctggattcactagagctaacttcagtaaagtacaaagaaaatggggccatatgactggccaaaaaaaaaatatctattcacgtggatgaccagatagtatgaatggattgaaaatttatcaggaaaaaaggatgagaggaaatgccaggagatgagggcagagagcaggccgttctgggggagggattctgtggggacagggtggcctactgggtgtgccccttttctcttctctgtctcccttagataagaccagcagttttgtcatcctctccctctcattccatggtcccgcagccccaggcccacactgaaagcatgtcgatccaggagaacatatcatccctgcagcttcggtcatgggtctctaagtcccaaagagacttagcaaagtccatcctgattggggctccaggaggtaagaaggggagacagaagccatggaacataggaggaaaatgagggtgaaaactaggagcc

SEQ ID NO: 1008 - DNA, 1006 bp, Homo sapiens
cctacctaccctaagcgagcaattccacgttggggagaagccagcagaggttgggaaagggtgggagtccaagggagcccctgcgcaaccccctcaggaataaaactccccagccagggtgtcgcaagggctgccgttgtgatccgcagggggtgaacgcaaccgcgacggctgatcgtctgtggctgggttggcgtttggagcaagagaaggaggagcaggagaaggagggagctggaggctggaagcgtttgcaagcggcggcggcagcaacgtggagtaaccaagcgggtcagcgcgcgcccgccagggtgtaggccacggagcgcagctcccagagcaggatccgcgccgcctcagcagcctctgcggcccctgcggcacccgaccgagtaccgagcgccctgcgaagcgcaccctcctccccgcggtgcgctgggctcgcccccagcgcgcgcacacgcacacacacacacacacacacacacgcacgcacacacgtgtgcgcttctctgctccggagctgctgctgctcctgctctcagcgccgcagtggaaggcaggaccgaaccgctccttctttaaatatataaatttcagcccaggtcagcctcggcggcccccctcaccgcgctcccggcgcccctcccgtcagttcgccagctgccagccccgggaccttttcatctcttcccttttggccggaggagccgagttcagatccgccactccgcacccgagactgacacactgaactccacttcctcctcttaaatttatttctacttaatagccactcgtctctttttttccccatctcattgctccaagaatttttttcttcttactcgccaaagtcagggttccctctgcccgtcccgtattaatatttccacttttggaactactggccttttctttttaaaggaattcaagcaggatacgtttttctgttgggcattgactagattgtttgcaaaagtttcgcatcaaaaacaacaacaac

SEQ ID NO: 1009 - DNA, 1078 bp, Homo sapiens
gctgacctgaagtttggtgatcttatgtcctgcttaggcgcagcgttggagaggttggcgctgcaatgccgtcaataacccccgatgaccattagagggcacactgattccacagcagtctgcaccgggggcccagctgtcaagtgctccaaaacccactccccaatttacgcctccagtggtcatctcccacagccttcattttaacaaccctcaacacaaaacagtcattttcttggggcgtccctgaggtgtgaacctcctccctcccagacacccacccactctccccatcttcctacaatttgggcgctaaagatttaattcctctctgacaccagatcattttttcacagctaatctgcacagtctggaaggtggcagggagggaaagagagggagatcatagaaggaatgggtaacaagcactctgggctcaccttcaactttaacggactttccagaaacccgtcaccttccaccccacacccaaacacacacatccacgcactcactcagtttcctgccaggatcccaaaccagcacacctttccctcttcccccgaggagaccaggtaggaggcgagggaaaaggtggggcgcaagtgggccccggttgcttccacacacaccctccgttcagccgtcctttccatcccggcgagggcgcaccttcagagggtcctgtcctccaaagaggtaggcgtggggcggccgagaccggggaagatggtccacggggaagcgcgcgggctgggcggcggggaggaaggagttaaagatcctggattggctcttctgtcactgagtctgggaggggaagcggctgggagggagggttcggagcttggctcgggtcctccacggttccctccggatagccggagacttgggccggccggacgccccttctggcacactccctggggcaggcgctcacgcacgctacaaacacacactcctctttcctccctcgcgcgccctctctcatccttcttcacgaagcgctcactcgcaccctttctctctctctctctctctctctaacacgcacgcacactcccagttgttcacactc

SEQ ID NO: 1010 - DNA, 1074 bp, Homo sapiens
ctctcatgccactcttgtgactgagagaacagaaaaaaaatagcagacctacgtgaggtccttaataattctccctgaggctgggctcagtggctcatgcctgtaatcccagcactttggaaggctgaggtgggcggatcgtttgagctcaggagttcaaggccagcctgggcaacataagaagaccttgtctctaccaaaactacaaaaacttagctgggcatggtggcgcatgtctgtggtcccagctacttgagaggctgaggtgggagaatcgctggaacctgggaggcggaggttgcagtgagctgagatcacgccagtgaactctagcctgggtggcagagtgagactctgactcaaagaaaaaaaaaaaaaaaaaagccagggacggtggctcacacctgtaatcctagcactttggaaggctgaggcgggtggatcacctgaggtcaggagttcgagaccagcctgaccaacatggtgaaaccctgtctcttctaaaaccacaaaaattagctgggtgtggtgtccggcgcctgtaatcccagctactcaagggaagctgaggtgggagaatcgcttgaacctgggaggcagaggttgcggtgagccaagatcgcagagccagggccacagagtaagactctgtctcaaaaaaaaaaaaattctccctggaagaggcgcagtcgcagttttgataatacactctaccacacacactagtgaaatgaggaaaacaagaggaaagcggaaagagagtgactgttttgtcaagagatccaggaagagacagcagaagtgaaaatctttttcatcagccaagtggctcctcggatttcttaatctccccccgaacttcctcttctccacccagaacagccattggtgagtggggcagggcaggagggaactgaagagtgagaaagcattatttcagcaaaaggtctttcctcccttgctctctcctccaaccactggctcagcctctccgcccgctgcctgtgaatgatgcaatggaaggtgtgctggggtcgccctgtgtcccgtgcataggagcatctcagcctccag

SEQ ID NO: 1011 - DNA, 993 bp, Homo sapiens
agactcggagtgtgcatttcttcgtgttgcaagcctggcctcacagtgccttcttcctttggttgtctgccaggggtagccctgcaccaggaggaagcttagaaatagcacaggtgggaaccggagagagagcactgttggggaagctgcggtcactcatcagccttcctggtgagaaaccaggggtttcctgctaattctggaaaggatgtttcagcagtgcctgcatgagacgcctcagatagaaaactggttatttttgtttcttagcactgccaccatagataacagctgtcacgatggacagtgtggacctggattagtccttcttgggaaaggagagtttgggttttgtaccgtggtggttctgggttctgggggaagagaatggaaccgtacgaggtaaaacaggagactctgaaggccacttggccatccaggcagaaagccagggatggagaggggcagcagggctgtgttcagtgctcccgccgtacgcttgtatgcgggaaaccactgcaggcggcccatgaagcctcctggccatgtgcgccctcccggtttggaccccctcccgtgtgtcttggctgcaggtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatct

SEQ ID NO: 1012 - DNA, 912 bp, Homo sapiens
gcattccggatcctaaggttaaaagaaaaccccttgccctcgggccagggctcacctgtctcgggagtggggaagaagcgcgactcccggccgctttggagtaggcgtcccagcaaaactctcgcctcatcaccagacactaccccgggcagaaggttcctaggctaggtcctcggacccgagagggagcgacacgctcgcttggtctcttgggtctccaggacgccgccgccgccgccacagtttcctcaggtgctacaaagcagccagggtgtgcgtgcgctcccgcctcgtcgcttagcaacctgagaagctgtccggtcgtcccaacttatcaattcccccgcccctccagagtgtcaatcgttttttaaaagattttgtttccgggtcgatccagctttacgcagcggaaggtctctttacctcccacgtttaccctcatgggaggatgcagtctcagtcacgcgcgtgggggtgatgtcgctaaggggtgattctcccctccctagagttacacacgctatctctcccgccaattgccgggctccatcaggcaggtcctttcctcctgagcccaaaccatccgtttgttgtcgtcctccaatcacaggggctcatcctcagggactactttgcaatcggcgcagagcgcagtgagaagagcttgaaaaaaacctctggtatcgggaagtgtagttcaacacttgaaggaaatgctttggagattgcgccacaaccagggcagcgtaaactacagttcccagagagcgccgcgtcgggagcggagccttttctcgctaacaccgctcgccctctccgagtcagttccgcggtagaggtgacctgactctctgaggctcattttgcagttgttgaaattgtccccgcagttttcaatcatggtgagtg

SEQ ID NO: 1013 - DNA, 964 bp, Homo sapiens
cacagaatccaaattgagtgcaggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggtaaagcagctccctggctgctctgatgccagggacggcgggagaggctcccctgggctggggggacaggggagaggcaggggcactccagggagcagaaaagaggggtgcaagggagaggaaatgcggagacagcagcccctgcaatttgggcaaaagggtgagtggatgagagagggcagagggagctggggggacaaggccgaaggccaggacccagtgatccccaaatcccactgcaccgacggaagaggctggaaaggcttttgaatgaagtgagtgggaaacagcggaggggcggtcatggggaggaaaggggagctaagctgctgggtcgggtctgagcagcaccccaagactggagcccgaggcaaggaggctcacgggagctgcttccaccaagggcagtcaggaaggcggccgccctgcagcccagccctggcccctgctccctcggctccctgctactttttcaaaatcagctggtgctgactgttaaggcaatttcccagcaccaccaaaccgctggcctcggcgccctggctgagggctgggatggaggacagctgggtccttctagccagcccccacccactctctttggctacgtgagtcaaggctgggcgaccaatgaggttgtggcctccggcaaacaatgaccactatttaggccggcaggtgtatagggcatgggggcccagctgccagtgctggagacaagggccgtccgagatgaaccctttctgctgcctgccaagccactgggaggggtaggtctcagcaggattcccag

SEQ ID NO: 1014 - DNA, 970 bp, Homo sapiens
actggatcgctgcttattttcagagatcacctcgcacccatgcacctggaaggcacccaaagagaatcattttaagaaattcacttcatctcaccctaacaacaaagcacagcctgcagcacatggatttcacccatgtgacatcaatgctaatcctatgtgtgaaacatctgggttcattcgattttttaaaaattagtaactgagatggggtctcgctatgttgtccaggctggttctccaacgcctgggctcaagccattctcccgcctcggcctccctcggcgctgagattataggcgggagccaccgcgtcagcctccactctttttgcggcgacaaagcccgcccgcctgcggggcgttccgttcgcagaaactctgtgagggacgccgcgggggcttccaagggacgcggcgaaaccaaaacagtcgccggtggttcacaaaaccacctcagaaaatgcttccaaaggcacgtctggcctccacaaggtgacggcttttcagcctccgactcgaacttgagtcgtccacagcactaggccgccgccagcccgggcgagctgcctagggaccgcggacgccgcagcaagcagctccctgctcccgccacacccgccgagccagccgcgcggaacccactcccccaccgtgggcccgcctcccgccgccagcctgcccacgattggtcgactgggctgcccgtcgcgagagaaggcggtgcctccggcaggccggcgctcccattggccgggatggcggcggcggcgcgcgcggccccggcgagcaggggaagccggtggccgcggctgcggaacgggcggaggctgccggtttcgtaaccgtcgctcctcctcgctgactcgcgggctgtgaggcctgggtcggctcgggccgcaccgcgcggggccgctcggagtggaggccgcctgggggcaggcgggctagaggagcaggtaaggaggctg

SEQ ID NO: 1015 - DNA, 1001 bp, Homo sapiens
cacaaacacaaacattcgagtcatgactgggtggggtggctcaagcctgtaatctcagcactttgggaggccaaggtgcgaggatcgcttgagtctgggagttcagagaccagcctgggcaacatagagagacctcatctccacataaaaagttttaaaaattaaccaggggcggtgtagtcccagctactcaggaggctgaggtgggaggcttcagcccgggaattccagactgcagtgagccatgattgggccactgcactccagcctgggcaacacagtgagaccctgtctcaaaaaaaaaaaaaaaaaaaacaggaaaaaacaaacaaacagaaaagcaggcctggcgcggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcgggggtgaggcgggaggcagacgggcgggaggagggcgagccccctcgccggcccgtccgggatccttcctac

SEQ ID NO: 1016 - DNA, 930 bp, Homo sapiens
acgtgatccaaacctgacaacttggtggcaggttctgtgagcattcatgatgttgtgaaaagggcttggggtctaggaggatggcagcagaggtttctgccctcaggtgtgagtgaggggcttttgaagtaggagagcaactagaaaaaaggagtggcacagggacagaaacttcttttctccattgtttgttcaaggccacgtgggtggagtcattgaggtggaggtttaactctgtgacataagtttccctgatttagtcaggctgtctgtcgttgggcttttcccacttccttctactacgtacttcttccctattcctcctactgaggccattaaacccttagttgtaattttccctgaacatgctttacattctgatgaattctgaaaaagaatgtggggtttccttgcagatgagttcatctgttgtttcatttcctttacaatgtaggttttcttctctgtctttttggattagtctgtttttggttctgtctaccaaggatccctttctttagacttctatagatccctttctatagaacttaatctacttaagtcagggagaccacccagaaggaaagagcccatactttcaatcttaggcataagttagcttgataagattttcagaaaaattcccttttaaccacagaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgg

SEQ ID NO: 1017 - DNA, 1010 bp, Homo sapiens
gaggtgggaaacaggaggtctatagagtggggagggccacaggagccaaggtatgcaattgtgaaagagcagaaggaaacagccaagggtggcttgggacaggatgtgggtaggaggagggcttctgtacccaactgcctggatttgaatcccgaggcctctacgtaccacctgtgtgaccttgggcaagttgtttgccctctctgtgcctcattcccctatgtataagatgggaataacaatactgtctacatcatagagccctgaacatcaaatgagttaatgtaattaagtacttaacaacagagcccagcacacagctgtgctcaatagatgcgggctgggactattattactattatctgtgaggatgtggggcagaggggcctaaggcctccttgaattatcaagaaggtcagtaggaggtcctctaagccatccctgcggcagacaggctccggctctgaggagcaccgggcagggacccaggaggctgcaaacctaagtgcagatccccaggctgggctggacaggctgaggtcagggcaggtgcagagaggcccagagctgcaacaccgcacttcatttattgcgtggctactgatttgcccgtgctgggcacacggacgtggtaaaggacagaagggctactcctggactgttctctgggcttctcaccctgcggttgtggtgagaggctgctgacagccagggcacccgggagtgggcgtggctggagaaggacccctgtccttttacagctaggcccactctgagccccacgcagtgttctagagcctgtccccccagggcaggatggtagtgggggcaggggtccctgagccattgcggcccttcccggcaggcgccaagcctaggggctgtggtcagcgtgaaaggcagggcatggaccctcactcagggctgcgtgtgcccgacgtgggtggggggggcgtggaatcggagcacaacttggccctgcgttcccaggaagggacccgaagacctcc

SEQ ID NO: 1018 - DNA, 1076 bp, Homo sapiens
aatggaagcagcatttgctagagggagtgggatctctaaagctctgttagagggttaggggtgggagacttttcaagacaatggattgtcaggtgttatgcaaatacagtgaggaaagtgtgggcccaacacgtacacaggttaatacatcaattattatttacaaaacactgtttttcctgccttatcatttcattattgtttccttcttaatgaagtgacggggggcgggaggggggaggaggggtgcagggacagtactggttgaactagagagagaatggagaggagggttcctggcttctgttgtggcgtcttttctatttgacttcatggttgtaagtatttccagatggtgaatcagacaccagacgtaacaatatttccatatttgggtatagcagtagcctgcgtttttaacatttttctgcctctgttatccaaccacaaagcattcttgacagcttcaaatgttgttaaatatagatttaacttctcttcccagagcaggaaattctttggaattccttgtttttcacgcaatctgtccatcatgatttaaaataaaagcacagtggatcatccaactggccgtatataccttaattggaggttggggatgggggacggcagagatccagtctgccgcactgcgttcaaacacacgccattccagagattcctttaaaatcacattaaagtttttttaacaagggtgtgtgggtttgtttctggacttcaactggggaatcttgaggatgagtttgccccagaagagaaatttagagaaccttaccgtcagctgcccatttaaagcagggggtgtgttgtgggatgggggtgggaagctggagcaacagggccaggaggtgtgggagcgggagacactagagtaacctatgtgcacagcctctccatataccatgtgctgttgcgcctgctagtaatcgacgacattaggcaagagaaacagcggctcctcaagtcctgcccaaagaccgtccagaaaccccagcctcccgtcgccttctcgccgcctccgctgggagccgcagatcagtccaagttgacggaca

SEQ ID NO: 1019 - DNA, 982 bp, Homo sapiens
ggacactaaacacatcctcccagccccatcttccccgcagagtcccgccaccggcccgacccctaacttgctccaaccacccgccgacgcccgcagcccgctgtttgggggccgccccctgcagcgccaggtccccgcgcggactacagttcccagcgtacatctcggtcggggggtccgaggggccgtcctgcctcagggataaggtccaggctgcgttcgcggctccgggcagtcacagtcatgcacgcagctcctatttttcgcgttgctaatcgcgtccgttgcagtccaacccatcctgggccgcggcccccacagggtctgtgaggagcgcttccccccgccccgggcgcccgctacgccgcgtccgaaggaggggccgaggccgggctcatctccccgggaggactccttcggcttcgtggggtgtcatgtccattgcggcccgaggctggccgcggggctctgctggagggcgctgagagccgggccccgaggccgcacggccggagactacaactcccaggaggcaccgcggcggcggcgcccacacgtcactcgggccccgccggtggcccggggaagcagcacgggcggggggcaggggctggggccgaccgggaggccggtgccaaggatgggggccgcccggctgccccgcgcgtgaggaggccgaggggcgcgccaccccggcccggggcggccgccccaggggccccgccacccccgcccggcccggcagtcgtggcccgggatgcggagccgggggccgccggtggagctgcgcggggtgagcggcgcggggaacggggactgcctgccgccctcgccctcgtcccccaccggcggaccccggcgggcattcgagagccgcgcggccaggccctcttagccctctgccgtttggggggcacgggtgaacctgccgccccactcccaccccgccccgccccgcccgtacagccaaatcggaagggac

SEQ ID NO: 1020 - DNA, 1057 bp, Homo sapiens
gaagaaagtggtgctggtgaagtatattccccggtaggggaaggctctcaggtgcaccagcagcagccatgagtgcctcaacaccagggagagcacagctgccactgacaccttctgccaccctggactctcagttccctgtgctactaaaggaactcagtgtgtggttgaccccaaagttgtcctgggttgactcaagaaggtaggatgagcattctgaggcaaagaattctcttttgtgattttattgactccaattttgcattctgactggcattccctgcatcccaaggaccttgacagcggagggaggcagagatggaggaagtgaaaactacccaaattcagtgtttgttacagacaattcagactgcaaaatttagggtagactatgttcatttatcactgataatgacagtcttaacattcccctacaacaggaagaccaagatttccccaaaaccggccagcatcttgcccatttgccagaaggagaaaaataagtcctggcaagagccaagataaggcccagaagcccctgggttcctttagccaaggtgagtggtttcaaattatgacaagttgcaggttctctgagaagcatctgtaataacctggcaaattaagcatcctctcctgggaggaggaatacagaactctgtaaccacccaatacctgtttccaggtcctgcccctcctggggcacagggcagccaccttgcaattctcatccctagaaaggagagaccagatcaacaaacagcagggctgggactgcccagggggttccgagattccttctcccctcctatcacctgccctccaggcacaccgtcctacttccccctacttccccaggggttgtcagggacagaaggcccctccttcatcccccctagtgttcctccactcttcctccgccccccattactagggtgtccaggacattgtgtgactcaggaaacagctcagacgtgaggcttgcagcaggccgaggaggaagaagaggggcagtgggagcagaggaggtggctcctgccccagtgagagctctgag

SEQ ID NO: 1021 - DNA, 981 bp, Homo sapiens
ctgcttcaggcttacaagagtgcgtgcgacatggccgaggcacgaggccgccaccaggagctttgcatccccctgtgtgtggtgccggccacgattagcaacaatgtcccaggcacagaaataagcctgggctccgacactggcctgaatgctgttgttgaggtaagagaaccccgtttcctctcattgcttttccgtcatttattttagcaacttgtttcttctgtgctaaggatgagccggatttattcttcttcttttctcccctttgttagcttggctttatgtcacactggccagaacagggtaaaatttttttagcttctctgccttagggagagcctgtctttattgattaaaagtgagatgatatatccagtccttgggatcgtgtttctatcccacctagactaggggagccgcaggtaccattgctctggaggctgcctctcctgcccacgctgagtagtgaggctgcagggccagctgtgggagcctgcaggaaggggtgtaaatgcccggtaagtacgagctccaggacagagccgtacccactgggggccgctgcctggaaaacagccttcctggtgagacaagaggctctttagagagccgaaatcacgccctcctgggcaggcggtttcaccaacatgtgccttgggaggggtggattctgccagtcgtgggtgtggtgctgacacccacatggtggcccctccggtccctgatactctgacctacctctatggtcataagctggacatgaagacctatggtagttccacaggcctttgctgcagagacggtcctcactcagctgcagacaggacggtggccaccgtgacatgtggggtcacgtccgtgacttggccacctggtgcgagggacccacagcaaagcagaactgctggccggggtaggcctgcatcgcgtgcggggacagcagccactggcctttaccttacatcttgacgtccaagc

SEQ ID NO: 1022 - DNA, 982 bp, Homo sapiens
gctcaccatactacacctcacccccaacaagaccaaaacctcttccaattcaatagcatagcaactgccaatagcaaggtatcttccatggcaatttgctgggtgattttggaagatttttgtttaactacctggacacacgtatacttgctatatactacaagtacagaattctcagtaagcggacttaccaaagtaggtgatctgtaggggagttaacaaaattcagtggtcctttcaggccactgacttcaagtggcaagagacaagggtctcttgttatcatgttatcttggcttccaaagctggttgaagtccagagattcataaagtcattcaagaaacctagaatgacctgcctgcaaggaagacaggaaggactttcagtttatagcaattcaaacatgaataacatttcctgattaatagtaataataattagaaaggattgactttcagaaatttttctcaaatcaaggctcctgttactttggttccaccttttctctctagaaggagaggaggagcatctcccagagggctgcgtgcctcagaaaagccggcatccctagcccgctctggcacaggccatgaggccctgctgaatcctgctgaatagctactcccttctagctggagccacagctccctccaccgcggagcagggttacaacgtccctctcggtagaggtgcacgcagctcctcctggccaccctccccaccagttcccattgtctggcccccctcccccaacctcttctttccacactgccccatgagttcagggaatttccccagcatcccaaagcttgagtttcctgtcagtggggagagatgagtgtagataaaaggagtgcagaaggcacgaggaagccacagtgctccggatcctccaatcttcgctcctccaatctccgctcctccacccagttcaggaacccgcgaccgctcgcagcgctctcttgaccactatgagcctcc

SEQ ID NO: 1023 - DNA, 922 bp, Homo sapiens
tcgagcctccaaattaatcaaaacacacagcacccagttaaagcccaggcagacaagcccaggagccagacgcgctctcctctggtgacccccgggccacaactccccagctgggcccgccaccaccccttgaatgccacgctccctccactgcccctcccaggcaggtgccggggccccgggacagcggttgccccacctatgggcgccttacctgtggggacgcccgcagcgccaggagctgccgccttgccaccccacgggacgcgcacctccagccccaatccacccgcgccccgctgcctcttcgcggcgctctcgcagccaagcccggcggccgcaagttggaggcgggctggaggcggggaacgcggaccgccgcgggcgcggggaacaagcggggcctcccgagtgcagacgcccggcgcgcctcccgcttaatctgggcagggccgctggccactccctccaccctgcgcagccacctccccaccgcgcagccacctccccaccgcacacccccaaacgccccacctccgaccgcaccccacttccccgcctgggcccccggaccttgggagcatcacctccttaaccccttaccctggatccgcgcccacctgcccctcaggcgcccagccctttctcgcctcctgggcacgatgcccgggtagaagggacactgcctggtaagttgggagggagggggtatgagggcgggacctgagccacgtcttccctcccttgaagccacaaccaaaaagcctgggtggggagggacgaaccgcgcgaccgagccctacaaaacccgccccggccgagtggcgaggcgagctttccagccgggctcccagagccgcgctgcgcaggagacgcggtggcctgagagcctgagggtccccggactcgcccaggctctgag

SEQ ID NO: 1024 - DNA, 923 bp, Homo sapiens
ccctttctgatgccacgtattaggctttcttactcagaattttgatagaaaaccatggggccaagagctctggaagcctggccggaaagaccaaggttcatgcagcccaacaaatgattgttgagcacctctcggagccaaagtccttaggcgagtgtggtgacttcctggaaggaggatgcagacttccagagagcccccccaacggacgtgctgagaagggagagggaggcgggggctgtagtcaggaaggagccagagaagaacagggtttgggtgcatccagaaatatgcctgcagtaggagggagaggaaggggtgccaccgtcaacggcttcccatcggaggtggttggtgcagatggaagtttctgtctgctggccctcaagagagtgttttgccagggacacagtctgttcctcctcagaaaacaccccccaaatgctaacaacatccccaccagctgctagaagcccctttcccctccccaccttgaagtagctcatagttctctgggcagagccagaccatccagtgtaccccagaggccagtaggttcctgcccattttcctctctggcttcctgccaagaattatggcagctgaggatgaatggagaagtaaaaacaactaacaccgcacaactaacaactaacaccgcagttcccacctgggttccacttagcaggagacatttcggagggttttttttgtttttgttcctgttttttttttttttgctggaatttgttttctcagtactgaaaagagaaaaagtgacaatcttgtatttttaaaagcctcggaaaggtgataccatctgacagtcattttctcacgttggtcttctaaagtcacctatttcttgtgtgtgcacatcacaccatttcctgtttctttataacccgacaagggtaggagtg

SEQ ID NO: 1025 - DNA, 1100 bp, Homo sapiens
atgccaattgcactcttcacttttatgtgcaaagtttggaaaatttcacaataaaatttttgtgtttacataaatgaaataacatgggaaaatgttctaaggtatggcaagtgaaaaaagcctggaaaataactagtttgtcccacttaagtttttaaaggtgttaaaagtacatgtttcaaaaagtaaggatagactaaaaaagtgaacggtggtaagttctaagttgtgggcttacaggtgttctttatttttatgctttgctgtattttccaagtttttttttttaagttttccaagatgttttacatctctgttcttatttaccagataaactttgtggttagttactggataaactgtaaatagtgataaaatttttaagtttatatcaagatagcacttcattttaaaaccagtaattattaggttggtgcaaaattaattgcagttgttgccattggaagtgatggtaaaaaccgcaattacttttgcaccaaccttatatttctaaaagatcaagttgtaaacctatttgttttccctaagatccgctcttgcagagttggaataaatatgattgtttacacttaagagtccaggactacagcaggcctggttggaggggagttactaatgttcccagacttaaatccagctggaacaccacctaaaatatgcagtaacataagaccatcaaaagcaatgtcccaggacttacaatgtttgctaagacgcaagagggtgtgacacagacgctaagcgccactggcgaggagatgaaggggtcgtcttcatcttcgccggatgatttccgcccacatagagggcgccagtgacgcccacacacgtgctggtgtcccgggaagagttcctggcaaagagctcaggaacgttggatcttaatcaaggctttctccgtcggggtggatgggttggactttaggctccagcaagccccgccccactcggcgggtcggtgccgccgggtcccaggtgcccgctacttcccagaacctccgcctcccgctccgggccctcgaaccagcgcggacaccacaatggaccgggcgtccgagctgctcttctacgtgaacggc

SEQ ID NO: 1026 - DNA, 1099 bp, Homo sapiens
cagagttccacaggaccatagtggcagaggcagcagtgaggacttcttttttatttatttgtttgtttgagacagagtctagctctgtcccccaggctgcagtgcagtggcgtgatctcagctcactgcaacctccgcctcccgggttcaagcgattctcctgcctcagcctcccgagtagctgggactacaggcgcatgccaccacgcccggctaaattttgtacttttttagtagagacagggttttaccttgttagccaggatggtctcaatctcctgacctcgtggtccgcccacctccgcctcccaaagtgctgggattacaggcgtgagccaccgcgcccggccggcaatgggggcttcttaaaaaagagggaggctgggcccggtggttcacgcctgtaatcccagcactttgggaggccgaggcgggcggatcacgaggtcaggagttcgagaccagcctgaccaacatggtgaaacaccgtctctactaaaaaatacaaaagttagccgggcgtggtggcgggcgcctgtaatcccagctactcgggaggctgaggcaggagaatcgcttgaacccgggaggtggaggttgcagtgagccgagatcgcgccactgcactccagcctgggcgaaagaccaagagtccgtctcaaaaaaagaaaagagggagtgtgggggtggggcccggagcgctccaaggggcggggaaggggactcccaggcccgaggactcctggaagggaggtgagtgtggcgctgaggaagcggcgggacggatgcgagcccgggaggagcgcgctggggggccgcaggcgggggatgtggcgcggtccaggcccgtcgcggcctcgtcctgacagggacacctgcgggatcgtccttccaggatcgcctgcgggcctcgcgggccgatgcctcgggtccccctccggcctcggtttctccgcgcagcggggcggggcgggggcagcgcgggtctcaaagctgcctgcagggggcgcccgtgagcggcgcggccggagccggagacccagcggccgccgagacagcgggagccggcgtgcgagcggcaggtcagccggggtgctag

SEQ ID NO: 1027 - DNA, 786 bp, Homo sapiens
gacaggttttctccatgttggtcaggctggtcttgaactcccgacctcaggtgatccacctgcctcagcctcccaaagtgctgggattacaggcttgagccaccgcgcccggcctgcaaagccatttctaactcttgggcccagaaaggatcaccaatttccctgtcattctccgttagactattcgctactgagacgatttttttttttttttgagacgaggtggaggggcgggggttctcgctatcttgctcaagctgatctcgaactcctgggttcgatcaatactcagacaatcttggcaggcgcaggaggaccaaattctagtgaatgagatcgagtctctcggctctttcccttccatgttttctttttgattggccctcgacgatcctcagtgacgcctcccgcaccgcctcacccgagagtcagccgccctcgcttttccgtgcgcacgcgcagtatcccgattggctctgccctagcggattgacgggcaggttagccaatggtctcgtaatataggtggagcgagccctcgaggatgtccacgacccggcctctcgctgaatattcatgagggaggcgggtcgaccccgctgcacagtccggccggcgccatgaagtgagaagggggctgggggtcgcgctcgctagcgggcgcggggggtcttgaagatggggtcatcggtgggcgcgcctgggtccccaagggggcgaggggagggtgaaggggtgggacgggggcagccgcagggagcagcagtgatagcgaggagacactga

SEQ ID NO: 1028 - DNA, 955 bp, Homo sapiens
ggggtagggacatgagtaaggactgcagtgagtgagacctgcggatagccattttatcattacaaatttccatatgaaccaaacctacatccaagcaccctcctgaatctcctccaacgccctgggcaagctcagagtttctctggacctggttcagaccccaccccccgatacctgcctggggctcccagcacgcgcacccccgccctcttctcatcagaggccacaaacctgcgcgctcctacaacaccccgcgcctgagaggcgggaaacgtggcgcctgcgaggcaagcccctaaggaagagacgggaacccccgaccccccagctcctaataccacccctgcccagacagccaggggtagggcgcagtctcaccaacaccagcctgcttgcggcaaaagatcaaatcaggatgatgtttagccatagctcctaactaagccggccaccggaagcttcgggaacttccgtccgacctttaacccccattgttcctgcctccacgtcgctgtgattggttctctaagcttccgtcagtttacaatccttgcaccaggcccgtcttgctctcgcgcgagtttttgtcgctgctgggcggccaggtcctggcaggtgcatgaaactcttaaaaactctcccagatttggatggcggagataactaaaatttgttcttgggtaaaacatctttgtgcttggtatctatttctgcaagtgtctttgggcagtccgatttcctcttgcgtgtctgttcgttgcacgtgagctccgcccattgcgttcacagggttctggcgcctctagggaggcctcgccttcaccgtgacgccccactcttccgggcacgcccctgcccaaaggctttaaaggcgccgtgtgggacgtcactttaatgcgacctcatctttgtcagtgcacaaaatggcgccctacagcctactggtgactcggct

SEQ ID NO: 1029 - DNA, 968 bp, Homo sapiens
gctgctttttccttctcttcctcccctgccctgccctgagctgcatggttcccctaccctgggaagccaggaaggaatctgaatggagaatcaccaaccaccaaagaaaaaaagactgcggggccctcccctgccaactccccttccctggccgcccactcacccacacctctttcacgcaggacaggctgcccaccctgtccacgtgaagtgccaacgccctccccaccctgggccgagcccccacccctccctgggcccccaagtgagattgcacatttaactactgtaaggagaggagcggcgttggcaaatgtgaaccatgagaatatcggtgatactgatgagaataaacgcctttgtaaaaaaaaaaaaaaaaaaaaaagtctggagccaggcgtggtggctcgcctgtaagccaagcactttaggaggccaaagcggcaggatcgcttgaggccaggagttggagagactagcctgggcaacatggcgaaacccgtctctactaaaaatagctgcgcatggtggctccgcctgtagttccagctaccggaaggctgaggcgggaggattagagactgaagctatagtgagccatgatcagaccactgcactcaagcctgggtaaggcagcaagaccctatatcaaaaaataaaaaaaggaaaaccacaatgattacgcaagtcgccgccctccctcctgcgattgttgctatttccatccagctactagtctcctcctcccgcccgacacctggcgcgtctatctgacgtcacgaacgcgccacacagattcgggctgcgcaacctctgtggccgtctacacggcgcgcagatgcgaatattctcgcggcgccggaagtccggggcacgtgacctggtgacagtgctgacttggctgtacagctcgatctaggttctgcggcacgggatggcggaggcgcctcctgtctcaggtattgtcc

SEQ ID NO: 1030 - DNA, 964 bp, Homo sapiens
ctctcaaccatcctgggattcccgggcccacccgacccagcggcgcgaccctggccctccgggaccctccgctgactccaccgcgcacttcccgggacccccacacacatcccagccctccggccgatccctccctactcggtgccgggtgccccccgccctctccaggcccggatctcctcccccaggtccccggggcggccccagccaggcccccttcgaaccccgccggcggcccgggctggggcgcaccatgcggctgcggctccggcttctggcgctgctgcttctgctgctggcaccgcccgcgcgcgccccgaagccctcggcgcaggacgtgagcctgggcgtggtgagcgcggggtccgcaggctcctggggtctgcagagagattgggagagggaagccgggcccggactcctgggtccggaggaggcaggggccagattccaatatccaaagagtgactgaggatggggtctgtgctcccggcttcttgggtctgtcgggaagtttggggctgggatttggagctctggaaaggagctgaggtgcggagctgaagtccagacaagactggcaaacccgggactgaagcggggacctatggaggggagcaggcaggcatccggggctggggccctgggctctgggtgcctgggaggggcagggctgccaggatggtggtgggcagagagagcccatacttttcacccagcccgcttcacctgccccctccgatgccctaggactggctgactcgctatggttacctgccgccaccccaccctgcccaggcccagctgcagagccctgagaagttgcgcgatgccatcaaagtcatgcagaggttcgcggggctgccggagaccggccgcatgggtaggtggcccccacccctccccagccctgcctctgcacccagcctgtccaccgcccaacagcctttagacctcagtgtgc

SEQ ID NO: 1031 - DNA, 989 bp, Homo sapiens
ggtgctggtctcgtaacttgacttttaggagctattgccagaacattgttctctggtctacttttcatttttaattttaaaacattccttgtttttaacctgatgatagaaaacagtttattagaatttggaaggaagaaacaaagtaattatcctctaaatgtcctacccaaacatctccagaaggagtggcaagcaggaaactgttgtgtggattttccacactactcattagaaacgcagccagcgatgtcctgccctgtgtaacctacggattcacgaagtgtcgtgggggccacagcgtttgatccgaggtgctctaggctcagcaggttatcactaaagactgtggggcgcaccgtacaatttctgaagcaatttgcatgaaaaccatgtggaatggtaaatagaataagtgtctcccctttaaggacgaggtgctcgagactgggagagtgcccgaatccagtccccagcatggcgcctcccagtcctctgtgtgcgtgtcctgttcccagtgacgcctcactggacattctcagtgcgtgggcgtgaaccccacagttggtggaaaatcaccgagttggaaggctgctcggagcagttggatttttccattccctgggaagacccacagtctctgggcattaagcacttagtgagtctggcactcacttgtttccgtgggagagatccagccgtggctgtcgacagcagctgccgactgtgcccaatagagaaggtatctgggaaagagcccagcacggggccggggagtgtgagtgtgtcctggcacaggcaggcagaaggtgtccaacgtgcaactggagagcgcagaggtggctcaagtccccttcctcgcaggagtctggaaggctactgcatagcgtttgccttagtagaaaatggaccatttttgaagcctaggtccctgcaggcctcctggctaactcggctgtcaaagccccttttctctgctttctgagctg

SEQ ID NO: 1032 - DNA, 900 bp, Homo sapiens
aaaattcccctggcaggactctcagatgctgctgagtagctctcagtcctctctgtaacccaaacataacacatctatctctgtgcttacactgggtggctttcacttgtttatctgtgaattgaagagaagttgcttgaggtcaggcagtgctcctcattggtaactgccttctctggggctaaccaaggacctagaacagaataagctattgaaaattgttgaggattaaaaaaatagaaaaaatagaaatggcaaatatctaggccagtcactggacatagagaatgttatttaattcttatcgcacgtccttgagacatgtattgctatttgcattttgtgtgaatatgaatttgggtaagtttatgtaatccctcctctgcagaactgggattcaaatgcaggtgtatctctgttcaggtccagactcttctgccctgaagcagtagtacttggatggaatgacgtagggttggacaagccacacagaggccacttcctctcacttacttttctttgcttcccactcaaccaggacagttcccacgcactttttcaagattcttatctgctcccacacttagggaagttcccaatgcaacctatcaatccatcaccaccacgaataccagccaggagaggtggggaaaggagtttaccacatggtcgctgggtgtgagcaactgttccctgtccctatggcttcccacttgtggctcccaccatggcctggagttttgggtggagtttttcaaataaaagccctcagcattgcaggacggcacagtggtgagctcttagcttcaccaggctcatcaaagctgctccaggaaggcccaagccagaccagaagacatgcagatcatcaccacagccctggtgtgcttgctgctagct

SEQ ID NO: 1033 - DNA, 1078 bp, Homo sapiens
cgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttcgcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtga

SEQ ID NO: 1034 - DNA, 907 bp, Homo sapiens
cgggcaagggtataggattttagaattccaagagttgtcgggggtcatcccgtggaatcctcttttttgcagatgctcttcctggagccttccgatgcaagctcttgggctcacgcagcccttttcctcttctaagcccagagcgctttcgctgctgctgatctccacggcctcggcagatagggaggggcaggcaggtgtcagcgtcctccctttcaccgttggggaaactgactcagagaaacaaggcgacgggcctcggcggggcgggaccgtaacgggaattcaaggctccaggccagagcggaatttattgtgtctcgttttgggaagcgtgaatgtgaaatgatcgacttcggagccccaggcggagacccttcagtccccgacaagaatcgggatggggtctgggattaatgcagtaattactcgcgcctgggcattgaccccttggcaacttcgcaagatccggcagggtccaccgcccttcccttcacagggtgaccacagggctgcggcctctttaaggcccagagctccgcccccggctcgtcgccaaccccctcgccgcagctcagccagttccagactttcctcagagatgaggtcatctccccgttgcccattggctgcgccgtgccgtcagtcacaggaagtcaggccgccgttttcgccttcttcatgccgcttccttctccgcccgccctttagtccgccgatcacgaccccgatcaggcctctgattggctagcgccgccgtcacttctccagcggacagtcttcaggacgggaggcgggcgtggtgggcgggcccgcagcttccgtggctgagaggagccggcggcggcagtgtctgtggtggccgcggcggcgagagcgacggtcccatctttcccaccctcttggt

SEQ ID NO: 1035 - DNA, 1000 bp, Homo sapiens
tcgaatgtggcttgcctatttataatctgacttataattctggacaaccaagctacgttgggctgtgttcctcggctgccacaaatcatcgtcacaggctgaaagctcaactgcttcgtgctctttattttttcatgcctatgccaacgttgccgatgtggtaaagctgtcatcacgccgccagaagggcggccttctttggcacgagcagcctaagaggtttccggctgctgcggcttgagctccgatttgatcagacgccacgaaagggatttagatcgtggccatttttcaactaagtgcgtctgccgaatttaatagcaaaccaaaagccacattttctaatctccagttaggcgtccaagaggaaaagtggcgcttgctggctgagggagcagcgtgtctgcaattacagccacgtcttgcctcctggtcttttcctcagtgtgggattgtctttttgttttttgcctggtctgagccggccccacagaaagaacagaccagacgagcttactgaggtaaaacgcaggggcggcggtgaggtctagggggtctactcagaacgaggcagagacaccagcgaaaagcgccgtatggcgaagctaactcaggcctgacaaaacacccaccctactctaccgcctctccggccaaggctgacgctacgggccagagggcggagccgtcacatcttcccgcgagaccagccacgcgacttcccagaaggccgcaggcaacatcttaatagcagccaggaagccggaccggagcggaagggtgggcggggcttgcccgcatatttagcggcacccgaggccacgccccagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggtaggcctcgcaatgtattcaagttactccaggggcag

SEQ ID NO: 1036 - DNA, 907 bp, Homo sapiens
ggcccagaagtcctttagaaaaaccttaaaaaatacagatcccctcaccatggcctatcgccctgaagccgaaatctagcttttaaatttcctgggggaaacagccttgactagaaacctccctcccgtgggtcagtcttacctgataggtaagaggcagcccagctccggcgcccccgcctccccccggcctcccactcggggctctgtagccgcagtgcccccccgtggccccccaccctcactcctgcgtcttcccgagctcgccccctcccgttttcccagactcccctcgtgctttcgggtagccacccaaacacccccgcctgcgcccgccgcggggattcctgcgggccgggggcgccccggttggcgcgcgtgtagggaggcgctgcgccggagctggcggccgcgcaggggcgctgtcctagcgctgcgccggggtcggcgcgggcgccgctgcagcacggctggggggcggagaggggcgggcgcggggcgggctcggcccggaatgtagagacccgggcgggagcctcccggcggcggctgcccggctgccgagcgcggaggctccgtcacgtgtttttctcctccgagtgagacggcggcgcggtcggagggggccggcgcgcagagccagacgccgccgcttgttttggttggggctctcggcaactctccgaggaggaggaggaggagggaggaggggagaagtaactgcagcggcagcgcctcccgaggaacaggcgtcttccccgaacccttcccaaacctcccccatcccctctcgcccttgtcccctcccctcctccccagccgcctggagcgaggggcagggatgagtctgtccctccggccggtccccagctgcagtggctgcccggtatcgtttcgcatggaaaag

SEQ ID NO: 1037 - DNA, 1077 bp, Homo sapiens
gacctccagcagttacacattcatatcaaccagcacaacacgggatggcgcccaaactccggcgttcacaagaggagacgtgacgtggtgggctgaggttaatcagggaaggtttcctgggggaggtgatccttgaactggctcccggggaacattcagagcatgattggtagacagaagggtgcagaggcgcccaggggagtacattgccccgtgcaaagcaggggcattggggactgtcttgagaccctgagggggtcaagcccctccttccccagctgcccctccttctagaacctctgcacatctagcctctggccctcctcttcactgcctccacctgctcccgcttgccatccctgtctcctccatcctggctgtgcagtaggaattccaggctcctccctgtgtctttgctgttcttcagactccatttatagagaatgagggctgataacaggaatacagtggcaaagactagactgtggaaagggttccagaaatcttttttcttttttaattaaaaaaaatatttgcagagatgagctcttgctatgttgcccaggctggtctcaaactcctgggctcaagcgatcctcccatctcagcctcccagagtgctgggattacaggtgtgagctactgcgcccagccccagaaatctcagtgctgtttggagctccatttctcatttgatgacttgctctgcgtggggaggtggggtctcattcccccaacttcctcagggaggacccctgccctccgctgctcctctgtcctgctagccttcctccaggaagcacactgggtgcagataatcaggacattccagagatccccaatttaagagggtcatttccatctcaggggactcccggatgggtgtttccgctctcaatagcccctcttgttttaccaggaaagatccagttaaatcacccactgaggtgacagctcattagcggggagagagatggagcatcgagtgacactgggccatccaggcggctctgctcccaccagacaggagctaggcctcactggcaggggggctgcccacagccttttcaggggctc

SEQ ID NO: 1038 - DNA, 1005 bp, Homo sapiens
attttctgcttctaagccaggtggtttggccacagataggccaagaagaatacgaacagacaagccttgctgggtttcccactcagtttattactattagaccattccctttttccccactcacatttctgcgcatttccatggtcttcatagaatctaagcctaaaaatagagttttccttgagtctttgggtcttcatttctgaagactctcatgtcacagaaaactttaattaaataaatcgttatgcttttctcttgctaacctttttctacaggcatgtcagctgtgatccttatgatggggaggaaaggcaccccaccttctctgtccctacagtcctaatgccctacccagaatggggttttcaaaatcccaggacacccactctttgtttcttaagcactaaacctatatatagtaaatgtttctggaagtttaacttcagctcttgctgaaattttaaaccctcaatttccagaggaccatcgccaggtgtttttaaaacctcgataggaataagaaatgcttcccagaatggagacttccatcagttctagggagctattagcccccttgccctggctgtaatggagaccgctgtgtctgcctcctttcgcactttggagccaaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaa

SEQ ID NO: 1039 - DNA, 1093 bp, Homo sapiens
ccccattctaggtttacccagttgtactgtgttgtttgtcataggccgggtgaggtggctcacgtctgtaatcctagcaatttgggaggcgaaggcgggtggatcgcctgaggtcaggagttcgagaccagcctggctaacatggtgaaaccctgtctctactaaaaatacaaaaattaactgggtgtggtggcgggtgcctgtaattccagctacttgggaagctgaggtaggagaatcgcttgaacccaggatgcggaggttgcagtgagccgagatcacaccattgcactccagcctgggcaacaagagcgaaattcagtctcaaaaaaaaaaattatctataaaagtataggtgcaactcctcaagtattaaagacaagatagctcggattggacttgactttcagagccataactattcttaatatgttggtttatcttggaatcagaccattttcagtttcaacctgtaaaacagtgtacaaaggaaacatggaaagttttctatatataaagggttgtgaaataataacagctcacagaaaatgctgaaatgatgatttgcttcagtaccctctgaaatttctcccctaccacccctccttcatccccattgctatcaattcaaattacaacagctaattctcaggagaacagtagaagcccagtttctctcctctttcccctctgaccctcctccaattaatctgactgcagcgtaaacctttgcggtttaatattgtgcaacttccacatttccctcgctctcccacccagccccctcccccaccaaattcaggggaactcccgttaccgcagtgccaccagcattactcattcatccccattcaggctttcctcagcatttattaaggactctctgctccagcctctcactctcactctcctccgctcaaactcagctcacttgagagtctcctcccgccagctgtggaaagaactttgcgtctctccagcaatgcatctccttgcgattctgttttgtgctctctggtctgcagtgttggccgagaactcggatgattatgatctcatgtatgtgaatttggacaacgaaatagacaatgga

SEQ ID NO: 1040 - DNA, 1086 bp, Homo sapiens
agccttctgcgctgtctgtaataataatattattattttttgagacggagttttgctgttgttgcccaggctggagtgcgatggtgcggtctcggctcactgcaacctctgccttccgggttcaagcaattctcctgcctcggcctcccaagtagctgggattacaggcgcccgccaccacgcccggctaatttttgtatttttagtagagacagggtttcaccatgttggccaagctggtctcgaatcctgacctcaggtgatccgcccacctcggcctcccaaagtcctgggattacaggcgtaagccacggcgcccggcctgaaataatattaacaacagcaaaagatcattttgcaggccaggcacggtgctcacgcctgtaatcccaggaccttgggaggctgaggcgggaggttggctagatcccaggagttcgagaccagcctggacaacagggcgaaacccatctctaccaaaaattaggcgggcgtggtggcgcacgactgtattcctagctactcaggaggctgaggtgggaggattgcttgagccccattggtcgacgctgcagtgagccgtgatcgcaccactgcactccagcctgggtaacagagggagaccctgtccccgccccactaaaaaaaaaaatcatttttaaattgcaacctcccatctccatctgcaacaactccccgttctcagctcaactgataggtaacctctagagatggctgtagtacaagaatgaaaaaaggtactcattcataaatctgatccatagtggtggcatttccgggaaaaacgttccatacccctaccatccgggcgaccccaattgcacctggcggaccaggcaagggcggaaaggagcagcgcctgcgcgtggtgagcgcggccccgcccagcccgctagtgggcgggcagaaactggccacagagcagtctccggaagctgcctctggctgctctgttaacgtgtcccgcgagcgaggcgcgtcgcaaaaggtcgcggcggaacttccctgcgcttttcagaccatactctttacggtactaggcactgctgagctgggagatgtcgg

SEQ ID NO: 1041 - DNA, 933 bp, Homo sapiens
ttgctttgacagaacctggtgtagatgtgtctgtaggaagaaactgtaaaatgaatggatcattttgtgaaatatctgccctttccccacctttcttttgcttctttgcctttttctccctagttttcatttctttcttttagggcgtcagccccccacctctgtggttgggagggactattgcacgtctacactctcgtggggatgaaatagtgtttgagttcgttatttgcatttgcgcgttatctccccgaggagatgacagcttctctgccagcagcgggcaaaggtgggctctgaagcagaggagaggaattatcaggaaaagctcattttcttctcctgtcctagggtttcactgatgaaggcctctgggacacccacgttgggggtgggggcggtgaggaccgccacctgcccgcggctcccctgcagccaggccacgcgcgctgttgctagggcaaccacccggccaggcctgcggctgccgggaagccccctcgggagcgcgcacgggaagggctgtgggggcgctggccggctgcgacgtcagacccccgcccctcggcgcctgccggacccagctccattcccagccgcgcctccttcggtgggcagccggccggaactcacgaatcagagcagccgacacatcgtccgctcagccaatcgtagcagatgtgtgatcccgccacctccccggaccctggcggttgtcgctgagttggcgaccgcgggagacgctgctgaggcggcttcggttgcgggtcggaacggcgctgctctgcggggccggtccaggctggcagctgccggcgcttggcggtgagggcgggctcccgagtggccccccaccgaaggcggtgggaccagcggctgaggccaggatgccgtccaggcggcgcggcggctcctcactcatcccaggtaagg

SEQ ID NO: 1042 - DNA, 988 bp, Homo sapiens
ttctgctgagtctgcaaagaatgttcaaggggtatttgtgtccgtagctgctcgtgcagcatctcagcctgcggtgtcagactcgaacccagagctgtgtcaaatgagtcaggactcccctctgctgcccttgtgcactggcaggggcactaggttactagtgctaggagactctggtcagtgcccatctgtgctgtcacatgcagggccctggcagtgaggtctggagaaggaagagaaggggcagggaaccccacacgttttgctggtcatttcccaccgtggtcctgccacgggaacccccttcttccacctccattccccactttaggcagaaacatctctcatcctttttcttttctccaagaatcttcccccaaaatcttggcatctcctatacacatctgtacctttgctatatctgtgggccttgttctccctgtaggactcctcttggaaagctaactccccctgacattggagaattttatcaaattgctgagtatcctcccttccctctcacagaccccatggcatgctcagatcacagtagaagacatttcctctgctgccaaacccatggcactctgaggctgactgtgtccacctcattccctcagctgtcttctctttgctgctattaccatgttccaagcagactttggagcatctcccccacagcagcatggactttggcagatttcttggggaccagcgatgtcctaacctgtttgcttttccagggctgatgtttgcagggtgtttttttttttcttttgaaccaaagcagaaatcatcctgtatccttatgcaattcttccggcaggctccaacagataaataaagcccaccaccctccatgggtctacctttcccagcagagcacctgggttggtcccgaagcctccaaccacctgcacgcctgccagggcctctctggggcagccatgaagtccctcgtcctgctcctttgtcttgctcagctctg

SEQ ID NO: 1043 - DNA, 1010 bp, Homo sapiens
tgcatcacgtgcagtaatcatttttattacctattcacaagcaaaaatattagtataaactgggtacaataaaatagagaaaagaaatattcaaatagataagcgttttgttaaaaaaaaaaaaaagaagaaagaaaggacacatttatcaggattcctatttcccgtacataatatggatgtttgtttgtttttgtaagttaacgggaccggtggtttaacttgttattgaaacatgctcgaaaaaatcaggtagcttattttgtaattgcttgttatgaaaccactggcatttctctggggaaaataagttaaaaactctttagctatcaggcagtgggttttaattttttatattggttaaatgtaacagtggatttgcgtactctctcctaatttctaactttgtgtaatcattcttgaaaccccaaatctagattttaaaaaagaagccttctaaaagttttcctgaagtttacttttcagttacaaagagtaaaataactttctgaaatgccttctgtaaatcgtggtggtggtgcggtttgtttggggagatttgttttgtttttaaaagacagtgcactttcttatgaaagagacagggaaagttttacctgtctgtctcctgggtttgttttttttttctttctttctttttcttttaaagattggtgataaggaattctaactacttaatgagatgggagaggcctcactccattggagtggaggagtccaggtggaagttgatggattggacaggtaaagagaagagtcccgcctcctcatgcctatagttgggtatatattaggaaaccttaaattatgtacagagagagaaagagagagagggacttgagttctgttatcttcttaagtagattcatattgtaagggtctcggggtgggggggttggcaaaatcctggagccagaagaaaggacagcagcattgatcaatcttacagctaacatgttgtacctggaaaacaatgcccagactcaatt

SEQ ID NO: 1044 - DNA, 1036 bp, Homo sapiens
tttgagagccacccgtaagtcacgggtttcctaacatgattggacactggaatcacctgcggattttttttttttttttttttttgagacggagtctcgctctgttgcccaggctggagtgcagtggcgggatctcggctcactgcaagctccgcctcctgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggcctgcggattttaactaatactactgatgccgcatctcaccccccctcccgagattctcaggtacggggcgtggccttggcggcggccttataaaagctctcccaggtgattccaacctgtagtaacacttgagaactgcgtgaggtggggacttcaactttaactggacttattttcctcctatgtaaaaggtggacaatatgcaagtggtcctgactttgcttccagattttggcaactccagagccctagttcggtctggagagccagcttcccgccccgtgtcctaaggcctctgtccgagaacccaaagtcctgggaatggacccgcgggagcggacccgcgggagcatctgtgacgccgctcagcaacccggcgccgccccggcggctccgacgtggcccagtgtccggctggcgtgggctctccaggccgcacccactaaaccgcgccggagcgggacacgcatgcgccggtctggacccggcacccagtaacggactcgagctcctcccaccggaagtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagc

SEQ ID NO: 1045 - DNA, 950 bp, Homo sapiens
ggcacagttcatgctacaatctgagattcaattgtgtaaaaataccttgggaaatgacaatagttaacagcttcttgggcaataattataaatacacatgtgtaggtgtaagtattgttcattgatctgtgtacacgccctgcctaaaaggatagagctaccttgcctgtcattgcaagtgtaacacacattgcaagtgccaacgtgaggagccatggctggtgagtcttccccagtaagaggataggtcttagggaggaattagtttgggaaaggactgcctttctcattaggctttgtgaaggtttgtgtgggcagccttggggtggagagagaaagaagaagggagaggcagggtgggaagatgcccagacttgcacagcgtttttgaaggaacagataaaggccaggaagaatctgggatcctactggtatctgctataattttgctagtgttgtccacatttgaagagttatgtagttcaggatgagaatgggcacaggatgggtatcagtagctgttgttctcaaaggaaacagtcaattcccttcaaaattcatgaaactgtcaattcccttcaaaattcaagaaactgggatgtgtcagaatagaatgacttctgatttttaggagattcacagaaaaatcatgaagtcaagtttcccaggtcactcagtgagcatatgtaggtaatgctagaatcagaaggaagtacgtggagtaaatgcaaaggtataagaccgttccttgggattactgtacttgtggagagaaatgtttaaatgattgttaccctgttggtaaattgagagggaaattgtgtcatgttcattatttgaggaatctttgtgcttccaacagaccaactcttgcgtaaaaagagaagaatttttatccattcagtgggtgcaggcacaataaatgccttgctggattgcctattagagga

SEQ ID NO: 1046 - DNA, 800 bp, Homo sapiens
ggtgtggggtgaggtgttccgggcagggccgggaccttgatcccagctgtggggtgggagttcggggaagggccagggcgtgtcctgggtggccagggtcggggcctgggtcctgggggtgggatgaggggttcggggcagggccggggccttggtccagggtctggggacaggctagggccggggtcgccatccgtcctgggcggcgggcaggggtctttaaggggcgcacgcggtggcggaggaccagggcccagccctccggaagtcagggcccacacggccccccagcgtcaggcgctccggtcgcgccggggacggcgggcggggcgggcggggcgggcggggcggacgtgcggcgtgcgcggggcggggcgatgtgcgcgcacgcgccaatcgcaaggccgcgagcagggtgtacgcgcggagaggccaagaaggcggcggggcgggccgagcgtcgggtgcgcccaatcagcgcgccgcaacaccatgacgtgaggctctcccggggctgagcgccagtccgcgggaccggcgggtgagtgcgcgagttcagggcgcgaggcgcgggtccgcgcgggggcgggacttccgcagggccccggaagtgggagctgtgtgttctcatgcgaacgggaaggagcgttggggatctggagtcccggggttgagacattttcgggcccgaaaggggaagaatccgccgccgccgccgccgccagctcgcgcccgccctctcccctacctccggcccggcccggcccggccgcgccgcctctccctgccgtctctctcct

SEQ ID NO: 1047 - DNA, 945 bp, Homo sapiens
tcactcctttaagtttccacccaagccacaataatttcaaacggtcttgcggatgacccagctggtcactcttgtttatgtggggactggaggtaatgagagccaaaaaaagtgctataaacctaatttggctagagcaagttcacacgacacgaccgtgctttaaaaacttgctctccattatgtacttccttccatcaggttggggaaaaaaaaatggtggggatggtgagtaaacacaccagtggtttcatcagaggggaactcactactcaggaggtgacggtgacgtggtgccggtccctgaagtacgcgcacaagctccggaggttgcgggagctgagggaggaaacagggacacgatcagattcgctccaggtggcgggagtgaggaggggaggagtgacgaggcggacgtgcgggggcgggggtgtccaacacaaacacaaacacaaacacgaacacgaacacgctcagcgtccccggggagggcggactgaagccacctcaccattcatcgcccctggaccccgcagtccccctcggactcagggccagagccttctgcgaagcaacctagccccagggaaacggtagcggccgcagaagccccgctctctgtaacggccgcggaggagcagcaagcctccctgtgagtcggtgggagacaagacggagcggcggtaagggcggtagggaagtgaagcgcctctctccaccttgttagaagcgcgctgaaagcggcctgcctacccaccccatcgctgccgttttgcagtcgtcgctcccaccttccgctgccgcctggagggaagccggagcgacgggggtcacggcggcggtcagagggtaaaggtcttgctcccagcagcctccgcggtggatacgtcgccatcttggatccgcgggacaagaaaattcatgcggtgagtttttggtaaattt

SEQ ID NO: 1048 - DNA, 1049 bp, Homo sapiens
aagggagaaaaatgacacttcccctcccattgtcacggggcgagtgtttgggactctaaatcccattgtcctcagcttaattctgggtaggtcacgctgagcacggcgccacaggccacagagctgtgcaccgcccggcctcaggtccaggcgagctcacagcagaagggccaacgggaggcagggaagaccggactgaggtggggccgctgtgtgtggagcagtacacgggctttctactcgcagacgcacgtcgcgggtacacgcgcttagaaggagcggagccgagaccctgccgacagcaggggacaggaaaaggcgcctcggtcgcgccccgcacgagttcccagccccacatccagggaaaccccagccctcaggtaccgtccgcaagaaggctgagcacacaggctcccgcagcatgggccctggcacctgtcagccccggcaggtctcacggcctccggaaccatggaccctgcgagtcgtgggtgtctagggccgactccggcttttcgccacaggaatgaacagtcctctgcttccccgagacccagcgaggccaccggagccaggacgatgggctcccaagcaaggagacgtgggccgctgtgagaagagggagcgcctggctagtgtccaggctgcaaggtcgttgccgctaactccgggaaaccagtggccagtgacaggtgttagcggtctataactcttccgctttcatacagctcccgtcatccctttcacgaagaacgtacgtgggcgcgcaatcacgcatgtatgcacaccacgcacgtacgcgggaggcacgtactcagccatgcatatagacagcaaacattatgaatctcgcattctcgaagacacgcactgacgacatcacgcacgtacgcacgccctggctgctaggagacgctattctctttacctggccctgatgcgcgccagccaaccaggccaaggccaggggacctcgagaccggcagcctcgacgaagaaccggaaggaggaaaaggaacgggagggaggaagagtaagtggaagggtgg

SEQ ID NO: 1049 - DNA, 812 bp, Homo sapiens
ccgcttctcacactgcttctatttaagcagtgtcctcttaaaaataatactggtctcatttattgggcacttgatatgacaaaactactaagtgctttatgtacgtattctcatataattctcaagacaactctggaaggtaggaactactctcccccttttacagaaaagataaaggagggtccgagacatcgcgcgtaacaagcccaaggtcacgggtacacaatcgtttggaagctaggtttgattccaaagctccagctccgaaatccaaaccacacccggttcaaaggacaaaagcacaaacgctcgctcgctgggctctaggaggtgcggacacttccgggggaggggcgaagccagctggctgcggaaggcggtgcaggaacccctttggcgagctcgcgcgaggacgtgccgcagcgccgcctgtcgatcaccttgccccgccgcacgtcggcgcgcccccgggcaagctcctcccccagtcctggccgagcgggaagcgaacgcgcgctctctccggttaccttccgcctcggggaagggcgggggaagtggaagcgcgcgctcgcgagctgcgtgctcgcgtacgtcgccggggttcggctgcgtccgtcccgccgcccgcccgttgccgccgccgccgctgccgccgtgctctcgctttgcccgccgccgcctaaggggggctggggccggggccagccatcactgccgttgccgggatgccgcgggtgtacatcggccgcctgagctaccaggcccgggagcgcgatgtggagcgcttctttaagggctacgggaagatc

SEQ ID NO: 1050 - DNA, 718 bp, Homo sapiens
gcgcatgtctgtgtacatggtaaatatttacgtccgtctgtgcgtgtcatagacatagaacaggtgggatgtaaacagacgggctgggcctagctgctcctttcccgcctcactcgagtctggcaccagattggccgctcccagcccgctccgggtgccggcccctgcaccccaccctgcaccccgcaccctgccctgcaccccatcccggcccgtgcctcgcactccacctttcccgcaccctgccccgcacccaacacctcccgcgcccctcgccgcgctcccccagcacgcaccaggccccgcccactccgccgcgtgcccagcccgcgtcaccgccgtcctccccaggctccagcgcgccttgcggggccgcgcacgctagcggaaccgccgggaagagcgccgtgccgtcaatggcggaggcgcgcacgtctgcagggccgcgcacgtctgcagggccgcgcacgtctgcagggccgcgcacgtctgcagggccgcgcacgtctgcagggccgcgcacgtctgcagggccgcgcacgtctgcagggccgcgcacgcactgacggctgaccgccatcttccctcccgaggcggcagttccaggtgcaagcgccgggtttgctgcccgctgggcgcccctgcagcggcccgagctgtggccggcgtggatgaggggcaggcgaggcagggccgcccctccagtattgccgcccct

SEQ ID NO: 1051 - DNA, 949 bp, Homo sapiens
aacgagttccagttcgtcagcggccgcgagacggccaaggactggaagcgcagcatccgccacaaaggtgccgccgcccctcccttcgctgccgggacccgcgggccccgaccccaccccctacccgactcggacacccgggagcctccggctcggccgagggggcgctgcagctccagggctgcgcggggacacccccgccgcgcgcggaggcctcggtgaacacggacagatcgccccccgctgcacctccccccagcttgggccacagcgcttggggctcgcgggccgctccctccgctcggaaggtctctgcgaggctcctgggccttaaggcccgaaggaagtttacggggactcgagagagcgggcaggaggcgggttgggagggcgcggagccccgggttcgggggagactggaggggcgcacgtgcggccgggtgcgagcgcgcggcgggggaggctgcggggcggcgcgggggcgcgcgcggagcccgagcggcggcgccaggtcacacaacctgttttggcgcctgcgggcgcctgggcccaagggtgcgacgcgggggcgcctgagccgggacacagggggtgcggtgagcgccaggcgccgcggggagttaaaaagttcgggacctgagcggtgcgtggttccgcggtggccgcctcttcctgccgcgcaggccgagggtcccgacggcgccgctcaccgctccgggactcagcctttctgggcccggcctgcggttccctcggggccggggagagggtggagcgcgggaggaggggcgccgggtggggacgcccaggcccttcgtcgggggagggcgctccacccgggctggagttgcagagcccagcagatccctgcggcgttcgcgagggtgggacgggaagcgggctgggaagtcgggccgaggtgggtgtggggttcggggtgtatttcgtc

SEQ ID NO: 1052 - DNA, 963 bp, Homo sapiens
ctgccctttctttcaggtcttttttgtggtaggaactggtaagaaaaggaaaggaattccctaagattttaaggaaacaacaacaaaaaccaggttatgtttggtgagagagttggggcaagaaactgcatcttctaatatggaatccaggtaatttatcagttttttttcatagcatgactacggtgagatttcttgtaagaaaaaaaaaaaaataccagcatcgctggcctcatatattggattatacttaaggggatcaagggataagatgtttgaatttggagatgtcttgaaaaatcctgtggtgagcacaaatgtttgcagtgtctctgctggactcctcaaattgggaaaaaagagactctggttctcatcatagactcaaaacctgaggaaaagcgagatgcgattattagataaactggcaatgacacgcacaaaaatgtgtctattccagccagggcttttcttttcagttgtttgttttggttagagatgactttggggaactgcatgtcccactggacattccaagctgcgttgtcggagtcgcgggtcgcggcctccagtcagcggagccgccgcccccagggtccgccacccagaagtcggcggaggggggcccgccggcgggagcgcgcgccccggtcgccgtctgcgggtagaagcagaggaaagacggtggcctgggagcgcgcgaggccgcacgtgcgcgcgcccgcccgcccgccagccagtccgctcgcccacgcgcccacgcacgcgcccgcccgcccgttggcccgggaagtctcgcgatgccgtagccggctgctcccgctgcgggtggctcgggctgttgctgtggtttcctgagttgctgctgctgcggcggcggcagcggcgtctgtgcttgtggaggtgtcggcctctgggcggatgttgacattgtgttgttgttattgctgatggtaatggcgg

SEQ ID NO: 1053 - DNA, 937 bp, Homo sapiens
acctcctcctcctcctgtttgcacagctggatggaactgggctcctcccgactccccagggcaggatgcgaggctgctttcccactccgtccagatgtcagacccctgcccgttgggcccagcagctgggccgtcactcgcggtccgcctcgagtgctccggcaacctcgccctgccccgtcggttcagggtcgcccagtccccgcgcccccccgaccccaccttccgtgggcctgctgcctctggccctgagtcacttcccccgccatgccccacctcgcccagtccgcctctccacccaggctcccgcggctcggcctccctggccccgcgccctcatcccttccccagcgaacacgcgggcgcatccttccccacccccaccttcaccccagaactgagggggtgcctgtgcttttgcacaccctggggaaagtccccgggtcacgcggttgtttgtggggagcctgtgacgctcaggcttgtccctatgcttccgcctacagagtcacaactgcgaactgtggcggcggcactcagagcgcgggccgacccccgcccggccactgaggcgggcgggcgggagggcgcgcacgtacgcacgcacgcacgcacgcacaccccggccctggcgcccctctttcccctgctaccagacacgcggtcacgtggggccatcgcgggctgccggcgcgggaagccgcgcgagaggcggccgaggggtgcgtgagccggcgccactgcttgcagtgcgcggcttgggagcccgcccctcctgcacggaggagtcggcctgccgccgcggcggcatctgggtaagcgacgcggtcctgcccctgtgggctgccccgggctcagtccctcctgccgcgagccacccagggcggcggcctgcagctgcaccagtcgcgggacagatgcaagtagctggggagag

SEQ ID NO: 1054 - DNA, 1008 bp, Homo sapiens
agaccgactcgggagactctactcagtttctgccaaactttcctaggccactcagccccggaaagagagcgccccatcttggaatctcagacggtcgaaaacttcggggcacccctcagcatccccgcacctcgcgcgccaggattaccccgagacgaatgcccctgtccttacccctcccccgcgccgccctgcccgctcagcgttcagcccctcaccccgcaggcggtcttgcgcccttcctccccttccccacgctcgcttcactctgatctcttcagttttcccggcccccaggttcccagacaggaggggacgcgggccacgggcctgggagggtgggggaaaaggggagaggggagacgggaaagggctgcgcggggagagaaggggtctgagaggcacgtgggaaagtgcaggctctcgaggggagagggggtagtgcggggacttggggcgcgcgtggctgcggtctggggcggcgtaaacttacctcctggtaactctcgtcgccggggctgaaggtgctgttcacgggctgcaggcgcaggccgacgtgcgggacgctgtgcagccacacgacccaccagggagcgatgtagtccacgcgcgccgcctgcatggctcggcccgagtgctacccacaagctgaacgacagctgcgctcacctcccggccggggccccgtgcccgccccgcccccggccccgcctctccctgggcccgcgcccgccccgccccgccgcgatcccagtcccagttctgggcgcgcagcccgctgcagtcaacagcccctttctgggcggggatctgtcctggccggatgggaggagggaagtgaaaaaagctcccagaagtctctaaatcagtttcagtctcgaggtccccgggctgcttcttatttatgatcagatcaagggtataaggtgtcagtgggggcagccagcagtcataggccagagaggggcgactgcccgtcccaagggcttgtcacagggtaagtaaccg

SEQ ID NO: 1055 - DNA, 988 bp, Homo sapiens
aaacccaacaaggttctgtagcactacaactcactagctcatttcatagaagggcctcatgtgtccaggggcccctcaaaaggggagccatcagctgccctgtccttttccaagttctaaaaaagcagctgcgtgtagagtctatatttatataatgacttaacaggacaggtggttgggacattttgcccaactttaatcccgtctttcaagtaaaaataactttttttcctttttaaagaagtatattaattttttgtgttttacaaaagaaataatacagaaaaggtattaagaatgagaaaagcctactctcttgtgctcctttcctgatacacctcttccactcattttagtggagagaaaacggagaatattggtaggaggacagaaggaggtagacaggcagaaggaggtgaatcctgggagccaagggcagagagaggcaagtccccagagaagtgggaatggccaacagctccctgagaagataccttccgtccttcctgggcaagcaggggaagtctcaagaatatacagagaaggaagagtggcagagcccaggctggggatgttaaaagggactcccggtgaggatgggggcgggcccgaaagcaccacctgactccgggctgcaggagggggcgtgggacgggggcggagcctctggcgatgacaacagccacacgtgatcggccaacactgagtcttacctcgttgtggcgtcagaaccgccgtcgctcgctcccttctcggcagtggtacctgttcccggtgtccctgaggacgtgcgggccaggtacggccccgaaagtaggaagcggagggggagcaggtaagggacccggagggggtccctggggttggtgtgggggagcagccccggcctgcggatgccccatccccgggcagcagcgcggagacgcagccggtccacgatgcagccccggggccccgccgcgggaccgcgagccttgtgtgagcggag

SEQ ID NO: 1056 - DNA, 1161 bp, Homo sapiens
ttttaaaaagcgagcaacgcggatcgcggaggccacgcctgtgatcgcagcgctttgggagggggcagttccaagagagcggatcactgaaccggggagttcgagaccacccggcaacgtaatctccgcctcgatagaaatagttttttttttttttttgagacggagtctcgctgtcgcccaggctggagtgcagtggcgcgatctcggctcactgcaggctccgccccacggggttcacgccattctcaggcctcagccttttgagtagctgggaccacaggtgcccaccaccacgcccggctaattttttgtatttttagtagagacggggtttcaccgtgttagccaggatggtctcgatctcctgacctcatgatccgcccgcctcggcctcccaaagtactgggattacaggcgtgagccaccgcgcccagccagaaatagttttaaaaaaagaaataaggagcgtgcggcccgcgggggaagcgcctttaccagctcgagcctgcagccccccaggccgcgccgtcctcggctcccccgggcagcgccggggttttgtcaggcgcgcgctgctgtttgcctggattgcgctcattctgaccctgaagccagcggccccactgacacgccctgaaaagtgggagccacacgcgggatccggagaccgcgctaaagtcccacgcacgacggcgcccgccggcgagtccacgcccgcacgtcggcgcatgcgcgcggccaagccggtgcccgcgcccaccagcgcgcatgcgcgccccgtcccttccctccccccgtgctctgccccgatggttcggtccgcgccgggggcggggccagggcgcccgcgggaaatttggcgggaaccgcgcccgcctcttcctcccttccttctttccttgctttcgccgcgcactccgccgccatggagcagcgccgcgtcaccgacttcttcgcgcgccgccgccccgggcccccccgcatcgcgccgcccaagctggcctgccgcacccccagccccgccaggcccgcactccgcgccccggcctccgctaccagtggcagccgcaagcgcgcccgcccgcccgccgcccccggacgcgaccaggccaggccaccggcccgcaggagactgcggctgtcggtggacgaggtgag

SEQ ID NO: 1057 - DNA, 1009 bp, Homo sapiens
gcatatgtgcagagtacggagggcccagggacgcgaggctccccgatgggcaacctcccctgcctttgcttttccccagagccccctcctggcctgcgttcggcatcttctcgggtcgtcatcgccctctgcggtgcctgcgctcggggtgagggtttttgtcggcttttgttacatcaccgatgtaacagtgcctggacgtagtaggtgctcaataaatatgttgttgaatgcgcttcagtctccccgaatgcttgtcccttccgggcgctctcatcgctctcctaccttccccgctacacagctcgaaggtcccctcctccgggaagctcaccctgtcccacttgccaggaagaatcaagcaaattttctgagtgagacaccttgtcctcactcaggcgtcctgcaggcggcttcagcgagttgttggggcagatgcgccgggagctcccgagggcagggacggcgtcttatttctctttttaagtccacagggcttgcacaatagatgcccaaaaaatgagagtgaatttagaatgagtgaccgagtggctgaagattgcctccttcctttcccagtctgtcggttacttaccctgtgacaagcccttgggacgggcagtcgcccctctctggcctatgactgctggctgcccccactgacaccttatacccttgatctgatcataaataagaagcagcccggggacctcgagactgaaactgatttagagacttctgggagcttttttcacttccctcctcccatccggccaggacagatccccgcccagaaaggggctgttgactgcagcgggctgcgcgcccagaactgggactgggatcgcggcggggcggggcgggcgcgggcccagggagaggcggggccgggggcggggcgggcacggggccccggccgggaggtgagcgcagctgtcgttcagcttgtgggtagcactcgggccgagccatgcaggcggcgcgcgtggactacatcgctccctggtgg

SEQ ID NO: 1058 - DNA, 953 bp, Homo sapiens
aaagcagaagaggacaaacatgggaaaagaagggagggaagggggagataaaaagcctaattaaattctcacagagcgtttatcctaatattaactagttaatgacctcaagatatgtattgagcttttactatgcacgcatggcaggaggggcgtgccccttccttgccttaacctggtgtggttctttgactttttactcctgtatactcgaagaaaacaatacaaaaatcaaagctgggaaaaaagttcctgtatggggtatttcaccgttttaatgcattaaacatgatgtgctcaaatgccccagcctttgggattgaaacattcataatgagaactccgaagcgaccaagatgaaatacaaacttcaaagaaggcgcccagttttgtcttgctactctagcctagttcagtggcgcctcaaactttaatgtgcatgcgaatcacctggcaatcttgctgaatattcagatttggagtcaataggtctggagtgaagcctgagatgctgcgtttttaacatgcccccgggtgatgctgatgcttctaacccaaggaccacactttgagtatacaagggactggagaccatcacctctaccgccaggtgtgtgtatgctgagtcccagcgttccagatcagtgtcccgcacgtcctcggccttctgccagtaggggaggagtcgggggcggagcgggaggagtggcgcgggccccgcgtgggtcctgccagagatcacctcggccccttgaagaggcagccaagctgcggcggcgcaggagggggcgggttcagcgagggcgcggcctctgagggggggcgcaggacacgcatcccccgcgatcgcccgggccactcgggagcctcgcggcagcccggcgccccacttggccatccgctccttgcccgcctcctcttgtcacctcccgtctcatccttctcgctccttc

SEQ ID NO: 1059 - DNA, 916 bp, Homo sapiens
ggacaccaccgacctattgtttacagcggtcagggacccgccccccagacccccaggaccgcgcttccgggggaggagggtgtcctcagcaacggtgacccgcaccaaagccctcctcaccggggtcaccgccacagccggtgcgaggcccgcagggcgctggggatgcgcgaccgactcccgtgaacctgctcctcgcgcgtcagggagagctgtgcacccaactaggctctgtgaggacggactgaggtcggcctgcaggctgcggccccgaaggcaggatttgtggagagatgattcgcgagccttggaggaaggatgggctgtgcgtgcgtgggtgcgtgcgtgtgtgtgtgtgtgtgtctgtgacttttgtatgtttatgtgagactgcgtacgtgcgcgcgtctgtgtgtgcgcgcgcgcgtatatgtctgtgtgtgtgcgtgcgtgtataatttctaaatggacgtcaccttacacatcacaaggttaaaaaatgacccctgggctgtgccaggccaagcacgaagagaaagccccgcctgaaactgcctggaggccccccggctgtcactctcgccacattccgtggagtatgtggttgcaacttctgtcactcaaggtctgatggcggggagattggagccgtatccaatcagcgcactggagtgaaaactgcccaatcaggcacgcagccagagaggaggcggtggcttccgggatgtggcgcgggtctttgcgtctggctactaccagaccgcgggttaggggcttcatctctctgcgttctcagttgtgggaggccttggtgattcggccacagctcagcctccgtcgctctgtgacctgcgggtattggatgattggtagctaagactcccgaatacttcagaagtggggaaatggtgagtgt

SEQ ID NO: 1060 - DNA, 995 bp, Homo sapiens
tccaagatttgtgggaagaaaaagtactaagcttggagtcaggaggcctgatgtttcttcctttcaccaagcttctctagttctgtttcattatccccatggcaacaactagcaacagtgactggcatttagtaggcccttcataaatatatgttgaataaactctaaaagaggtagcttttcattccaagttgagttctctcttggtcctgttgcaggcaagggcaatggtaccctgccctaggtgcacaagtgtgcaggagggatcaatcgcagagcctttccgagagaaggggcccaaagcgagtcaacttctctactgagcttcccatgaggatgctggatccccaatcctaaccatgcagacgtctgagggtcgccgccattaacgggaatgatatggcccttcctcccccactccctcctctcttctcccctttcaacacttgaattgggctctccgctacttccgcacagcgcaggacccacacgagcccagaaccatcacggcctgctagttcccacccctcccgtcctggaggaccgtaggtggacgctcttgcagagcgcctctcgctggttggggcgggggtgggcggagccagcaccgtctgggctgtggaagcggagggggtggggacactctggcccggttctcggtggtgcgggagcgggcgggagcagcggccgctctggtcggcggacgtgctgccgagtagtcccggaagcgaagcagcgatggcggagagtccgactgaggaggcggcaacggcgggcgccggggcggcgggccccggggcgagcagcgttgctggtgttgttggcgttagcggcagcggcggcgggttcgggccgcctttcctgccggatgtgtgggcggcggcggcggcagcgggcggggccgggggcccggggagcggcctggctccgctgcccgggctcccgccctcagccgctgcccacggggccgcgctgcttagccactgggaccccac

SEQ ID NO: 1061 - DNA, 903 bp, Homo sapiens
actgctccctcagcatgactccccggccaagaaatgccggctgcggaggaggatggactcggggagaaagaacaggccgcgtaagtcccgctgggaggggagcgcgggcgcaaggcagacgcagcgtgcggggcccgggactgggagcggctgaggcaggcgccgcagcacgccccgtgcgcccccgcgtctgcggtcgagggactgcacagagtaggttcccgggactgattcttttcctaggggacatcaagcactacaggtctttgcctgagcctgccctttgctcgcttctatcagtagaacgaggattggacacgaagcttgagcgggtccctaggtcaaggatatataataagcgaacgctctgtccgcccttctaattggtggctgggaaaacgcaggtgtgtgaacatttgctggggtccaggagtgaggataaagtgggcggcacaccgagggtgctctctcctttctcacccctctcgcttctctgagcgcgtcctactggggttgcctgccctttgaatcacagagtagccagcagcgtctcgggtctattggagagcgcaagtctggaggcgtggagtttaactaccccccaaaatcacagcctattagaagctgtttcttcacggccaatgagagggttttttgggagggacacacccactgataccatgtgggccggaactatgtggaccaatgaggattggaggtggattttttttttcaacgaagggggaggttgagttgagggtttgtaattgtaatgtacaccggagaaagccgaagtgcattatttcacaatctaaagcttgtatatataatggtagtttgtaaagtgtaccttccccacaggacgctgtgggatgtaaatttgtaggtcgagtttacagctgg

SEQ ID NO: 1062 - DNA, 1087 bp, Homo sapiens
ttcttctctaatgccttttgcacttaaaatctttagtagataccttagcatcttattcagtaataacatgccaacttagtctgtaactaaatatttggtcttcaattgtgactacataaaatgctgaaatatctataacttgggaagcagcagttataaatgcaggtctggtattagacaacctgtgttcaaatcgcacctctatcgtttattaactgtgtgacattaagttccttaacgtctctgatagcctcattttcctcatcttaaaatgggatcctatcatttcataaagttgtattctatatgagtaattaataatgataatagttctttgaaggcctactacactaggaattatgttgagcacttcacactcattttatctaattgtgagaacagggcttcgtacactgtagacaaccaaaacatactgaatgattgaggcggggctaatgaggtccgcagctggcacgccattagaggagtcgcgagtggagctcagtcatgtctgcccacaaagcgcctgcgcttgacctctacgttatatttactttggcaatgtacaaagtggtgaggacagtcctagcccggagggcccctaacacattgtcgtcttcttatcctcggccctctgcgttagagagggctgccccgaatcggctttgaacgctgactcgcccttttccagtcggcccttgagcccactagtcagggctacagcgttttcctaaccgaggttcagaggtgagatggaaaatgtacccgtctttattctgttctctcccctgcaatgacagggtgaatggcggtggggttgggggcacgtctccagagtcccagtccgctcgggacccgcggaccgcccggaggcgacaacggccctgaaattggggggagcttgtttccagccggactgtgtccctgggcgcgccagagcgccgcgcctgcgcgctcagcccgttgccgcgccggccctgcggacgtgcgcgcgctgccttcgcggcacctgggcctgaggtgcgtgcctcccgggccctcgccagctccagatgcgtgaggaggacttcagaaacccgactgagaa

SEQ ID NO: 1063 - DNA, 1022 bp, Homo sapiens
ctgcagaaaatgcccagtttagtctgggagacactcagacccctcgggacaagggtggctagagagaggtccaagctgccctgggtgggtggggagtcaaggcaggccaaagcttcagatttagacagtaaccaccaaatccgacctgggctgcaggtccaaggcctcttcctctttcctgcatgctccgctctgccgctggcccatcttccaatgcaacccctacaactaccaaagcaaaaaggcctgtcccaactccatcctcacggcccgatccccaaccctcaggggatgccgcttcgtgtctcctctttattttacaacgcggccctccttgcagccctcacgaaaagttctgcagtggggtcccccagcgtggggcccttctcgagacccttaaagagaaggctcgtttggtggaccatacccgggcagcgcgggcccgggcctggactggttctacttgtgttctgaggtccctgaccaccgccttgggtccagccctcgtccagggggcggcggtgcaggggagaccgcgcggcccggcctgaagcgcggccgccctcatcccttccccggggctggggtgggtcaccggccgacaaacacaggaggggccgcgtccccgtccccgacgcgctcacaaacgccgtggtcgcccgaaccttcggccccgcagcattcggctacaggaccgcgacactgcagggccccggctctgcgcgctgcgctccggccgctcggcgcgggaggacgtgcggtcgcgcctgcctcggtggccgcgcggggtaggtggctgcggggaccggaaggatggcgaggaagtcggaaagggtttcctgagatgagagattacttccgtccgggctgcggcctctctctggagtcggctagccggggctcggggagcggggtgcgcagggctcggggccacgccttgccacctgcagcgcccgggtgggccgcgggggcctcggcgggacgcgctcggccctgtcgcaggagctaacgcagggggaatc

SEQ ID NO: 1064 - DNA, 988 bp, Homo sapiens
tttgggataaggaagcgtgactacatctacagggtgacgtgagaagggcccagagcagcgagcaggtcttgccatcagggaggggaaccatctgaaggggtggcgtgaaaaagtctttagaggaaggcaaaaaatgggaaaaggtcagagaacctttttgggaggtaaaaggaccagctttggattaggcgtgatgcacaggccccagcgcagggcgtagaaactgcagcctggacagcctgggtgggagaaagtttgggatgtttaggaaggaagggtgcgccagccagggggaagaaacgagacaggtggccgcagatggcgcgagtcaggcagcaggaaaaggcaggctgtttaagcagccttttcctgcagtccaggcggagagcgcagaaggagcaccccgaggggcaagcatgggagagccggagcgggctcgcgggcgcgcgggcgctgtacgtcccctcctcggctcgcggccgcgagcacgcgctctccgtgcccggccccggaggggcgggggcggggcacaggcgcggcgcgcgcacgtccgcgcggggcgggggcggggcgcgaacgcgaccggtgacgtcagaggagggcgcgcgcccggaggcagcaggcggagccgggaggcgggcgttgtgcgcggccgcgggcggagcggaggggcgcgaggggcggagcggagcgcgggaggaggcgggggaggagaggccaccgggaccgcgagcggcagctggggagggggccgcggagcccgagcgggagcaaaacagctgatctggttttcctttaaagcgagagaaaatggaagtcgggtagcggcgactgcggcgctgcgggctggcggagcggagcggcgcggcgcggcaggtaagacggcgctggccgcggtgctgccggcgggcggcggggccgggcccgcggaccaggcaggtgcgctctccgggcgcggggccggcgccgtctccttcccgagctccgt

SEQ ID NO: 1065 - DNA, 947 bp, Homo sapiens
gtcacaactgtactcacaccccaggaacagggcgaacaggccacatatacaacggggacacacgcagtatcacccccggtcacaaggaccctgcaccccgatactctctatcacacatggttacacaaaaaccaccagacaccctggagacaggcggttacacgtgcacagttgcagacacccacacccagccacacagccacaaagacacattcagaacggcgcatccgcagccagctcccgcctgcgcgcacagattcgaggctccggacacgccccggccccgcccaggactcccagacccctcaccttctgcctcccctggtcgcgtccgggtccttgcggagctaactagctcgccacgacgtcaagaacgacgtaacgtcaggccgctgtgggctctgggaattgtagtccagagctagatcggccacggacagaatggcgttctcttatctctgagtcggggcctggctcgttttgacatttttgcgcccacgagtcttcggagagggcgtcgccactccagaccttccagcaagcttgaagtcatctgacgctaaaggactacttacctcaagagctccatcgtcacagaaggaggcggccaagttcgcggggggaggggaggagacagagagtcgaccagtaaagcctcaagggaaatgtagtccaaggcctgagaagcgacgttgctggtaatagaaggtaattcagtaccagcctgggcctggccgcggtgaccgaggcgggccgcgtcgcggagacttctgggagtgcttcctcgctctccgagtgcgcaagcgcagcgcaccgagtggacattttggtctttgtccgcgggtcagtacggcccctgggtccacgtggcgcgaaagtaggaggtgggatctgggcgtctcgggtcggtcggaccggggaggttaaaggggaggattcctgatctt

SEQ ID NO: 1066 - DNA, 979 bp, Homo sapiens
cttagcttttccaccccttcaattttcaagtaaaaaagacgctccaggaagatggcaccgttataattatcagcactttcgacaagggaagtgcagctcaaacgttatacctcaatgctggtctcctacatctccctcttaggcacaatcacacacaatcccgcacccagtttcacattcactcaacaatcccaaacatcaggtcaaactttgaggacaaactcggtcacactcgctcaaacccgcctcagaggcccccatctccgccccgcacgtaggccagaagctcttacacccactccctgccctcgcgccgcgcccctaaagatcaggaatcctcccctttaacctccccggtccgaccgacccgagacgcccagatcccacctcctactttcgcgccacgtggacccaggggccgtactgacccgcggacaaagaccaaaatgtccactcggtgcgctgcgcttgcgcactcggagagcgaggaagcactcccagaagtctccgcgacgcggcccgcctcggtcaccgcggccaggcccaggctggtactgaattaccttctattaccagcaacgtcgcttctcaggccttggactacatttcccttgaggctttactggtcgactctctgtctcctcccctccccccgcgaacttggccgcctccttctgtgacgatggagctcttgaggtaagtagtcctttagcgtcagatgacttcaagcttgctggaaggtctggagtggcgacgccctctccgaagactcgtgggcgcaaaaatgtcaaaacgagccaggccccgactcagagataagagaacgccattctgtccgtggccgatctagctctggactacaattcccagagcccacagcggcctgacgttacgtcgttcttgacgtcgtggcgagctagttagctccgcaaggacccggacgcgaccaggggaggcagaaggtgaggggtctgggagt

SEQ ID NO: 1067 - DNA, 1097 bp, Homo sapiens
gtgtctgtgtccatacaaacccatcttctaatgagccgtaatactgaaattcttcggtaacgtccctccttcccactccctatctttttcagaacttccaggcattaaagacaacgtctgccaatcctacaagttctccccgcctgctaggattcagatggattccacaacttttcagccttccgtgacttttaacactactctagagctaatcacttttaatgaccccactctggaatagacactcctcggctttacactttgtcccggcagcaatcgactgaactgtcccccgacgccgaccacctcggacgacctcagacattcggggtagtttgcccgcgggcagggccccgccaactccgattcctgccccagagccgtccgccccccaagccctcctcaacctcaacccccaaatcccaagcgcagaaccgctgggcttccggttctcctgtgcgcgccccggatccgccacacacctcgccccttctccctgggctcgctctccggaccctaaccccttcccgagcgaggccgagcaacgctctcagcagctgaactaagactccggaggccgcacgtccccctcagcaggccccgcctgggcctctcggctcggctgccctccattgcacccctggcccaaccgtgctgacgcggaagggtggggcagcacgagctcaaggcccggcacttactcgggaaggtaggtggaggaaaaggagctccacttgtgtagcgcgtaggggagaagccggcactcgggcgccgcagcgacagctccgccagccgccatcttgtcagcaccgtagcggccgccaccgaccgctggcagcgaacgggaggaggggagggggcgtggcctgctcttaaaggggccgccgccctccccggccgcccgcgctccccgccccgcatcgttacccgagcccagcgccgggccaatgtcctatctcagggtttcccacgtcgctcgctccttgacggctgaccgacactgggtctgaggtgtaagcgctttccaggcccttccctggggcttggaggggaatggcgcaaaggacttttcttacaagcagaggtaaggaaaagcc

SEQ ID NO: 1068 - DNA, 911 bp, Homo sapiens
taatgatggcatgatgaacttggggtgaacttgaagacaggcttttgtgttgttgggcatgtgccaccttagggaatttccacctgtaccctcctttctctttctccaggatattttggccacagactttatcataaactccatcccttagggtggcattagggtagtcttgggcctgaatttaggtgggccagtggctgtcttagtgacagcctttccgctctcttctgtcatcccctcccaactgctaatgtctaactacctaacaattacccattaaatcagtgtgtctggggttaggagcaggcctcaatatgtttaatcattctccagataatcccaatactgtaaagtttgtgaaacacttgtcagataattcaattatgaaggctgtggaaggtgtttcagtaggatctaattggttaatgttatgacttaattaatttgaatcaaaaaacaaaatgaaaaagctttatatttctaagtcaaataagacataagttggtctaaggttgagataaaatttttaaatgtatgattgaattttgaaaatcataaatatttaaatatctaaagttcagatcagaacattgcgaagctactttccccaatcaacaacaccccttcaggatttaaaaaccaagggggacactggatcacctagtgtttcacaagcaggtaccttctgctgtaggagagagagaactaaagttctgaaagacctgttgcttttcaccaggaagttttactgggcatctcctgagcctaggcaatagctgtagggtgacttctggagccatccccgtttccccgccccccaaaagaagcggagatttaacggggacgtgcggccagagctggggaaatgggcccgcgagccaggccggcgcttctcctcctgatgcttttgc

SEQ ID NO: 1069 - DNA, 1058 bp, Homo sapiens
cactagcttctacatctggccgtgtacccacctgttcactgtgctccagctacctggccctttcctccttcagcttctttgcacaacttgtctgttttggctcctgctttaatctcagctttgatgccacttaggcctttcctagctgattcccgccctcacccctgttacccgccatctaattacagctctctaaatgtgcttcaacagcacctttcatgtcactgattgcaatttgcattgaatacttgcctgattatttttgtctgcaagtgccacatgggtttagccctgctcctgacaagcacactgctgaactgagtaacttttgaatgaatgaatgaatgagtgaataaatcagtgaaggtcctacttggcactgtcatcatcctatcatcaaaatatttcgagtccctcggtgttgctatccctggcatgcccatccccgcgggctggcaaaaccctggagggggcagcctcccaaggcaccgccgcgggctcagcccatctaggaatgactcccgcaccacgcggcgaggggcgggtccggcggcgaggtgtcctgctgcctagcaggttcacgtgtactggtgcaggtggggaggaaggcaaggaaggagcgcagcagggcgcgccagatacgtggaggggagcgcgggcggcgcctcgctcgcctccggcttcgccgtcggtcactgcctgggaacgcgacttcctcctctaggggccgacgtgcggggcggggcggggccgggcgggagacgcccccgcagggctgggctgaaagccgccccaatgggattcggtgcggggcagcgactgcgccccgtcccggcgccgcgctcgtccgcagaggaggcggcccggcccgggcagctgcggctcgggatccgtcgaggggaggccgagcttgccaagctggcgcccagcggggtcatggtgcccggcgcccgcggcggcggcgcactggcgcgggctgccgggcggggcctcctggctttgctgctcgcggtctccgccccgctccggctgcaggcggaggagctgggtgagtggag

SEQ ID NO: 1070 - DNA, 903 bp, Homo sapiens
ccgcatcagtgaatttaggagaaggaaggtcgttagccctctgcctcaccgccaagcaggagccttgcgctccaactgcgtccctcgaagtcttcaggcaaaagcgggactggggagtccagtcctgtggcccagccacatttcctcgcgtagaacgttggacaatgttttctacctcacaggaccatccaaatgactgcgttaggtattcccatgaaatgtacgatgagtacaccctattctacagaagcaaaagctgaggctcagagacgccaagaggtttgctggggtctcgcgactaagcggtcccaacacccagacaccctggctacccggggactgccggtcactaccgggcgccgaaaagccgccggctccttccgccagctacacatccggcgccgaggccggaagcttctcttccggctcccaagaccgcgttccggaaatgagtcgctctaccagtacctaagatggccgccggcccatccaccgtcgcgatcggtgtgaggaaagtgtcacgaacccggaattgcccgactccgtcatggcaggcgccgggggcgtggcttccggcggccacagcttgctagtcgccgcggcggggtcgagcgggggcggcagctgacaggcgctcctcccccgaccgcagcggctggttcccagcgaggcgggcggcccccagctcgcgtccccgagtcctagcccgcgaggcgccagggctgcgcctgggcatggaagaggggaagatggacgagaatgaatgggggtaccacggagagggcaataagagcctggtggtggcccacgcgcaggtgagcggtggacgtgcggcgcaggtccggtacctcactccgacggccggtatcaccccgcccccattatccgtttcctcaacagggt

SEQ ID NO: 1071 - DNA, 1047 bp, Homo sapiens
gaagaggacctgtggacaacatccccttactattaacagcacagcaattccgtagtctcacgaggctgaactcttttggtgctgagagtaacagcactgtgggcactctgcttcttcctccagtgctggccgggccctccgtcccaaccaagcctccaccccactgcggcctggcagtccggcgggcatccaggcgggaggcggcaccgcgtgaggctgagcgcggcaccgacggggcggggagggggatgtggaactgactctgacggggaacgggaatactgaggggacgacagaccggccaggagaaggatctggggcaatgggagactgacccagtagagaggggatactggggtgatgaggaacccaagcggtagggggggatgctggagggtgggggaattccggagaccggccggggaggaggaaggtactggggggacgtggaaccgaccctgttgaggaaacggataatgggggcggggtgataccggccgtcggagtgaggtaccggacctgcgccgcacgtccaccgctcacctgcgcgtgggccaccaccaggctcttattgccctctccgtggtacccccattcattctcgtccatcttcccctcttccatgcccaggcgcagccctggcgcctcgcgggctaggactcggggacgcgagctgggggccgcccgcctcgctgggaaccagccgctgcggtcgggggaggagcgcctgtcagctgccgcccccgctcgaccccgccgcggcgactagcaagctgtggccgccggaagccacgcccccggcgcctgccatgacggagtcgggcaattccgggttcgtgacactttcctcacaccgatcgcgacggtggatgggccggcggccatcttaggtactggtagagcgactcatttccggaacgcggtcttgggagccggaagagaagcttccggcctcggcgccggatgtgtagctggcggaaggagccggcggcttttcggcgcccggtagtgaccggcagtccccgggtagccagggtgtctgggtgt

SEQ ID NO: 1072 - DNA, 1091 bp, Homo sapiens
gaaatgaaaaatgacaccccagagcagccacgtgtggagcctggcatacgccggcttcctgcgctcctgggcgctgcgccgggggactggggcggggggcgatcggagagggagcgatgacggggtgctccggagaccccgcggggcccaggcgcaggaagaaacgggcggcggggggcgaggggcccgatcccacgcaaggagaggccaaggccagctcgcgccacaccccctctccaggccagagtcgtccgcgtgcagcgcggcgaagccctcagtttcccctgcccggcagcggcccgctgggtcaccaggctcacctgtcccagccccgggcggcttagtccatcacagaccggggctcgggcgggcgggggaccaagggccctagtcctgcggctgcggtcggggagggtggccccccggccggcccggggtcggtagggcaattccagaaaaggtttgcccggcagctctccgagaacaaagggcggggggaggacccggcatgtttgtggacttgtttgtgactcaatcccttttgcacggcgtttcacagacagacctgcaagccttgtcaggaagagaaagaacttgggggcgggggaggctggggcaccgcatttccgtccagccacgctcgctcgcgcggcccccgggctccaggctcgcgcagcggcgtttcattagagccccgggcccgggccgcgcgccaggaacttccccgcacgcggcgagatcgacgatcccccgcccccagccccagcccggctccaggcctcgcaatgtcaggcacgagcgccgccacataaaatggatcccggccggcgcggcgagggcggcaggttcccgaggctcctccgcgctgcgcccgggcgcacacgcgcgctgtgaccgccgaccgctcccgggccacgcggagccgcccctctcccggccctcgcgcaactgtcaggcgaaacgggccggcggatattggctcggcgacacgccgaggctcctccccgagtctggatctttatattttgggagaatttctttgaactcagttaccaagctcggtgaaggagacaagttcccacagctgactc

SEQ ID NO: 1073 - DNA, 959 bp, Homo sapiens
tgctcctgacaaggtctacttcctgctctcaggaggcccttattgtggaggaagggaggcgtcgcccgtccctggcttctctgacagccgtgttccatccccgccctgtgccccttctcccggacagtgccttctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggac

SEQ ID NO: 1074 - DNA, 958 bp, Homo sapiens
tggttgaattcgtcacagtgtctttaaataaaacaacaacaaacaaaacacagcaaaccttaacatagttgctaatcatatgagtttacaaggccacctgtgtctttactatcagttacactccttcccaccccatcacattaatcactcaggtctagggatttgcaagtttgctaacagccgaatggaacaaagacaaaacgctaaaatttgtgatgtgggcctaactccaaagccttcaagaaaaaaaaaaaaaggccaggcgcagtggctcatgcctgtgatctcaacactttgggaggcctaggagggtggatcacctgaggacaggagttcgaaaccagcctgaccaacatggtgaaacctcgtctctactaaatacaaaaaaattagctgggcgtgatggcgcatgcctgttaatcccagctacttgggaggctgaggcaggagaatcgcttgaatccgggaggcagaggttgcagtgagccggtattgcgtcactgttgcccactccagcctgagcaacaagaacgaaactccgtctcaaaaaaaaaaaaaatagccatttgtgctttcaatctctccgcttccggcctccacccggcgggaaaaaactcccgcacgtgggcctccacgattccttggcatgcgtgtcactctgggcaacaggctggtcggccacgactgcgcaggcgagaggcacagagcgactggagactgtagtcccccggtttccctggagaccaggcggaagcggccggaagtagcgctgcggttggcagcggcgggatggagaagctgggggtggagccggaggaggaaggcggcggcgacgacgacgaggaagacgccgaggcctgggccatggaactggcggacgtgggggcggcagccagctcgcagggtgcgccgcagccagaggagccagcggcctccttgggtgtaaatgagaagggtg

SEQ ID NO: 1075 - DNA, 1067 bp, Homo sapiens
ctaccctcttgagagtctgggcttggctccccgcacgtctgctttcctcagccgcagggctcccgcgttctcatgcctgacacagtccgcgttcgcatgccacggtggagcatcccctcagcgtgccctaccgctccggcgccggctcggcagatgttccgcctgcgcagagctgagcataggcgccgtgtgagcgccgattcacccaggcccgagcgcgaggcccaagcggggtacccggcgaagggcgtgcgccgcagcgtcttccgcagcttgaagctcggaggagctgcggcgcagcttcgggagcttagagctggggaagacgctgcggcgcgcgccactcgagcctgcgcggccgcttcccggcgcagcacccccctctcgccctctgcgcagccccaccagcccggactccgaggcagccccggacggggggaggtgcgggaggaggggctcctcagggagcggcggggaattcccccttccaccgaacgttcccgattgttcaccgtcctcacgtcagcagcagggggtaatccccgactccagctgctcctgacgtcaccgcgtggagccaccgccccccgcgcgcccctgctccggggcctcctcgaagccccgcccccagccttagccacgccttctccccctccccccaggcgcccgacgtagagggcggagcttctttgaccgcggcgtgagcggttgcttgggccagaaggttctctggtggaggcgctcttcctggtgtcccgcccagtaggttcgttcgcaccgcttcttccacactctttctccctccttctcctcgccccgccttccctccctcctcaatccctctagttccttccccgcctcgccactgtgcacgatctcgcgagacttggcccagaacattgcggatcgggtcggcgccattttgggactgagactggttgtgggggagggaaaagcggcaaaaggggattattcaaagtaccgaaaaccttctcccgggatcaggcgcggcggcacccccaggccaggggcacctctggtggggcagaaggtaacaccgtcctcta

SEQ ID NO: 1076 - DNA, 985 bp, Homo sapiens
gaggggagattctgaggttaggacatgcctggggagattctgaggttaggacatgcctgctcctgaaggtttggagagaaaaggctgggggtaggactgggttcagcaacatcactcccagctccatgcctcacctgagtgataagtgggggactcactccagcaccctccttagcgtggagctggcgctgggccaagggcacaccctcaggagcagcgctgagaagctgggcgcttggtccatgaaccacgccaaaatacgtgaggttgcgagccggcagctgcagcacactgaggttgttgcacagggcggcggccgagcctcgcaggggaatggagcgctcccagcggaacatcctgtgtgggggtgcagccgaatcaccaggcgcgctacaaacagacgcagcggagatgcccgagggcggctatcatcgagcatttcggaagatgcctgagactgggtcataggatggggtgcccagaggacggtgatgggggagggtctcgaggagcaagacaggggagtcccagggctgttttggggcgacgggggaatcgcagaggaggaatggggatgacacaggaccacccgatggccccaagcccgcgagccaaataagtgtgatgaagcccccaaggctttctccctcggctcggatccctgaagcccccggcctagatcagaggtaacacctgcagccccagatcggctcgcctgactcctggttcgtagggtccctccaaatccgccgccaccatagagacgacgcacgtacgcacggcccttgggcggggtgagcggccggaacgtgccgcgggcggcgcggttgccggggcaactgtgggcggggcgagcgaccccgagcccgtggttgcccaggcgactgttaggtggcttacgcggcccggatgcagcagaaacaccagcgttgctgcgaccgcgttggcgatggcgcacgaaggctcggtgagcttcagttcagct

SEQ ID NO: 1077 - DNA, 1055 bp, Homo sapiens
ggctcttcaaatccgttttctttcttcttcttcttttttttttttttttttttttttttttgagacagtctctctctgtcacccaggctagagcgcagtggcgcgatctcggctcactgcaacctccgcctcccgagttcaagcaattctcctgcctctgcctcccgagtagctgggattacaggcaccgcgccaccacatccagctaattttttgtattttagtcgagacggggtctcgccatgttggcctggctggtcttgaactcctgagctcaggcaatcctcccgcctcagcctctcaaagtgctgggattacaggcatgagccattgagaccggccccgttttctttattttaaaattgattggctcttaaacaatttgactttcaagtgcagtctctgaattatttaatatatttcttcctcttgaaattctcgaaatagattttttctgttatcttccctctctaaatgctcatccatttaaatacgcaccaccatgtaagagacttactacattcattagctgtttcaaaatccacttcctgttctcgggctctacaccacccactgaccctttccctcatggcttgagtgtaacaaagcgtttgagtgggcaccgtgcaggtgtaggttttctgcccgagtaccgacgtggcttccttggtcatctaaactcccgcgcggtgggcgggagcaagtaggggcactgggcggcccagagccagcccactgttcccgacaccgaccttaacggccgaccctggctctggcgcatccccagctgaactgaagctcaccgagccttcgtgcgccatcgccaacgcggtcgcagcaacgctggtgtttctgctgcatccgggccgcgtaagccacctaacagtcgcctgggcaaccacgggctcggggtcgctcgccccgcccacagttgccccggcaaccgcgccgcccgcggcacgttccggccgctcaccccgcccaagggccgtgcgtacgtgcgtcgtctctatggtggcggcggatttggagggaccctacgaaccaggagtcag

SEQ ID NO: 1078 - DNA, 1080 bp, Homo sapiens
cggagctctctgacctgtaactcagggctgccatcctgcagcctcagctgggcgcaatagagtatatagcaccgagtctggtacacagtagttccttaaccaaaacgtcagttccgtgagggtgaagaatttattttgttaatggctgtatcctcagacctaaaaccatgtctgacacatagtagggacccaacgaatatttgttgaaaaaacgaacgaactactggtgtttgtgtattgtggttttgttttgcttttttttttcttcttctttttaagtttgtcttcagggacaagacactgtcgaatcctcatttggaaagattatagcttttctccaagtgttctccacggacaccaccactatcaccaatggcttgttacaaaatgtaggttcctgggcccgttccagaactgctcaatcagaatgggagcaatttgggactctgtaatagcaaaagccccttccccagttcttacgcacgtgaaagctgcagaactacaggattagaattggagggcaggcagacactagctgtttctctgcaatctgaacgttccgaacgaggaaactgaggcccagagaggagaaagggatctgcccgcgtctcccaggtggtccaggctggagacaaaaagttcggatctgggcccaccccggccgaccctcccagacctccagcatctgccgggctagccagccgggaacgggggccttcggggtgggccgccggctcccgggccgctttcaacctgggggacggaggcggtgggagcgtcgccattggccagggcgcggcggacgcctccccattggccgggcggacgcctccccattggccgggcggagccctccgcccccggccggggcggccttgccattggcccctccctcgcctataaggcgggggccggcggggccgtgggagcgcgcgggagcgcacggcggggcgcggccgacgctgggacgcggcgcacggagggacgcggccggcgcccatggcgttcgcgctgctgcggcccgtcggcgcgcacgtgctgtacccggacgtgcggctgctgagcgaggacgaggagaac

SEQ ID NO: 1079 - DNA, 1075 bp, Homo sapiens
caagggacacacaaaacaatcaatcaaacaaacaaaaaccatcagattttgagcattagagcctggtgtttacctgcacagtgttggtccttttcccattaatatgttggaatagcacaaacagccactgccacttattcagtacctaatattaatcaggcactgcagtatgtagtttacacatgatcctttaatctttaataaacccattatgcagatggggaaaatgagactttgagatactaaagtaacttgcataagacagctcagtcattaagtgcagggatggcatgcaaaccaaatctgacttttaaacgttacttcatcaccacagctggaggtgagctgcatcagtacacaattcccagtgaagacaggaagttacataaggagggagaatttgtgagtgggtgaatagagcagaaggtgactttactaacgtctttcgcgcattcattagccctcagcatgcttaaaggtgaagtttaaggatgattaaaggtgaggttttcttcttaccccacagtagtggctgttgacatttgatatttttgctcttaaaggtgtgagatgctctttgcattacagcctagtgccttacaggaaagaatttcagagaaactaaaattcgttttagtccatatttcaagtagtgtgttttagtccatatttcaagtagtgtgatggtactgcttaacaatgaacagacattgctgttccgggttaacaggactaagaatttgttcccacattcggtcagcaccaaggctaaggaacagcttcactctctaatctttccacgaaatagctgtcaccttgctccggtgctgaagttcgggatgcggaactagctgagcatgcgtacttcctccctgccggccctccctccgtcccgttggctccgccctccgcggacgtgctgcgtcagaatgcgcctcacccctggcgaccccggaagtgggtcgggggcttggcctctgcccggccacagagccggagctggaggtgctgtcccgtctggcggcgatccccgggcagggcccggggccggggtttgaagatgctgaacgtccct

SEQ ID NO: 1080 - DNA, 1057 bp, Homo sapiens
aaatccaccttaggaagacctgccaaaaagctgattcttcaaaaaagtgttctcgaaatcttagtgtaactggcaccaacacccatccccaatgcctcgttttttttccagcagaactgacaaggtacaaacggaccccgcccagcctggaaggcttctctaatgttggcagagtaggttggacttgtttttgcacaaatcgcctttccctctttccctactccacttgcactgaatattgcactttcttccttactgaagcgggattcctgccttttttttttttttttgagacagattttcgctcttgttgcccaggctgcagtgcagtggtgtgatctcggctcactgcaacctccgcctcccgggttcaagcgattctcctacctcagcctcccgagtagctaggattacaggcgcccgccaccatgcccggctaattcctggcattttaaatacgataaattacttcaacctatgaccacctcaagctgaatataagtagccgcagacaccgtttgcatgacccaggaaccacaaacacggagcgaaggcctgccgggaccacgctgagcttcactactggcagccaactcacttccgggggtgcactcagcacagcagtggcccaacccgccctcaaccggaagtcttttgggctccggcttcgccgtcgccccgccccctggcctttgccccggtcgggcgggacttcctgtgtcgtatttccaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacc

SEQ ID NO: 1081 - DNA, 957 bp, Homo sapiens
aaacaggtttttcatttctgccaggttgtgccccagcttccatttgctaagcagcttaggggaacattggattaaaaaccacccgtaaagaaaaggcattaagaaattgatttgaacgatttgaaattattatcttgaaagatcaaagaaacagtgattatgaacaccggctctggtgggaagcggttcttgaaagttaaagcatgggggaactcgagtactctggagcatcatcagcatctgtacaatgcaagtgaactctggaagctagacgcatgctttgcacgtggacacagacacatgcttgcacaggacacatttgcaatacatacatgtttatacatggacacatgttttgcacacgcttgcacaggacacgcttgcacaggacacatgcacaggatgcatgttttgtacaggacacatgttttgcacatggaaacacatatccatgctttgcaaagggacacagggaagcatgcttacaatggatacaagtttacacacggacgcatgttttgcacaggacatatgcacaggatgcatgttttgcacacggacacacacgtttacataggacaagtgcacaggacacgttttgcaccggacgtattctgtgcacgggacgcacggtttgcagatgcaagcacacacactcctcggcgcgacgggcgaagcggggtgggcagcgacagcggagtccggacccagggacagcgcctccgggaacctcgccaaggcggcgggaactacaactcccggctcggtcgcctcgggacgacgcgcggcccagcgcagactggccccgcccagcggccccgcgcggcccggcccaggtcccggcgcccagagtcgccgcgcggccgccggtgagccgcatggagccccgggcggcggacggctgcttcctgggcgacgtgggtacgtgcgggcgccgcggaggtcagagcgaggcag

SEQ ID NO: 1082 - DNA, 1027 bp, Homo sapiens
ttaaagatgtgcacacacccaacagtttatatttcaataacaggtctggagcctgcctgatgactcttgtgctcacagccacccatgagttttcctaagtcacaaaggtggagctaaaggaaggggcggggactatcactgcagaaagaaagaaacaaacatagcttttccaaacagtaacttcgtgtcgctacgcaggaccctttccttttatctcaaaatgctccccgttggtaaaaccacaggtggtgactatccagttttaggggagaagcgcagtgcctgcgtcccgctttatcgctccctcaccaggggcgcccctgcccaccgcggacgcagcagcccgggggtcctccaggatccctccccggagccgcccgccctcggccccgcccggctcagcacactcaccctggggcgaccacctggcccggctgcgcgcacagctcccgcaccacgcccgcgcgctccgacctcagcctgcgttccggccgcgcggggcgcacgcagcccccggaggctacacgggactgagaggccccggaggactgcgcggaggcggcggcctcgaacacggccagcaccgagccgatgcgcacggccgcgcccgccgccaccctccactccagcaggcgcagcggcgcgggccccgggcagcgcacctcggccacagccgccgtcggggcgccctcggcaggaacgcgacccgcggccggcacctccatcgcggacagagggcgggcgggcggtcggtacggggcctgcgctgcgctcagagcgcagcgcctaccgcggcgacacaacccaggcggcgacgctgtagttcctctcggtaccggcttccacccgtcgcctagcccgcgccgacttcctggagggcgcgtgacgtcacgcaagggcgccgcgtacgtgcgtacgtgcgcgtgtaaatacgagcgccgcgcggggccggagccggctccgtcctgggaccaaccctgcgtgccggccgtgaagaactgcgttcctgagccctacctacttttcc

SEQ ID NO: 1083 - DNA, 902 bp, Homo sapiens
ttcacgtaaattccagacaaacgtagaaagtggctcctttagtaagccacttgcggctgctgctcatcagggttcgcctggggccactgagaccacgcgccggtgcccgccctcccgctgcggtccgattttctgaaccaaccaggcgcttccgggcgccttgccccagacgggcccaccgcctgcgcgggccgagggcggcgcacctgcccctgcgcttccgcatcgaaggtgaggtcggaggaagagaagaccgcaacccccaagctcccgcggcgtggggtccggggggggacacgaggcggggccaccaggacgccgacagcctcacgtctctgggcccgcggcgcgcaaggcatgccgggacccgtagtcccgcgacgttgcgactcacagtgcgcgatgggagtggaggagagcggctcgcggtgcatgccggaactcgtagtctcgggatgctgggtctcagcgcgtgatggggtaatggcacgcaggcctgcgttgaacgctgggactcgtagtcccgccatgctctgtccgcggtgcacgccgggatacgtagttccgagcgcgccaagaccgtcactgggactgggcgacagcggcccgcgttgcatgccgctgctccacggtgccggcgctccgaggaaaagtaggtagggctcaggaacgcagttcttcacggccggcacgcagggttggtcccaggacggagccggctccggccccgcgcggcgctcgtatttacacgcgcacgtacgcacgtacgcggcgcccttgcgtgacgtcacgcgccctccaggaagtcggcgcgggctaggcgacgggtggaagccggtaccgagaggaactacagcgtcgccgcctgggttgtgtcgccgcggtaggcgctgcgctctgag

SEQ ID NO: 1084 - DNA, 1032 bp, Homo sapiens
aatacccagtggagtctggttcacaccctggggggtgtgtcactgtgatgggacacgtaggagtccacccttaaaaccagcaccctgtccctcgaggctgccgagtgggtgtgtggactggggtgccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaacacgggtccacatgtctggtggacttgggaggacggggcagcccacaggattaggggctgggcgccgctgctaagattggagagcggggacagttaagatgcaataaataggtcaaggcccttcctcagaaaagtgaaaagcagctgggaggcctgggaagccaacgcggcctcttccaaaggcgccttctcgtgccagtagctctcctttcagagctgcgggtcctggggaggggccctgggagcctcccggacgccgtcgcccccacacacgcccgctccgccgcccgcgccctcacgtgggcgatctctagacgcctctgcgcccgctaggagtccccggagaccacgccggccgtcctccgttgttaacttctaggctcgcggggcctccgtatccccacgtgggccctgcaggaactggcggggcgcgtgacccggcgaggcccagagacaggggaggggcgccgggagccgggcggatccgcgtccccgatgcgcgctgcatttccggcgggcggcgctgggggcagcgtggagccacccagtgctcggcccgccccgcaacccgccggaaccgccgcccgcagcgaggaagcgcccgcgcgggcgcaggcggccggaatggcggggcccggctggggtcccccgcgcctggacggcttcatcctcaccgagcgcctgggcagcggcacgtacgccacggtgtacaaggcctacgc

SEQ ID NO: 1085 - DNA, 1079 bp, Homo sapiens
gatgtgatatgcatgggtagggttgtggtgccttgtctgcccagaggtcctccccagatggagcatcttggggctgtgataggggttggatgatggacaggagtgaggctggactgggtgagctcagttgtcccaagtcaggggcttgggggagctggggattttggcctgtccacatctgggatctgctctgatggaggaaaggggagcgcttgagcagaccttcctcctggggctctgtaattaaccaggaaagtgtctgtgcataggatcttttcatcacttgatacttatcacactccctgcccctaaggctgagtctgaggttcccttttgttaagtgcaggaccagagactttggaaaggccagaaccacacagcagggcaggatgagaggccatctaggaaacttaggcatcctaggcctcccagacttggctaaggattaagtcacgggagagttaaaggccaaaggtgcacagcaaagaccccggtggggagaggctgtgggctctgaagtttgagcaggaggcagaacactgtcccctccctgatcctccaccaggcgggacctttagggatgggggcagtgaagaggatcctgggagggcaccagaggttggactccaagccaaagcccctcccccggcttccaccaggctgtctaacctccctccctcctgctgcaacccgagtcccgggcgccaggccggcgtatcgggtgaccgcggcgacgcagccaccagcctccgccgctcctctgcggggctgcgccggcggggccgcgccgagggagggggccgcgagaggggatgtgcacggcggcgcgcagcgccgcgccaggtggagtcgcggttaccggggcgactggggcccgggccggcacggcggcggccgcggcggctctcgcattgcagcaaagggcaccggcggcggcggccgcggctgcggaggcggccgggggagagaagagcccgggcgggtgggagtaggggccctccctccccagccggacgcaggacctggggctggggaccccgcacgtacacctgtggccgcaggtaagggggagcgactgt

SEQ ID NO: 1086 - DNA, 1030 bp, Homo sapiens
atggtagagggacacaaactggaacccaggcttcctaaccgccagagcgaccttcccgccgcccaatgcctccctgaggtgctggtcggctgcttctgcccggggtacccagcagtcatcctactctccactcagcaccaccgcacgtcggccgcgcgccacgctacccgccgggttactgggcgctggtttggccttcggaggtcgaggctctctgagtgacctcctgaactgggctcactcttacttagcctcctctctcgaggcagcaccctcctctctacacgacaactccatcattcgcagccccacggtgttcccggggagcgcctcccgcccccaccggcttcgcctcagcttgtcctcgcctttcccgccctcagcatccgcggatacccgcgctcgccgggcccacgcggaagcatccgcagactgtcgcaaggtcccaccgtcttgctctcattgggcaaccttaccctttccccgcctcaatgtttttgcttcctcagtgattggacctgggcattgtccattccagctcccaggcaccgccctctctccacccactagaaagccacccgggttctccttcatccccaacgctcctcacctagcccctgtcctgagggtgcccctaaccctggagccagctttaaaggggcaggccccttctcctgccccagccccagccccacccaccgggcccacattctccgtcttccaggtccagcgctccctcacagaactcccccgcaccttgtctcgctcgctccgcccctccttcccagccacagctagaggtcccgggcgcacctgcagagccggaggcttgctggggcatgcgctccatgaaggctctgcagaaggccctgagccgggctggcagtcactgcgggcgaggaggctggggtcacccgagccggagccccctccttggcgggggcgtccggcaccacctcagtgaggccgcggcgcagggcagagagacgccacacagccaccagccgcagcaccaggatcagtaaggctc

SEQ ID NO: 1087 - DNA, 1068 bp, Homo sapiens
gtgccacagaatccacacagaggcccagcggcggcactgggtggtggggaagggggaggcggacccaggttgggggggcaggcagtcagtgcggttgccaggaagcgggaaagggccacaatggggtctgggaggtgggcggggcggagcggggatgtccagccacgtcgctttgttttcccacgctaggagctaccacaacaggtcagtgcacctcggggcaccgggtcccccacgcaggcccttcccggggcaccctttcccaacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctac

SEQ ID NO: 1088 - DNA, 1087 bp, Homo sapiens
gacgatgttgacggtgaagaagggcagccaacatcccgcaaacaccagcaccaccaccaacaccatgcgcgtcaccttccgctccgagcgccgccgcacgcagcccacgcgcacgcccgccgccctcaccttcaccacgatgagcaggtagcacaggcagatgaccagcagcggcgcgaagaagcccagcacggccgtgtagatgatgaagacggcgccccacagccccacgggctccggccagctggcgttgcaggtaccgccctcctgcacgtccgcgaacaccaggagcggcagcgacatgcacagagacaggacccaggccgcggcgctcgccagcttggccacacgcgggcggcgccagcgggccgagctcagcgggtgcaccactgccaggtagcggtccacgctcatgactgtcaggcagaagacactggtgaactggttgacgccgtccagcgtcatgaccaggcggcacaggacggggccgaagggccagaaggacgcggcgttctgcgtggccaggaaaggcagccccagcatgtacaggacgtcggccactgccaggttgagaatgtagatgttggtgacggtcttcatcttggcgaagcgcagcaccacgtagatgaccagcgtgttcccgcccagcccggccgcacacaccagcaggtacagcacgggcaccagcaccgcccgggcccctgccgagggcgccggccccaccagcgtcctgttgtcaccgcctccagaggcagcccccggggaggaggcgttccagctgggcgtggaggctgggaacaggggctccatggcggcagccctggggtgcgtcaggctctgcaagagaagaagggaggacgccagggtggtgagtccctgaaccagcacatgcaggcattccttcctcctgggccccagccccgcctgccaggaggcgcgggatcaccgggtaaacacgattagtcatgtttagcttggccgggaatcacgttaagcaaattgtttggaaaataagccaggagaggaaggagcggcgggcaggtggccccgggagcccagacggacggctgctgtcgatatggcgaca

SEQ ID NO: 1089 - DNA, 951 bp, Homo sapiens
aaaaagagaaagaaatcggacgggtctcctttaagtgaaaatagagactgtgagaacataaagacattgctgacatctgtgttttaacattccatttatttaaggaaagaggagaaagaaatgtttggaatataaataaacccttccctataggaaggtcagaaatgtagaaatacgcagaagctggtgggagcaaaagccgatcctgagacaaggatatctagagaggtagccctggtcgggatgtgggaagaggcctgcgaagaaacagcagaaccaagggaaagaaagggaagaacgtcaggtccactgctcatcccgagcgcctagaactgcgccagactcctggcatgcgcacaggacactgaaggaagggatgagcttttcggctagcgtattgtctttgagcgacagagcgggattcccaaacgtccccgccggtcactcagctcctgcagttcatgcctagcaagaaccttgcgggcggtccgaggctgccatcctttcacagctgtatttgggggcaaaaatagggtaacgaagccgggggcccagacttacttttgcagccgggtgccatagcgccctcacccctcgatcccgaaaacaatgcagccggtgcctccacctcccgactgcaccgcgcgcgactgaattccgcccgctcaagatggccgcaaatttgaatttggcgcttggatcggacgttgacgcccgcatggaggccgccatgttgcccggcctacgcatcgggggcgtggcccagtgacgtcacagctaagcgcctctgtatcgtcgcgaatccgtcgcggaacctgtcttctgtctttacccagagctaccatgagcaagcggaaccaggtatcgtacgtgcggccagccgagccggcgtttctggcccgcttcaaggaacgggtcggctacagggagggacccaccgtagagactaag

SEQ ID NO: 1090 - DNA, 1022 bp, Homo sapiens
ttcccttagcactttgcagtgagcccagcacctggcagcccctgcccagctggtgcacggtccctctgcggcactgtgagcctggaagtagggagctgggtgtccatgtgctctgagcagggctgggggcccaggcgatggaccctggagctgtgaaggctgaggcaggggtgggtcagggatgaggggagactgctctggggggctcggggccatttccaccagaagttccccctgggagtttgtaggacaaaggacatggttgatgtggatcatagggctgaccagtggcaggcggtgggagggacgcggggtgcttgtgccccaggttgatcagggtgaagcagtcacatgatctctcctgtcctctttcctcattctggtttcctaaagtggtcagaggtctctgcaaaataagctaaagggagggttctgctgggtgggtggcttcggcttctgtgcagcgctcaccctgctctcccctggaacgcctggaactagggtggtcaggctggggtggaggagctcccctggaatgttccagagcttcccccactcctgccgttctgagtcaccctgcctccccggaggaggaggaggatcagctgagccgccgcgctcacgtagtgtctggctgtctgcctgtctgcctcgctgtgagcagagtgggatgctgccgataaggcgcgcacgtgggccctgggaggagcccgaggcagccactcccgcacgtgggcaggaggagggctgctcacaccaccggccgagggaggaggactgcgggctgcgcctgggcaggggatgagcttgtgtcgcgggcggcagggggaagggagtcggagagctcctgcggtccagccggatgactgatgaggttgaaagcacttccgctgcggcccccgcaggaagttcccaggaggaagttgcgaccctttctaagccatcccactggcctggactctgctgggattattttgaccccccagggcagagtgtagccatctgactggctttctctctcg

SEQ ID NO: 1091 - DNA, 1011 bp, Homo sapiens
cctagaggccacgagtgaagttaatttccagttctcgaaaatcttacagacagcggagaactggtgtggtggctctgacgccccgcttgtgagtctgcagtcggacatctggaaagtaagcggcacgtccgcgtgatttccagtgcttcatcttcttccaccctaccttccctccgaggctgggttcttctaattcctgtagattgcagagcgattcctgcgaatgtgccttctttcattcattctagttcattccacagataattcagctgcgcgcttcctctgtgcgaggcattgccggagagcggggagcgaattgaacgtggaacctgccagtaggggcttgccgcccaatacgaaattcaaaatatgtattgtatgtagacgggcaaactaacgaggatcttgtaacttgttttctcatctgccaaatgggggtaatacgatcttataggaccttataggtcgctgaaagattaaacgagcggaaaaaaaagagcccctaatagtgagctaggtgcaaaaaagatcctaatgccttttttcctcattcctccccagattgaaagtgatgagtgccagccctgagggttaaagcgccatattttcctcaatatagggaatatttgttagtgtccccagacgaagttacattggttcaattttcggcgtgtgggagttttcgccactagcattcagcaccccagtttcaaccgttaaagctaccgactccacatacaggaaatgcatcttaaaatttggaaaaaaaatccccaaaacactgacatccaaacactttaaagctgccaaggtggacggaacaccttgaattcccagacgcgctccactgagcatgcccagagcctcaggccaaaccccctcctacccgccaaggggaggtggggcagggctggccttctgtgctagtcacttcctcttccggtttcatatgaactctcccgccacccgggaacagtggctgccaccgtttgtgttttcccgagtttgaat

SEQ ID NO: 1092 - DNA, 984 bp, Homo sapiens
tgagcctgctatacaataagggcttcatgattaaataactgggtcgtacaccaagattctgaacatataggcaggccctcttaagtttagtgtctttgtgtaatggaagtaataactattttgcctttaagttgccataaacatcaaatgagataatgcacttagaaaataaaaacaaaaaaaacttataaacaagacagctttatcatgtattgaaggtggtagaataagaaaacattaaacgtttttattctcatttccccttctttcctttacagctttcacttaaacttgaaatttcaagagaaaattcacttttgaagtttttacttttcaagtgataatagggtcacaggttctttccttccagtctttttgtgttgctcccactcccttttctttctcacatgtaatttttttccattttctttaaatagtatctcaactgggctcacaatagctcagggaaggagaaactgggacatgcctgattaatccattttacaggccaggaaactgaggcagatcccagttgcctccgaagctctgactcagcagcatgcagagagccctgccgctctctgcgccttttctaaacaaatagaacaaaactaaccttgccaggtttccaagcttggatctctaacactccttcaacgttcaccccggcgttcctccccgctgcgccccctccctctccttgccgccccctcctcgggagcaggtggtaggctccgcgcccaacgcgcaagcgcgcggcatcgtggggcgggggtggggcgggactgagggcggagtgtgagcgggctcggttttgggccgcggcgggagcgggagtcgccgccactcgagtgcgcaggcgcctggcgattaccggtctcaccatggagcggaaaggtgagcggtggagcggcctccgccacgaggggcaatggtcgccggggcgaggcccgggtcagcgccgggagcttcgcttaactgccg

SEQ ID NO: 1093 - DNA, 1003 bp, Homo sapiens
cagtgatgacttcatggtccctgccccggccctgtgaccccagtgcactgcccggacccccggtgaccccgaggtactgcccaggctgagcatcccccacctggaccctgccttactccctcccaccagcactgttagaaatgcagtctggggcccccacaggactcgctgggctgaatctgcattcaacagatgctcagggctcctgtgcacttcattttgaggaccactagatttaggggtttgtgtttatgaattcctccatggacacaaaaaaatcctaaagggccctcggtgccactgccctctggggatctaagaggctattgctgctctgggtgaatctgggaggcagaggagtccccggggacccctgtgttccctgccaacccagctccagctgccaggctcacccttccactgggtgacccagaatcggggcggccgcagcggggggcccagggagccggtcgcccctcactcgcctgcctcacgccctcccaggccagggatgcggccccagctggctcagcccaaggtcgtggacacagtgggtccaggccggctctgctctgacctcaatctccctcctgaaggagaggagggaaggggaagggcctgtgagtgctgctcaccccggaacgtgccctcaccgcaatcagagcagacaaagctgcagccaagggcgtcccaagagcagcagggtgaggaaagcgggcctggcccgccccaggggcaacagccgggctgcacccagcccctggtgtttggtgaggcgatggccggcgctgataaacggccctggcctctccctgggatccttcgcctgcgatgcctttgacctctggcagaggaaactataaagcccagaggtgggcatctggcctcagtctgggcgtagagggtgcagggagcagacgggaggatctcaggccagggacgatggcggctctgcaggagaagaagacgtgtggccagcgcatggaggagttccagcgttact

SEQ ID NO: 1094 - DNA, 955 bp, Homo sapiens
accaagtgagagaaattgggcacccccgcctccgctcctgctttcgcacccggcacgcccatctcgtccccgcgcgtctgcaccggccaggcgtcccgcttgcccacccgccgccgcgccccgcgccccctaccccagggcctctgcattcggccccacccctgagggccggccgggaacgcccctggaccggaataatttccagggggcaagagctttcgaaccaagtaaaatagaacttgaatgtagcggctgccgttgcctccttgtaccggtagcggggttggggacggaagccttcggtcggtggagaggagaaagggagaggccttcgggcggtggacggggaagagagggagtccttcgggcggtggagggggtggagagcgaggccttcgggcggtggagagcggggaggggggaggccttcgggcggtgggagggggagagagggaggcctttgggcggtgggggccacggggagggtggtcttcggactacgtgcgggacaggaggtcagggctggcaagtccctcaggcctccctcgttgccccagcctcgcgggccgcctaactgccccgttccaagggtgccaccggaccccgctggagaggaacttctccgttggctggatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccga

SEQ ID NO: 1095 - DNA, 718 bp, Homo sapiens
gcagtcgtctattcagcaaccttgacaacaagctctggcactcagtttctatttcccgggagttgcccagcgctccgcccacgcccgcttgcagaactcgccccgcctccgccccacccatcgtgtgacgtcaccatatcggtcccgcccctctacttcgcgttgctcccgggactgtcaaccgcgtccggaagccccgccttttcgcccccgcccgcatgcgcgggcgcacacgaatgcgggcgcacacgaatgcgggcgcacacgaatgcgggcgcacccttgagtcccctccacaaccgcggtttgatcccagcggtccagtcggccggtgctgcccatccgtcccgccccctagacgcacgtccgctcgcccggcgcccgagccagtccgcgcgcacgccgtctgcgccccgaaagccccgccccaaggcgcgcccgcccaccgctctccacgtgctcgctggagggcggtgcgaggggccgagccgacaagatgttcttgctgcctcttccggctgcggggcgagtagtcgtccgacgtctggccgtgagacgtttcgggagccggagtctctccaccgcagacatgacgaaggtgagaggcggcggctcgctcatggtccgccgctggggccctgcccgtgggctactggggctgcggggctggtcgaagccgcggtgtcctgggcgcccaagccaagttgcaaaaatcagt

SEQ ID NO: 1096 - DNA, 904 bp, Homo sapiens
cctggcttttctaaaggaacgtatgcgtgcggttacgaggaaccgtcgtttccccagcagggtgaggctgagcgtgcacttaacagtcgcgagggccacaggctcctcttgcaagtaacttaaggttaaggagcaacatcgtggacaaatcggcctcgcccagcatttcagtgagggcttggtgcgaattccagccagagccctagaaagtatcttgggcaggtcgaaatgcacccctccagctcccagccacgaggggaccggcttccctgtacgcagctccggccagaggaggccgccgccgccccaccacgccgcggaggggtttgcagggtcccttccacggcctggagtttttccttttcccacgcctgaggaaggcctcgggcgcgcggaacagacgggcaggcggggggcgcacaagcccagggcacgatggcagcagcgctggatccggctgggcgctgctcggccccgtatccgtccgagaggaccgccgctgccaggcctagaggagacatgaagagaccgggcgcagcgcgacccgggaagctccgccgaggtaggagaggcgcccggccagcggagggagttggtctcccaactctccggaaggaggaggagccggcgctggagccgccttagccgcggctccgcgggctggggggagggagaggggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtgagtaggccctggcgcctgcaaccccggcctccgggctcctgctagtc

SEQ ID NO: 1097 - DNA, 1074 bp, Homo sapiens
cacacctgtaatcccagatcctcccgaggtgggaggatcacttgggtccagtagttcgagaccagcttgagtaacatagggagaccctgtctctacaaaaacaaaccaaaccatgaatatatcaaagttggtttttacatttgactgtatggacatctgctttttctccccaatttttagtgagtcatactgctgctaaaaacattggtgttgctatgagcattattttgtctacttgtgcataggtgcaactgtttctccagggtaatatattctcaagagaggatgtgtatatctttaagtgtactgcataatgccaaattactttgcaaagtgattgtacaaaattatactttaaaaattttcattttcattttattttatttataaatagagtcagagactccctatgttacccaggctggtctggaactccaggactcaagcgatcctcctgccttggcctcccaaagtgctgagattacaggcctgagccaccgcgcctggtccaaaattacatgtttatcagcagtgattaatatacaagcacatcaacagacacacgcatagcacacacatgagcatgcacacgtgtgcgcactccctacacatctacgcatgcacacacccataccatcacacaccacacacgcgcacacagatgcacatacatgcactcactgcacacaccgttgtacacgatgcacactacaagccacatacacgcactacgcacacacgcacacgcacaacaccagaccggcacacagacccataaacgtccatcacgcactccacgcacgtccgcatgcacgctacccgtcccggaagcgtggtctccgccgcctgcctctgacgaagcttgtcccggccgcgccaccgtcggacgcccggggtcggaggtcacggcggcgttggaggtggcgtggttttttttttttttttcacccggaaaccgcggttgccggagcccgaactgaggcggcggcgggagcccggttggcgtctggtcttcgcgtcggccccgcggagccagacgctgcccccggcgcggggagaagatggtgcctagcg

SEQ ID NO: 1098 - DNA, 903 bp, Homo sapiens
aagctaaccaaggctcactgtttattagctcatacatacctcaaggctaaaagttgtggagtagggaacactattaccatgaaggaggggtacaaagttggacagagacacctatgttagaacttatgcaatcaggaagaaccttcattaattttgataatcctctcagttgctatttcacgtacagaaacaaatacttttagggttgcccttcccttttcttcacaaggatgattttttttttttgagatggagttttgttcttgctgtgcaggctggagtgcaatggtgcaatcttggttcatcacaacctctgcctcctgggttcaagcgattctcctgcctcaacctcccgagtagctgggattacaggtgtgcaccatcatgcccaactaactttttatttttagtagagatggggtttcaccatgttggtcaggctggtctcgaactcctgacctcaagtgatccacttgcctcagcctcccaaagtgctgggatgacaggtgtgagccaccacgcctggccaaaggtgaaattttaatagtaaaaggagaagataagcagcactggtaacaccagcatccccactttcttgtctttatcagcttgggctgtcattacaaaacaccatagactagttggcttaagcaacatgaatttattttcttccagttctggaggctgggaagttctagatcaaggtgcaggctgtttccacaggaggcctacgtgctgccactgtgctgctgccatgtctctagtgatccctgaaaagttccagcgtattttgagagtattcaaaaccaacattgatgagtggtgtaaaataacctttgccatcactgccattaagggtgtgggtcaaagatatgctcatgtggtgttgaggaaagcagacat

SEQ ID NO: 1099 - DNA, 975 bp, Homo sapiens
tctcaaaatagtggtgggagcattgcagggtgccagatgaaaatctgttgagtttgctctacagcacaccttttgcaaagtatcacttgtggtgtacggggaagcagctgtaatgctgattccgccggcatttctcactcaatctactccatgctaaacaggccggttaggaattaagtcatactctgggtagtacaagtggaaagtgtgaacagagaaaccactttatgcgaggacagtggaaaatgagatcctcctttcctctccctactcctgctcctatcgagaagcacttaagagcgcagacgcccaggacccagccgcgctcgggcgtcccgactcggaggctggcggcgggcaggcacgctctcccgcgctgagagcccttctgcggagatgaactctcgagtgtcgccgccgcgcgcgggcccgatcgataccggcgggcggacgtgctcccgccgccgacagcagccacagggcggtgcagtcagctgtccggccgctcggtcgcacttctcatcagctcaatacccgcagaggacgtgcaccggttccctcccggacacccaccccgtggtctccgccgcaccttctgcccaccgccccttccgctcggccgtccggcgcagagcgggagcttttcagccagacgccctcgcgttgggggcagccgggtcccggcccgagcggagggcgtcgtgaggtggccttttcgcccggctccccagtgggacgctccgcggaggcagccaaggcggggagtgtcgagctccctcacactctggaccttaccttctggcgtcttcgcccgggaggctgcagggggaggcggacccagccggccacaggggcaggttcgcggcgctgtgaggcggggctgggcgtgcgccgccgccgccgccagattcgtctactccagtgaatcggcacgggagaaagccccgcccccggcgcccgctcccactcctgatt

SEQ ID NO: 1100 - DNA, 943 bp, Homo sapiens
ctctcccgagtctgtcgttaccgaacggccatgcgagggcgcccagcgcgacagggaccacctcctgacctccacggaggaccaaaggcacccggggggacgcccggccatcactccacgggcgaggtcgctcccccagggagaagggctccccaaagtccgagcgcccttggagaaagtcggccggacctgggcctgcgccgcaacccccgcccaccgcaactttcgcgggcggtagcggggcaggaagtgggggggcgggggcggcgcttgggacacggggaggtgccaggcgagtgctccggccccgcccctgccccgcccggccgtggccgcgccccctgcgcccccagcgccccggagccgtggagccgccgagccgccgagtcgtcgagtcgcagcgccgggcgtggggactgcgggtggggcgaacaaagcggcggcgacgcgggcggcccaggcccgggacgcgcggagcgagcgaccccgccgggcctttgtctcgggcggggcaggagccgcggcggccgcggggcgccccgagcgcagaatgcggcgcccggcggcgcggattggggagcgctgcggcgactggctgcgtggagcccggcccggggcccgcaggcacttgcgtgtgtgaagcggggagatccggcgcgctgcccgttgcccgccccgcggccgcacgtgggcgggagcggcggcccgagaggagcccgaggagtaggaggaggaagaggaggggacgcacggcggcgcagcgggggacctggggcagcccgcgcgaagccccgccccggccctgagccccgcgcgcgcgcgggcgggatgccccgcggccgctgcactttggctcgagcactgccctgagccggtcgggcccgcgggcgccatggagcagtggcggcagtgcggccgctggctcatcgattgcaaggtcctg

SEQ ID NO: 1101 - DNA, 965 bp, Homo sapiens
agcaaaatccacctatgtcctgaacactatccactttacaagcctcattatatgtactggagacaaaattcagaaataaataaatatatatgtacatatatacaaatatatttcaaattaaaaaatacttttagagagtggtatgtattacatttagaaattaataacgaagtaaattatgggatgtcatccacgcctgtcccaaaggtaccgaatttataaatcatctcaggtgcggagcaggacaggttgaaaataggaatgacatgaacccgcgcggaacagctgccggcgcggtgtccagggcggcaccccgcccggtcccggcccctccagccctgggcccgacccctactacgcctctgcctcgacgcgaacgcggagcccgagcgcgcgtcacgccgtgtggggccgaagaggctgctacccagaggcggagtgcgggctcgcgagggtccccacccgactctcgctcccgccagcacctacggactcgcgtccccgccgcgcgccgactcgggagcagcaccgcccccggcacaggagcctcacgcgcctcttacctaacaggaagttgggtggaagcagcgcggacccacggcgcaccgaacgcactccaacagaacccgacgcagacacgcgctttcaaccggcggagacactggcagggccagaaacgcgcgcagcgggggcgggaggtcggtaagctccccgcccctgcccgagaccccgccccggcccggcccggccccgcctttttctctgcctcccctccctgcacgtacgcgccccgcccctcgcgcgacgttttttgttgacccggaaacggattatccggagccaaggtccgctcgggtgagtgccctccgctttttgtggccaaacccagccacgcagtcccctccctgcggcgtcctccacacccggggtctgctggtctccgcggatgtcacaggctcggcaac

SEQ ID NO: 1102 - DNA, 1069 bp, Homo sapiens
ttttcttatactgccagtggggatcttcagctcagagcttcagggaacaacccctgcttccaagtgagtaattcttctgggagttgtattttttccatctcttgtaaacgtcttaccccacttccacttcccttcgggaacgccacacagcgcctgcgcagcaataccactaaacgactacgtgcggtcggtttgccggcagagggggtatagctcagtggtagagcatttgactgcagatcaagaggtccccggttcaaatccgggtgccccctctttggccttttcgagatactgtttttgtcctgggtgtcgatttttcctaagctgtttgcttttactcctactggcagacgaggagcagtgagggactgaaaggaactggggattcaacagcagtggctctcaaaatgtggtcctgggaccagcagcattacctgggtacgctcgggcctcatcccagacctaatgaattagaaacttgagggtggagtccagaaatctgtgttttcatatacgctccccatcgcttgagtccaggagttggaagctgcagtgagctatgatcgcagcactgcactccagcctaggcaacgtgcgagaacctgtctcaaaaaacaaacaaaatacacacacacacacacacacacacacacacacacacacacacacaccctgcaggtgattacgatctcaagttctagaggcttacgttaaaatttacacatttgcttctactatttacaagtttatgtttcagcctgagctcttcttgtaagacagaccacgaggtaccccagatggaggaatgtgcaaagacgccggggctggagctggaatccgtcccgagacttctcaccttgacctcgaggaaggcaggaggtcggagacagggggtgggcaggctggggaaagaggaaacccgcaggacaagagggttgtggctcgtcacgtggccacttgagggcagcaagtagctgcagctggaggtagctgcctatctgattctgtttgagagtccgccaagttgggatttaaattagacatcaagaagaatttacagaccggc

SEQ ID NO: 1103 - DNA, 705 bp, Homo sapiens
aacatggtgaaaacccgtctctatacaaaaatacaaaaattagccgggcgtggtagtgtgcacctgtaatcttagctacttgggaggctgaggcaccagcctgggcgacagagcaaggctgtttcaaaaagaaagaaacaaagaagaaagtagaatggtggttaccaagggactggagtaggggtaaatgggtataaggtttcagttttgcaagatgaaaatgatctagaggtctgccaccactgaattgtacaactaaaaatggttaagatggtagattttgttacgtgttttttcaccaattaaaaaaaaatttaataaaaaaggataaagaggagggaagcctaatgttatgctctttatgcccgaatttggcgaaatcgagccttgcccgctgttttttcctatgacagtgtctgaacctttctttttcccaggagtaggaatggcccctgctcccgcgcagcctccaggctgcaccacgctcgccccgcctctctctccgctccttactccgcccaccgcagtttcctccaatcgcggccctctccccgcccccttacccgagcctttttcctgcatccgggcctgagagtgcaggcttgagggaagcatggaggtccatggcaagcccaaggctagcccgagttgttcgtcgcccacccgggattcctcaggagtcccagtgtccaaggagctgctgac

SEQ ID NO: 1104 - DNA, 900 bp, Homo sapiens
cagcagcttgtggtcctggcctgtgccatgctttagtgccctaacgatgagccccagcaattcccagcgcctcctgcttctccaagtctggcctcttttcccctctgtaccgccgcttctccccactctccgcagctcggggtcactttctttactgatctcccctctcttctgggagaggcacttgctgaacatctttccgcccggagcctccccaggagctgcagaggggcagctggagagatgctttctgacgtagcatctcccacctttctccttggggaccctgaggaaggggacaagggctcgctctgcaggtcctcactgtaactggaaaaacacgacctcgccctcgggaaggctttctgtgcgcctcacctcaggatgagggtgggtgtaggggacacctcccagaaacccctaacctcccagtcggttaaagaagaggggatagggtcaagggatgcgacagagctgtgtggtttccggatgggaaacctcagtcgtttaggcacccctccgctcgagtcacttccgaagcagtcgattcttggggagaagcgctgcggaaaggggcgactccgatgcagatggccctgtcccggcgccccaggtcgtcgcgcgcgcagctgcggtagtcactgcgcctccccgcccccactcctggatgccccccttccctctcccggccagactctgagcaggagctccgcccccagcgcgccgccccagccccggcgccttaaaagccgggcgcaccgccccgccgcgccctgcctgccgcacctctcctttcttctgtagctcgcgttgaagccgcacgtccggccccgatcccggcaccatgagcttcggctcggagcactacctgtgctcctcctcctcctaccgcaaggtgtt

SEQ ID NO: 1105 - DNA, 908 bp, Homo sapiens
tgattttgcatcactggagagaactcaggaagcaggagaggctgaattggataccacggggaatgcagccctgccaacagaggactggatagaattagagcaaacggacacatccccccacgcctgttctccacagggcagattttattaatatatttctaacattggggcctcgtttcagtcttcaagttttttcttttttagcgcaaactagacgcgctctgagagccaaaattagcgtccgcgaaccccaccccattgcctccaacagacctagctctcctttccaccctcaaacagccgttactacagttcccagcaagcaccgcgcagggccgcaaagggccaggccctcggcgaaggccccgccccgcagggggcatgccgggagttgtagtgagtgggcgcttccctactactacttgtcccttccactgggcattcccacttggaagagtgtgatgcgctgccagagcagtttctctagttccgtactcggagctcaaggtgacagaggactgcgcttccagccctgcgctgcgcatcgcgtcggtcccgcggacctttgccccgcctccttccacacccgttcccttgacagctgggctgcgctccgggccgcggcaagccgcgagcgcgcaggcgcagcagccccgcgccgcgctaggccggcctggagggcgggacaagcgctagaagctcccggccgggggcgcgcacgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctc

SEQ ID NO: 1106 - DNA, 909 bp, Homo sapiens
attcaggacattcctccgaagacgttccagactcgagtcctaggacatggttggggcgggggtcatttgatcgagtggcctgtgtccttatctggaatacgggacgacgctgtaactctaactcaccctgcgaactcacagcttttgaggtaaacaagtgagaaagaagagacaataaagtgatctttctttaccatctaccaaggaccaggtggtttacacgtcagttcattttcaggaacacagcagcgctctgaaaactacagagcttcctgggcgtagggggctgtggtcgcttgaaaagaaccagcctgggggtccgagttccaccggaattgggttcgagcgcgggtgaaaagagggacccgacagcacccaccctccaagtagaggcaaaagttgaaagtggcgggctggctgcgcttccgaagaaacacgactggcgaaggctcaccttagtctctacggtgggtccctccctgtagccgacccgttccttgaagcgggccagaaacgccggctcggctggccgcacgtacgatacctggttccgcttgctcatggtagctctgggtaaagacagaagacaggttccgcgacggattcgcgacgatacagaggcgcttagctgtgacgtcactgggccacgcccccgatgcgtaggccgggcaacatggcggcctccatgcgggcgtcaacgtccgatccaagcgccaaattcaaatttgcggccatcttgagcgggcggaattcagtcgcgcgcggtgcagtcgggaggtggaggcaccggctgcattgttttcgggatcgaggggtgagggcgctatggcacccggctgcaaaagtaagtctgggcccccggcttcgttaccctatttttgcccccaaatacagctgtgaaaggatggc

SEQ ID NO: 1107 - DNA, 1102 bp, Homo sapiens
tttaaggtttctctggggtctccttggctaagaggaggtccgttcagtgcttggggggcttacaattttatttttagtttacaaacacaaacaaacgtaattatttatttttatgttttttgttttgttttttgcgacagagtcttgctctgtcaaccaggctgagtgcagtggcaagatcgctgctcactgcaacctccacctcccggattcaagcgattctcatgcctcagcctccctagtagctgggactacaggtgcgccctaccacgcccggctaatttttttgtatttttagtagagacggggtttcgccatgttggccaagctggtctcgaactcctgaactcaagtgatccgcccaccgaggcctgggattacaggcgtgagccaccgtgcgtagccaagtaattattaactccacagaaaataaaaggctgtgcaggaagtaaaaattaatcaagtccatatatagacctcagatacatttcgtttgggctatcctgcactttactttgtaattaaacaccactatttaaaaatcaggaaaattgcacataaaaatccagctgcaagtgggcgctctggagttccccagtctccactcactcgtcctcccagcccccacaggcctcaacgtcgcctatcccactccaccagcccagtcttccaccgccctaggaactctcctacgcctacgcaagcagggagggatagggtgacagcaccgacaacaaagggtcgtctcccgcactccgtatgaggatggcgtactggtcggggggcaaccgaagcctttcttcctaggttctttatcttttctaagtttcccatgacctatcgctccgcttgagccctcagcaaagatgtcacccgccgaaaggtgtggccggaagctggaggcgtggcttccggacgtgcggggcgaggctcgtctcgtttccgccggcgctccgagtgacgtagggaagcgcgccgcgcacctcatggttccggggacagttagggcggcggatggaggtcagcggtggtgctcgctgcgtaggtcttgtggcacggggagaaggggcggctgatcgtgggtttcgagtgcacaacacag

SEQ ID NO: 1108 - DNA, 942 bp, Homo sapiens
cactcaaaagcgtatccaagtcctgaggtctccaaagcggtggagagacccgcccagcccctcactccccggctgggaactgagattgtggagggtgggcgccctgccgcggcccagtggggctgggggcttccagagtcggggtccagggctcggtgtccgagactccaccgccagccgcgccgacctgacccacggccgggtacaacagagaaggcggcgcttcccaaaggcaccgatggagtgcagggtagccgccgccctcaggatttatcaaccgcgaggcgctgtcagcaactcgtgcccggaagccaccccgccccggcacacacatactccagcgccccctccaggcgcactccgcaaacacgcgagcgcggcgaccgccccagccctttgtgactggatgagtggggccgagcagcacgcactgtcttcgacctccaatcaggactcggggtctcggagctgtaccaatcggagatgaccgtggcctcaacagggccaatcgggggactcgagcccgacaacagggcaagccgccaacagcgatcaatcagaggggaggagcggctcccagatacccaatcagcggccttcaggcgcagatcgtgggcggagcggtagccaggccgcgggccggccaatcagcgggcgagcggctgcctcagcgcgcgcggcgggcggggcggggcctgtccgcgcctaggagcagtgggcgctgagagcagcaaggccaggtgaggagtagggacgaccccgagcctggagagggggcaggagtgggggcgcgcgagggtcggggcggggtctcaggatgcagccgggcggcctctcagggctgcggacgcggcggggagaggtgaggggccgggttcagagttcggggagggcgtccttcccggcgccgcggctgcgggcggaggggacactgttgccatg

SEQ ID NO: 1109 - DNA, 1063 bp, Homo sapiens
aataaccacatggctagcgagaaccggataaagaccaggacccaggatgccccaggccccacagacagccccacagtcactcccacagcagcctgggttcctcaatgggcctggccacgctgcccctgcccgaaatgccagcgaggcacagactgcccacagccgggagccccagccggtcctgacgccttgccgtggcaacacccctgccgtgcctatcccctgatgctcggcctggcctcccgagctccaccttgaggtaggcggcctccgtctccgcgatggtccggtcgaactcgttgcgagaggcaatcttgcgtgccaggttctcgttgacgcgggccagcttctctgtcagctgcctcacctcattctgcagccgctgcttctcgtcctcctcctcctggatctgccggcacagctcctcccgcttctggcacagctcctctatgcctgggggccgggaggggcggcgctgtgggcccagggcaggagcgcggcggcggagggcgggcctccttccacccgaggaagccagagtcaggcaccacccccgagcgcccggcgcggggcctgcgagccagcgagggctcgggccacggacacccggcctccggcacggagggctctgctcagccgcgcgatgcccgcagcgaggcgggtccaggggcaccccgctgcgagccgggaacccggccctgcggccctcccgacctccccgtcccggctgcgccgctcacacttgaccagctcgttgttgtagttctgcagcgccgcgccctgctgggtcatggtcaacgccgcccggggccccaccaccccaaccgccgcggaagcagcgctgtccgcgcctgcgcacgactcccccacggcgcgccgaactagcgcgtcatcgctgagcgccttgtgcgcgtcatggctgcgcgtgcagacgtgcgtcatcgccgcgcgccgcgccgagcgaatctcggagtcggtgggtgcagatggcggcggcagttgtggtggcggagggggacagcgactcccggcccggacaggagttgttagtggcctggaacac

SEQ ID NO: 1110 - DNA, 1061 bp, Homo sapiens
atctttcctccctctccatgttcttcccagtagttcaaatagcattcatatgtaaaatgactggttaaaatatgggagatcatctctggctgttggagaagtcacccatttaggggatcaacctgtgactgaggaggcaggacactttctgtagtgggaggaacatgggccacatacaaacagatttagttcaaatgccagtgctacctctcccttgcattaagcaagttactgaaaccttcagaatctagttttcatctgtaatataggaataatgatgataatgcttatatcaccagggaatttgtctttctgaaagggctagcacacagtaggtattcaatgcaagttagcttttgcccttgccttcaaatccagggaacacatggcagcaacaagactgtagccctgggagttgctatgtctgcagcctctttaaggtgttaggcagacaggatgtaagcactagaaagattcagtatggtatcaccggctgtagtggttcagcccttggcctctgtagcccaagagccagtgttcgggtctactaactctgtgctcttgaaatgtctcctacttttaagtcagtttccttatctgtaaactgagactaatggcatttacctaattgggtcgttggagatcaagtaccttaattgatataaagtgcttagaacagtccctgggaggtggtattttgctccagtctgttatagggaggatcattttgttgttagagttcagtgaagaccgttttttaaaatcgtgtggaatgactataggcattataaagacaactgaagaagctcttgtttctgaacagtacttggccagtttctttaacaggagatggctttgcttttagaagcctgccccagagtcttccatctcttccactctccctgcacgtccgctctgtatggcttttgttattaatgtggagcagttgaagtcactgacttgggtgcaggccaggccagcattactgaggtcatatattactttcctagactctagtcatgaacaggatgttggaagtcagaggtacagagaagctgcct

SEQ ID NO: 1111 - DNA, 1009 bp, Homo sapiens
gttacgttcgaggaatcaaatcgccttacctttaaatacaccttttatgagtggcgctactgctgtattgaagacttcttcctgttcagtagagggatcaaatacaaaatcgtaggtgaaggatttatctgtaccaaccaccacctagagaaggcacgggacaaggcgtaaggttaaaaatgaaaggcaagaccacacccctcgttaccatttggccccagctgttcagacacaggctctggactctgctacgcacctgaggctctccgggcacgaaggaaaggcacatctggcagccctcgctaatctctttggggaccagagggcgacaacgcagcgccactcttacgggaattcccttcacctcttccttcatgatcctatctcagcaccgtctctgcgagggggaaaaagaaggctcgctgatgaatgttagtaggtcagcaggggtgggagggcgtcctccccggttccgaccctcctcagcgggaacactgacttgggagattcacgctccatgacttggccagggctggaccgcccgtcagccctgcactctaaagagagtgcacgggcttctgaaaggcaaagaaaaaactccaacggggacggcgacaaagaaccaaagccctagggtactgggtaaaaacaggttctgagctaaggtgtgcccccgtaactcaccaaactaaatgtcccttccccgttctccctgggcctcccgccgccctgtcccagccggagctttaaccgccaagtttcaaatccgtcccggagacgccaaccaattgcagtgcggactgcccgagggcggagcgcgcacgtcggcgcgcgcaggccggcgcggtgggaaggggagggtcagctcgttgcaccctggcccggcctcttttcgaccctgcggagcatccgcttccggttcccagactgaattgtcagtgagcggagtctgaggtcgctgtggactgcccactggtgaggtggtgcggcgtttatgcggctgagagtg

SEQ ID NO: 1112 - DNA, 904 bp, Homo sapiens
aggacgtctttggaaactctcgcccttcctcggcggacccgagctgcccgagagatgccctgcatgtgagtgacctctgcgccgaccccgccactggtcagctcgcggctggggcgtgccctgccggggcctgacgtggcggcggggccgcggggcgggcggcgcgaggggagaggccgccgtgagggcgcggcctgacgtggcggccgcggcggggctgccgggggagcccggaccactgcactgccccgcgctccggccagagggcgcccggccccaagccttccccgccccgaggccgcccagggctccgggagtaaccgcgccagcgattgggtcggcggcgcggcggggccatgttggagcggagcaacgaccccgcctcgcaccgccctccgccctgggtcgggccgcgccaggagggaaggggagcggcgaaggggacgctccctcttaggcagcccgacgcggctggagccgcggcaggagcggcggcggtcacgaccgcccctccgcgcccgggccaatcagcggcgcgggcacaaatatgcaaatagcgcgccggtgctgccggagtgccgctcgcaggggctggtggggtcgcgctgggggagtgaactgggccaatcaggcgggtgcgtggcggcgcgggggaggcggtgccccttcactcctccctccactccctccctgccccgcgctgacaggggggcctggccgcgcagccggtaagtgccgccgccgccgccgctgccacccaccgcctcgggcgtggggaggaagcccgggggcaccgcggggcagcggccgctgctcaactggtggggagatgcgggggcgggtcgtgtcagacgggtggtcgcctgaggccgcccccgcccggccagccgcgagtgtcagtctc

SEQ ID NO: 1113 - DNA, 957 bp, Homo sapiens
gtctgacatctagtggcctcctgggcccgggcagggcgagggcggggcagggaagaaggtggagggcagaatgggaggcgtggagcgagaaaatcaggaagcgcgggaccaagccggggaagggcggcgggtctcgcccctggcacccgctctcctcggggcccgtcccatcccccaggcctggccgaccccaggtccttccgtgcgcagtcggggctcgcaaggacgaatcccgcggccctcgaggcaggcccgggggagctcccggccctccacccccgcaggccgcagatcccacgcacccccgatcatgggggccccggagggaggtcgcgaggccgggctcacggtggccgcggttcgcccacgtgcgggcccggagctggcagggcccggtcccgagcgtggccgcaaccgcggggacctggcacgtgcggggcagccccgggggccgcgtacgccacttccggtcccggagacaccgcccagcccgccgcccggttgccatggcgacgccgtcgcgccacggcccgcagaaccggccaagcgacccgggcgcggcgcggggaggctgaagggacgctcgggtaggcaaggtaggaggccgggctgggggtgggagcggagcgcgcaggggtgcggggcgggggcggcccaggtgagccctgactgcgcagggagggacagcgcggggctcccgagtagcagccggcctcgcacctgccccttgcggccgcgcactggactgcggcgccgacccgcaccctgggcccgagggctgcagggctcgcccgccctctcggagccgagcctctcccggtccaggcggcccctgccctggcctgcccgggtgccgggtctctgctgaagttagaaccgagacccccgcttgctggtgaccccgagtttggatctttgctcctgcgccgcgttctagagcaaggtagggtgcaaatg

SEQ ID NO: 1114 - DNA, 1031 bp, Homo sapiens
gatgccttctttggtttcctttttattgcagaggggccaccagggagtgggcaggagtgaggggtgagagcctgggggccgcagagccaaacttcgcctgattaataacccagatgttcccgtccaagcacatggaggtcccgggagctcttgggaagtcagaccccagctcggtcccgtgccaatctgcagttaggaggcaggtcctcggtccgggttgacacgtaggccacagtcttgggcgccctgatctggctggatgggaagtttagtctccacccagaagaggagctctgaactcctccacgttaaagaaaaagttaggcggggtaaactgcaactttctttttaacccgaagtgatcaaacctcggggcccctctgcactggttcttggagcatggccaggtgcgggcacctggggtgggaacagtggggggaccagggtgggcccctgggctccgaggccgccccaggcccgcccgcctaccggctctcagagaaagaacagggggccgcgcccgccccacgtccgctccgccccgggccagccccttcctcgctgcgactcgcccgctgtccccaccccctcgcccgcggcgcccagtgggaggcgggggctggcctcgccgagcccagcgccgggctctgatttgctgcgggcgttggggatcgacagcctccgcggctgccttccaggagagagggagggaggaaaagggggaaaaaagtgctccgcgccgaaggcgaggtccgcactctccgtccccgcggctggcgcaggacctcactcgagcggagcgcccacggggagcgggtcgcggggcggcggcggcgaggaggaggcgagaaggagttggaggaggaggaggaggaggcgagggcgagctagcccagcggggtcccggccgccccgcgggccaaagtcgagccctcccgcccgtgggcgagcgcgccagccgccccttccagaacagccgccgccacaaagaagaacggggggtgccgaggtccccatgacctcctaaagtg

SEQ ID NO: 1115 - DNA, 1051 bp, Homo sapiens
gtcacctgactgagtgggaaaaagggtgaaggggttgtgggaggctggggaaggggtcgcaagaagacccatgtagcttttaaccctaatgtggccgagacaagcaccttatttgtgctaacaagaagtgttttgttcattattactgtgattaacattagtattggtgtcgataacaaagctgaaatcacatatttaggatttaggtctgattaaaaaatgttggggtggatgttccaactggatcaggagaaaagaaaatgaaaacagcctggggagagggaagcctgatctgtttcctcactcgcttgctcgtggatgtcattttctgtcttcttgggggcggccaaaaatcgaccggtgtcggggaccagaggcggccccgcacgcccccgcgtgtgcgtccacgggcgtctgtgcagacggacactgtgccggggcgagctgacaggagttcacggctgcgatagaacatggagatgtcatgggcgcgacagagcctggcggggataccagcagcgtgtgtgtgtggacggcaacgttgtctgtgcgcgtgtgtgtgagtgagtgagggagagagagagagaataggtgtgtgtagaggctcccggtgcctctgtctggctgctgaggctgagatgggagcaagtggctggcgaagctggtggtggcttcaaaccacactttcgtagaacaatcgcaagagaaaattgttggggggagggaggaggaggagaaggcggttttccttgtgcccccccttctaacgctgcttttctccttctctctttccccctcatcccgtcttcccctcctcccgtcctccctcgccccgcatgctcccggcttgccgcctgcaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatc

SEQ ID NO: 1116 - DNA, 1034 bp, Homo sapiens
gaatttatcaccagctcctgctccctctaagccagtacccgagctggagccagctcctatgccagctcccgcaccccggccttcctggcctttgcctgtggctgcagagagcaggctgagccagaagcctcatctcctggtgtcccctccaggcctaaggctagagcggtctgcgctgtgcaatgcggaggctgcccagccccaggacagcagcgcggccttcctcccggcccctgcggctcaggcctgtcatcccctgctctggagctcgcgtcctggtccgagtcccggcggctccaccgttcgcagcccggcgaccgcggcgagtcgcttggccgcgaggcctcggtgtcccgccctgcgcggtgaccgaggtcccaggacacagcgcagacagggcgctagtcaggcctggccgcggtaatcccgcctgccgggaccctcgcccgcctcagcactcattaggcgcctggtgtgtacccgcgcccatggccgacaccggcagagcccctggtggggaagggacggagcgcgtcgcgggagccccatgctgcccggggtgggcgctgctcgacagtcacgggagccgccccaatggctgggaccaccgggacccacgggctcgtggagcgtcctcctgacccggcctgggaatcctccgcgaaaacggggagccgcgcgtgtccgtggcgtgcccggcacccggcgggtcggaaacggcgcggccctggctgctggccccgtggggcggtcgcggtgcaggacacgggtcacggcgctgccgctgctctgcgtggcgaacccacacgcccgcccgccagccactgagcagcgcccacgtgcgggcgcggggagctgaacggccggggaccgctggggggcgctgcttgggcggggcggattgactcttgcgggccgccgtacgcgctataaaaggcgcggcgcttcccttctcgtcctctgcgtgcgccggaggctgccgtggcgggtgggccgcctgacttctcctcccggccagttctcgagcgcctcac

SEQ ID NO: 1117 - DNA, 1089 bp, Homo sapiens
tatgaggtggaagagctggagacggccactgagcgctacctgcacgtacgcccccagcctttggctggagaggatccccctgcttaccaggcccgcttgttacaggtatagcctccacccagcctcatctcttaacccaccctacagaagtcacctggtgctgactgtgtctgagctccaggcttccaatatcattaccttctctctccttctgcagaagctgacagaagaggtacccttgggacagagtatcccccgcaggcggaagtagctgagggcaagggtcccgatgagggtcccatggcctgctccctcaggaacagctccagcaccaataaagaggcatcttaccacccaggcttcttggtggtccttcttcctggtgccaccatctaggggcaccagggaaagagcggggtgaacagagctttgctgaaaagggccccctgcaacctagtgcctgaccctccctggactcaggaccaggaaggagttgacaccctggatggtcaagggaggccctccccatccagcagcctggcctgggcttcctccctccctgcctccttttttcctttcatagaatttgactggtatttgaagtcacccaatatgtatcaggtgggcactgtgggggaatgcagatgcacaggtgtacacagcagtccagaggtcccaggcctgactccaggaaactggcctccctggggaagccacggtgtcacccagaggtcagatagaagcaagagtatctgagggaggcaggggaatgagccaggctggagctgagccagcagggcagggcccccctgctgcgacagtggcatcctgatagtgagatgctcagatgctgctgccctctagtggccgccagttccctgcaactcagaccacgtgatttctgggaaaaggccctccctggaggagaactgaaacttagggtggggactgtagaaaggggcggagagatcagccgcccagccaggagttaagctgaggtcgtctgagccctgcgacagcctggacagcaactcaggtaagatcagccaaggatgggagtcagcctgggatctagggctagaaagtcca

SEQ ID NO: 1118 - DNA, 1022 bp, Homo sapiens
ggagacacaggcacagagtaggttagaaaggccttgaatgcaggccgggcgcggtggctcatgcctgtaatcctaacactttgggaggctgaggcagccggatcacctgaggtcaggagttcgagaccagcctggccaacatggcgaaactccatctctactaaaaatacaagaattagccaggcgtggtggcacacacctataattccagctacttgggaggctaaggcacgagaatcgcttgaacccgggaggcagattttgcagtgagccaggatggcgccattgcacattgcactgggcgagcaaaactgtctcaaaaaaaaaaaaaaaaaaaaaaaaaaaaaagccttgaatgctatgctaagcgccatagacttgatcccaaaggcgagtggcagggagtccagaagggcatcagcagaaggtgcagtcagacagacctaagacaaatcccatctctggcttcctcaagacttttgctttagttttatcatctggaaaatggagatgacaataataataacttgttaaagtgttctgagcattaagtgaattcatgtccctaaagagctcagcctagtgcctggcagagagctggcccagcaatggaaatgggtgttgacatccaagagtttttagcaggggaggtcagactgctctaaaaggcacgcccggctgcagagagtgactggctggttttgaggaggctgctgtcctggggaggctgggctctcggagatggtgggggtgatgaacagccacaggcagggtctgaagaagtttaggaggtggcttatgcagacccccgcgactttgaaaattgcttgtgaataatatctaaattcggaattgcttctcagccttttgactgaaatctccagtgtaatctctaaattctgatcttttggtgaccccgggcctagtgccaaaccacccagggctggcttgatgactttctctgttcttctttgcagcacgtccacggacgccatgctggggactctgacacccctgtcttc

SEQ ID NO: 1119 - DNA, 1099 bp, Homo sapiens
ctgcataaaaacccaccactctcattaattacactgtaaccgaacgttgaagtttgcccactcttagacctctccttgccgctttcaggaagggaaatgtcaaactagaacacctgagcctcgcacagctgccagcgaattccggcggcagttcgcgggtaccttcccagcccatcctatctgctccggaccgcgggtgacattcagatttccaacaccgccccgagcttgctttaccagacaccctcaaacgactcggaacgcggttccgcagatgtgattggctgaaaggggacctgccgcgcggcgctctgtaaaagcgcctgcttcctccaaggaggtggagctgaagctggcagggccagggcagggaggggtaattaaattaaaaaaaaaacttggagggaagatgaatcggatcacattaattcaaggagaggtcaaaggccggtacctttgtaacgccggcgagagtaagacttgcggtcgcccatttctgttgggcgcgaggaaacagtaaatcgcggaagggggtagagggggaaggaaagggagcgcgaggcagcatgcggcgcaggagagaggacttggagtcgatggacagggaactcgaattacactgagcgggcgggggagagggccctctgggtcctgcgattggcaggctgagtcgggctgacgtgcggtcacaaccaatggggaggaagggagggacacggcgggggattatggcgtcgtggattggcgggcacagggcggggcgggacggcagtgcgggactgagattgatcgaccgcgggggctgccgcgcagagatatccgggccgccggtgggtggtcgctagggctgggccagcctcttggaggtccacgcccgccgagcccacgctggctggggccggggtgccggcgcgctcgggactcgtctcagcagtcgctcacggtctttgtgtcttctcttccgcccctttccctgcctgccgcctccggccgccacgatgcccctgcgccccgctgctgccgccgcggactggctgcgccggctgcgcgctgcttgctgcggcggtggtggcgccccatctgctacacgggcctgaag

SEQ ID NO: 1120 - DNA, 1076 bp, Homo sapiens
ctctgatccactcagccctcttataacttggacccgtgtctctatgtttgttcacttattttcactgtctctcctcgcgtcgagtctccggtcctcccagtctgtgagtctgtctctctgtctctctctctcttcctcccgccggtccttcgtctctctttgcccttgagtctctggtctctctccgtctctcctcgctgtttctatcgatcggcatctctctgccccagtacccttccccacctcttcatcccacatgccccattgcattttcaacgcccgccgcgtctccgggttacccaggcgatgtcgagtcgtgtccccaggttaccatggagacgttcagggcccgcccctcgcccatgatcacagaggaacgtcatcgcgccgcgcgcgcacgtacacacgaagggcctgctgactacatctgccggaaagcatcgggccaagcctttctccattttgcggtctaggaagtagcagaggccccttcctgtagggagttgccatggagacgcggtggggcaccgacggagttctaatgacggccgtgattggtgcaggatcctgctaatctcaggaaggcccgtagagaagtgaggaaaacgtggtggggggcatgcgcgatctggtaggcggtgctgccgtctgttgtacctgagaggcttgcgcatgccgacgcacggattcgaggcggggagcatgggaagaagcggccaggagtatgacctgatcattgcgaccaccgctaggggaagggaggagagggtgtagaaacggggacgagggtgggggaagggcaaggaggcgctcgagctggtgcgcggagcatcctgggagacgtagtccagcgggagggggaagtcgaagactgcgcgtgctcaggagcgcggagcggcccgctgagcgcagaggtgagggcggggtcctcttaaccgggagggctatcgtgtggacgggggcggtggctgcagactcggggattccggctccccagtgagaccggaagcgcggggaacgaatccgggcagtccttgcgggagcgcccagggctagagcgagaggcttgtcaatca

SEQ ID NO: 1121 - DNA, 1098 bp, Homo sapiens
ccacagggtaggagcagtaagaaggatccagggaaaaaagtccacgaatgagaaaggaaacccagcgtttgtagggctaggagaacaaagaaagaaaatgctggcggcggagggcgaggctctgcggtgcgtggcagatgggaatttgctcggtggcggctcctctttctggagagcttcccagcgtcccctcccccgccagcccgcggtgacgcgcccggcacccaccacagccggctctcggcgccgtcgcgccttcgctcgcccgcttaggccgtgctcgcggtggcgtgggagacagagagcccagggaggaccctggaacatgcagtggtatggaagacgcctaagaaagggcttctctttccactcacgaaaatcagtgtgtgagctcgaagccatttcccagcgtgtccgcctcaactccctcattcaacagatgaggaattcctccagggaaatgcagtgatgcgctcacggctgccggcggcccagcgccaaggggcgctccacagccccgcggcccgaagccctcgactcggctgccacgcaggccccgcggccccgctcggactcccaggatcggcttccgagcgggacagcgctgcagtccacgagtccgggcaggggcgcctccaggccggagcggtttcctgcctcgggcactctgctgtctccacaaacggtttttggaggcacacacacggatactttaaacacgtcggtgatgaatcggtacccagctgccagtggcggagcttcctgggcggggccgcgggcgcgcggcggcttcatttcctcgcgcgcgccggaagtggcctctcaggcgcggcggcgcgcccgggggtgggtggctgaggcggcggcgggcccaaggcgtgaggcgccgcccgggtgtccccgcggcgcaggaggcggtggagcgcagagcgggcgagcgcggtgagtacctggcccggcctcgcccgccggtccgcgactcccgccggctccggcccgggcggtgcgggcgccggggctgcgggctcctgtgtggtcgggtggggtcgcctagcggaccggtcctgcggggggccctgtctctcagggatgagcctg

SEQ ID NO: 1122 - DNA, 917 bp, Homo sapiens
gaattttctggcgtctaaaagcactagtgaggagaggagaaagttttaaaaagtaagattaaagaaaaaagtaactacttgtctgtgtggaagctgaggtggaagaagggcttcatggaaaccctctctgatgaaatcatccctcgtttttgaacagcaattttggcttttccagtttctgtgtgcgctgttggtgcaggtgtgttactcttcttattttgcagatgagcaaactgaggcacataagttacatgagaaagtaggagatagaggactggaacatgatacttcgaataaagaatgtctcagcccctgggcaaccgcagggagtcgctgagaaacaagtttccccgggagtagactcccagctcgctcaaatccttcccattccacatcgtgtctggagggaggaaaaaaaaattcttccctcccagaagcaaagtcccgcaacttcttagtcttccctagagacaggaaaggaaacccagcgggactacaccttccgacgacctttgcgaatcttgcggaacgcaggcgccctgaaacggcgtgtgcactacgattcccggcagccgcgggcgggtgcgggactacatttcccagggggcagaggcaggggcgggagggggcgggccccggcgctgctcccgcccctcccccgtgctcgcggggagaggtaaacaaaccacgcgcgggctgcccgcggcacggcgggcgcggctggcgcggctggggcggcaggggcggcggagagcgcgccgagccgcggccgagctggcccgcccgcccgtcgcacatgttccggaacggcgcccggccgtagccgcctgcggcgcctcctgtcggcccgagaagggagtgcggagaggcgccggtcgccacccgcggtgcccatggagcgggtgaagatgatcaac

SEQ ID NO: 1123 - DNA, 943 bp, Homo sapiens
ctgacacctccagtacttcccagggctggaaagcatccatgattgcggacagcagtggcagtgaaacaatgtcagctggggtaggggttttcagaggcaaaaggtggaattcagctggggaggggggtggttcctgagctgccacttctgcctctcaaattaaagggagccaggtgtggaggcatcctggtgtgagctttgcacagctgaaccaaggctgggcagaggagtgtggagagggatgctgacatctcctcccacttctggaaaataactttgcatttgaagggagaaaggcatgagtaaatctgtaactcggatttggacggcctgggatttcatttgactgtgtgaaggcacacacaggtgcctcgcaagtgtgtgcgtgattacgtatgtatgtgtgtctgtgagtaggagtgtttgtgttgggggtggggggatcttctggttacacactggttcccttcttcccatttggattggggagcttttatttatttatttttaagtcatagcagccaccatgtatggggacctaactatgtgccaggcattgtgctggacactttctgaggcattatttttctgtgaaaaaagtagtttgtttttatgcaggtgcacccagagacatcaggtatttttttccattccggttaaaagacagtgttctactctgtggtaagccttggggagaggcagggaagcctgcggggacgggcaggggcggtccctgcctcgctcgctagtctccaccttttattttgaccggtccgatggcgacaggctcgcactaggacccaggcgccagagtgcctccgtctgtcctgtaggttcattcaatctcccatacacacagactcacagcgagaccgacacacactcccatacactcacacacacaactgcaggcagcgaggctcgggaagtcaggccggctttt

SEQ ID NO: 1124 - DNA, 1053 bp, Homo sapiens
tgagggatgatgagaaggagttctgtaggaaggaaggtgctccaggcagggggcctcggggaacaaggggatgctggaggaggtgcgtggactgggggaattgggggtgtcctacgagccacgctggtatcagaggcgtgtgaaccagagcagttccatactgaataagagctgggcaaaatgaggtcgcgaggaggtgcgtggaaggcgggcctagcgttcagtgggatgcggggaggcgcaggagacgcagccagagaggcgaggggcccaaggaagtgctcaagaggtgtcccccggcagggactacaatgcagattccctggagcaggggcgagccgggcccaaggagcaggaaatgaagaagccaggaatcccagctggtccctgacccggacgcacccaccctgccttccccacagcctggcctctggctctgctcccaacgcagcaagccggggtatctccgacctagccctggccctgcccgccggaaccccgcaaaagctatcactcagccctcggccccgccccggccccaccccggccccaccccgcactctcacaaggtgtcactcagccctcggccccgccccgcccgccccatcctcctctggctccgccccaccagcctcgtgcggtcaccgccccgccggcgcacctgcgctgtcactcagccctcggccccggccccgccccgcctgccccactcgcacacgggctatcactcagcctgcgccccgccctagctcgccagaggctccgccccacccgcctgccaacacgctgtcactcagccttagccctgcccaggccggccctcggcccgtcagaggcctccttcgtgctgtcactcagcccttgccccgccccctccccgcccccctcacacgtgctgtctctgtctctggccctggcccgccccgcgcacttgcgctgtcactcagcctggacgcgcttcttcgggtcgcgggtgcactccggcccggctcccgcctcggccccgatggacgccgcgttcctcctcgtcctcgggctgttggcccaggtaag

SEQ ID NO: 1125 - DNA, 1066 bp, Homo sapiens
ggaaaaggaagaggggttaggattattgggtcagctgtgactacggatcctgtccttatttttaaaaacattttgatcatagactttttgcattacttttgaccttttaaaacgttgcagtattatatttatcttgattactgagtgttttggagcccccttaaattctgaacccgaggggagtacctcaactctggtcccggctcggctggctgcacgggggtcggacgctctgtccttagtaccatacgtaagccactgccccgccccgcttttcttcacctatgtaatgggaaaggaggtgaggtgggacgagctttccagggtttaatattctccctggcccggcaaagacggggatttgaggggttacatcggcacaacacccggggtcgaagaaggaggctgctgggctccgggaaggagctccctcgccccagacttccgcactctggttatttcccaacggcgggaaggctcgcttggagccggactcgtgattggctaggacgaagtcacgtgggaggattcgcaatcaaatggcaagggcgtctgcgtcatcagtgagcgacgagagcctcccgagaggggcgcggctaagtaaaataagctcctttcttagtggctgtttccttggggagggactgaaacagcgatggggattcgctctcttccaaccctaggcttccgggatttggagggaaggtgaggcctggggagaaatgtattaaatcgcgtataccccggatgctccgaggggcggggcttcgacggtggggcgtagttaagggcgggtctctcttttgggggcgggattctctcgggagtcggggtggagccgcaaggctccgctttcccggagcgcagggggcggggtttggggcggggcctcgcttgtgggcgggcccgggcaggagcgggcttgccctgcggagcagtagctaggaacagatccacttgcaggttgctgttcccagccatggcttcgcgctgctggcgctggtggggctggtcggcgtggcctcggacccggctgcctcccgccgggagcaccccgagtaggagc

SEQ ID NO: 1126 - DNA, 989 bp, Homo sapiens
acctcatttatcgcaaagagcagaggccaggaaaaggatgaataatcaatgaccttaaaactcaggtgagaataaaaaccagttctgagaaaccgtgtgacatttacatcctggtacctgagctttagatcactctgcatgtgtatttcctctgcacaaagcccaggaggctacttttatattattggggcaaatctcccaacagccctgggtactaaacagccttcagcaggtgcttccaaattttcttatttgcttcaactcccaggttgccaggggaagcttggccgacaagtctatactcctgggcagactgagcaacagcaggtggtggcttctggataagaggtgctctaggtcggaaggaaataaatgagactacgatcagttaaagttcggtaaagcaagagacgccttcaacccgacgaccagacggtggctccgcagcacagactctctcggatggtggaattcccaaccggcttcgatgtagccccgcccctacccagaccacgcccaccaatcaccgccctctcccccccaggccccgcctggagcccgcccctcctaaagcatgctccacctgactccgacactgccgggcttagtccgccgggcttagtccgtggagcgcttgcgcatttcttgagttgtcgtggcactgcccaaatctgaatgggggaaagagggaacttcatatttcctacagactccgccacagcgactttgcgtgctctcttagagctggttttgcctttcgtggtcctgagaaccctggcttttggttccccaatgcggcttaagtgtgcaggttttaagttaggcgatcttcgggcagccctagtcccagcaccgggtccttgcgctgagtctcgggaccacagccggggaggcggggtccttctctggggcggtcgcgttggcagcggatgcgggaagccggactctgggcgtcatgtactacaagtttagtggcttcacgcagaagt

SEQ ID NO: 1127 - DNA, 700 bp, Homo sapiens
ccacatctctgaggggctgaactgccccccaccttctggaagctgggaggttggaagaggggatgcgtgcgatggactcagcacacagctgggaactcgaggcacacctaagccttcgcttgtgctgtgcggagtccacacttccttccccactggggtctcaaaacctcccctcactcaacagggtggtgctgctcaaagctctgggcacacattagggctggggagggggtggtggagagggggctccagcctgcccaaccaccaggcaacggggcacctgcccctctctcagctgggtctggacccgcgtcccaggctcaggctgcaatgcctttctctttctctttctcttctttttgcagttccgttgggtcctgcccaggacagataaagacagagcagcctgtctttatcggaggttcctctgccagtaggaggggcccggagaaaaccagaaagagggccagagccagagaaacatgaagcaccccggggcctcccacaccagtgcctgagcaggaatggggaggggccatgattcacaaggccctgggaggtcactttaaagagggctgctcaactgcaaggacgctgtaagcaggaagagaagccacagcgcttcagaaaagagtgggacagggacaagcatatctaagaggctgaacatgaatccacagatcaggtacctctgcacgct

SEQ ID NO: 1128 - DNA, 900 bp, Homo sapiens
aagcacttaccagcaatttgagctccttctcttttggtctaggtggctctaaaataacaataaaggctacagtgattgaaattcaccagacttgaaatagactgcagccttcttccttcccaccttcttagaatctttgtcctattcatcttccttacgcttccccgggttctcttacttctggattctaacagtgagttgtgagaagcaacgcggaaaacggaatggagactccagcttgttttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcggagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggtagcaaag

SEQ ID NO: 1129 - DNA, 984 bp, Homo sapiens
agtaggggttgagtttgcctttctcatcaattaaaagtgaattgcagctgggtgtcgtggctcacacctatagtaccaacactttgggaagccaaggcaggagggttgcttgaggccaggagttcgagaccagcctatgcaacacaatgagaccccatctctacaaaaaaattagatgagtatgatggcatgcgcctctgaagtgagaggatggcttgagcccaggagttagaggctgcagttaactatgatcccaccactgtactccagcctgggtgacagagcaagaacctgtctcttagaagaaaaaaaaaactaaattgccagtgtagaggaaaagtcctttatcgtctctttctttactgtttttaatgatttgacattcattacaagttttaaaaagtagatgtgctaatctcttcagatataatatgtttagctgtttcttgtgacagcagtggattgttgacagagcttcttcctcagtgtattagagtaaaacttgatgagaatttttattacttgcagggagtggtgaacattttggtttatctacatatgcttgtgattaataagagtgatagttacatacagatattttaaatttttgaatatttccccattaatttaacttgctttagttggtctttctgaatgccattatttcccaacattacttttaaaagatacttaatatagttcacaagttgaggttttggggaactactaatcatgatcatgttagatttagttttctgttgagtttggttttcttttttgttgccagagtgttgaaattttactttataaaatattatttagatagacataaatccccatgtatgctaaatttaaaataatgaatttcttctttagcttcaaaagcagtggactgtcttttggattcaaagtgggcaaaggccaagaaaggagaggaagctttatttacaaccagggagtctgtggttgactactgcaacaggt

SEQ ID NO: 1130 - DNA, 1083 bp, Homo sapiens
ggcttccttcctaaacacctttcatctctttattttattcttttcctacaccatgatcttatgaatacttaaattcccaactgattgctatgtgtattgaagcataatatcacaaagtacataaatcagaagtgtatatccatgtaagtgtacacccagatggaaaaaagaagtaatttttttcagtgacattattgcattgtgacctcaagttcagagcaacattctgtgcccctagaataccgtgatagctgctaaactagtcaggaattttttgttttcaggcatgcagtggtgtaattatagctcactgcagcctcgagctcctgggctcaagtgatcctcccaagtagcttggattagaggtttagccaccacgcccagcactaatcaggatttaaatattaatatttaaggtgtatgaaatgtgcagataataaaactgttttcccagctttttattaacaaatactcccttctgaggcagtgtttgaattactcaattagagaaatttttctccccacagctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcattt

SEQ ID NO: 1131 - DNA, 922 bp, Homo sapiens
aataaaattgcgatatttgccccaaatagtaacagtacaattttcatcagttctctagaaaattatctgcaattaaaaaaaaaagaattctgatgtgttaactcaaattaatcagtattttctttgtacactcagattgcaacctaagtattagtctgttgaatttggtttagtggatatttattcaggatttttacaaaaacaaggaaacagagaagaggaatagtgctgtgcagatgacctcggggttcaggcgacactcaaatgcctgcttctcctctgaggttattaccatctcttacttgtttgacgtttagagatactacaagagatagttgaaaagcagaggttgcatttccagtggtgttttgctctgctggtatttgctcctccgtgctgctgtgcaaagggccagaactgcatcgaatggatcttttcttcaggttgtgcaggctggctgccttgatgtcgtagttgctgatgttggctgccgacgaaccttattcctttacatttgcctggtcctcatttcaccggaaaacacagtagctgtagctgcacatagacgcttcctctttctgtttccccctcatccccctccctagacctctctgggctttgacgtcatgtgtgctcctttcggttgccatagcaaccccattccccaagccctctgtccgtctcctctggtaggttccacaatggtacaggcagcatcacgctgcacaatggtttccaggcagtgaaagagggtgattcagcaagccactcttcttctattttctttaacctccccttcactttttatttttatgggggtgggtggtgcttgctatatgcttacctttttcttttcttttttcatttttacaaatttccttttttgtcctcacccctcaattcctaggggcttgagtgagtt

SEQ ID NO: 1132 - DNA, 1016 bp, Homo sapiens
gaaagccgagctgtagtgattgttatctctcttctgaatctagccacccagcaagtctaacaggctctgggctggtactgggggttgtctgcacagagtcctgtgatgtgaaccatctgtgggtctcttagctgtggataccagtacttcctccagtggaggtggcagactggtgaaaaggactctgtgagggtccttagctttgattgattaatgcacaatttttgtgctggttggcctcctgccgggaggtggtgctttcaagagagcatcagctgtggtagtatggggaggaacaggcagtgggtagggccttggaactcccaagggtatatgccctttgtcttcagttaccaggatggcttgggaaggaccattaggtgggggcagggctaggcatgtctgagctcagactctacttgggtgggtcttgctgtggctgctgtggtgggggtggggtgggggggtgggggtgaggttcccaggtcaatagagttatgttcctaggaggattatgtctgcctttgctgtgtcatgcagcttgacagggaagtgcgggcaagctggcagtcacaggcctcacccagttcccacacaacgcaaacagctggtctcactcccattgtgcccccagcagcagcaccaaggctgtctccaggcagtgggcaagcaggaccgagtactttccccaggctacccgcctcccagctgtgaaaataaacagggctctccttcttccctgctctgttgagtctgcacactggattcatgccctccccctgagttctggccaagagacttctccatcagttgaaattgttacaaagttcagctggagttttccttctccctgcagctttcccagtgcctccagcagccctcctcaaggacccctgtgaggccaggcagaaatggcgtggcaggggacccagcgagcccagagggattttgccgctgcttcctctacccctgtatttcacgcagctctctaaattgactcagctccaggtaaggtc

SEQ ID NO: 1133 - DNA, 1071 bp, Homo sapiens
ggttcctcatatggtctgtctggagactttttgcaataaatggtgtccgtgccatccagagaacataggtcaccagttaatcaagacagtagggaataatgatttacacatgttgacaaattgattcctcttaataaccaggtcaattttttggccaacactatacacatgtacactatgcacataattacgacatctataaaagatagaattaatctaattttatgcagatatgggaagaactcgtcccaagtctcacagtcagtaagtgatggagcctagagttgaactgtttcacttcactaccatgttaatacttttctcaacacattctgccgctctcactctaagtgtgaggccctgtccaactaaaacataatatggtgagttcgtcattgattcaaataatcaactttcttcccgaatcccaagtttatctcttctgattaggaaaaaaaatgcattttgatatgtcgcgtttgcgtaaagcgaggccgaccgcacgcccccttctcgcgagctgctcccctcaactgcgacccaatcacccttgcacacgcctcctgagcccccgcggttcccaccgggcttcaggccacgcctccgccgctgcaccgcctcctctccccgccttcgcccgtagtctataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgc

SEQ ID NO: 1134 - DNA, 912 bp, Homo sapiens
cttacaaccacacgttctcctccaactagcatcccttccagggtgcactaggatgcctctcagaggttctcccccgcctcccgaaggaaaggggaaaaccccgtgggcgtccggagagcctttgcgcctcgccaggtggagggaccggcgccacccagacccgcgagccgagaccctccccgcggcgtcgctgcgggaggggcggaagagcgcgggcggtgggcgggagcggtgctgcgaggcgggatctgcggggcgtccaatccccttcttcccccgcccgccccctccccgccccccgaacgctttccaccaactgcgcgcggcagtgggcggggcccgtcacggctgtcgtcttgggtgcgatttttttctcctcctttttttaccctcccgtttttttcttttcttttttttttccctatcctttttttgtgaatgaaaaaaggaggtcgcgagcggtacctgggactgcagcgccaggcgtcttcgcggcagcgccttcgccgcgggcccgggcgcgtagcggcggcggcctcgcccctctcccggcgcccctgcgcgccgcccgctgcctccgcagcccggctccgcgcgccgccgtgacattgggcgcctggcgcgcggggcgatgctgatccggaaggggcagcggctgcagtgcagcgcgcgcgtccgctcctgggcccacgtccggcctgggctgccctgccggagtttctgagtggccgcgagctggccgggaggctggagcccagcagcagcgcggcggcgccggcgtcgtcccaacttgcaggcgcggagggacccctgacatttcactaaaatgagcgtgctcagcaggaagagatgtgttcctcacgctagaagccaccccgtcacatgtagtggtgtaagtagatggctgcttgc

SEQ ID NO: 1135 - DNA, 903 bp, Homo sapiens
ggaacatgcaggccaatagttacgcacaaacagagcagcagagcaggacggtgctaaggttggaaagggtgagtcatgaaagttcaggaaatcagaataggaaggggtgagaatcctctcatctgggcttgtggggcaggagagaagagcccagtgggcaaggtccagtgagtgtgcttagaactgggaagatgaggggaagggtaagcgctgggcggcggtgggcaagatggacgagattaaacgggagcgaggatttcagcgagagctttggcgacacggaaggctgagaatcggagggagcctgtcgggcgaaagcgaaggcggctgctgggcaggcagccgaatccggctggagagccgagctggtgagacctacaggaagtgaagggagtcgctcagggcgtggcgcaacgagactcttagaagaaactctgaggcagagatggggggcctccgcccatacggagacacaaggaagtccacatgcacacgcacgagcgcgcacatgaacacgcacaagcacacaaacgcctcctccgggcagggcacacgcgcccgctgcacaggccgaggccctggactcggaggggactgcagagccgacccacaacccgggccccgatgcccctcccggccgcgcccctacgactgcttgcgcaacaggcggcggctccagtgggcgcccgccgcgcgctgccggagcccagcccagcccggcgcgcccgggaggagggagcagggagcggggaaggggtgtgtcccggctgcgtgctgggactgcgagggtctgggaggggcgaggcgcgggggcggggccgcggcgcctataaagtcgccctccgcccggacgtaaacaaacctcgcctggctcccagctggtgctgaagctcgtcagttcac

SEQ ID NO: 1136 - DNA, 1009 bp, Homo sapiens
tttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcctcctctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacaggtaagaccttactgggctaaagatgcccagttgaaagttga

SEQ ID NO: 1137 - DNA, 913 bp, Homo sapiens
caggtggccacaagtgtgtattatgtaatagaaagaggaagcaatttattgaaatggcaaatgagagacagtgctctgctagtaggaggtggacgagtatggagatgttaaaaggggtgcaggtgaggagagcatcagggaagtcttcctggaggagggataccagaacagactttggatttgttcattagagaacaaaatgctgatcagagtcccagcagaggaaacagcatgaataaaattgccaatgggataatgcaccgtacagggtacagagatgttttctgtatgcagtggggtgctcaagaaaggttgtagagatagatgaggctaaggagtaggttgtgtcttggaggctatattgggaacttgaactttgtctttcatacatggggagaccctttattattctaagaggggaagagcaggaaaccatcactaatgtgtgctactggctgggctctgtgagaactccttgggagagacagcattaagaaaaaggaaaacattgctaagtagcaacttgaacttagtaaggtatgaagaaggttctctaagcctctggagataacgatactacctacctctgtgttcataagaagcctaacaactttggcaagtctctaaaactctcgagaacttaattttatgatctgtaaaatggaatcatcttacttataatattattgggggaattcaataaggtagtatttttaaagtgcttagcaaaatgcctggcactcatagtagctctaaattatttggagagggcctgttatctttttgggggcatgataacagccaaggttctttttctgtttcagagcctacttggatgttaatgagctgaagaacattcttaaattggatggatcaacacatctcaatattttctttgcaaaatcctcagagg

SEQ ID NO: 1138 - DNA, 1161 bp, Homo sapiens
tggcttaaaacaacacagcttcattctctgacagttctggtggatgaagcctgaaatgggtctcacagggctaaaatcaaagtgtcgggagggctgcgttctgtctgaacgcagagagtttgtttcgtccccttttccagtttctagaggcccctggtattccttgggccatgatctctccttcatcttcaaggccagcaggttagcgtctctcctgtctgacccctattctgtcctttcatctcctctcttaatgctgcctctgtttttatatcttttctctaattttactgcctccctcttggaagggcccctctgtatactctgggctcacccagataaactaggataatttctcccatctcaaatccttacgaaatcccatgtgaaaagtcccttttgccacatagtcacagtcacgggttctagggattgggacatggatgtctttaggggtggagggcgtccttcagcctgccacagatggcaaagtcatgccattgtggctgcagctccattgtccaggctgagtgtgggggcgcatggcgtggttctcatgcccaccacctaccctgaccctgcggaggtgggcaggaggcagcgataatcaccacgtgcagaggtcctgccaggtgcccagcctcatcattccctagaaggcaggcaccaccacatgctcccacactgtagataaggaaacagctttgaaacagatttgaaagtgtttgaggatttgcctggaaggagggctccagagccagggactgggtccgggacacccggagactctctgcttcttggagctccggcaactgcttgtctttctcttcacaggagaagggggccctgctgccgctgccgtggggcggggcgtgggcggtgctggctgcaggaaggctctcccctcccactttgtgctttccctgcaggctgctcctctgtcgagctgatcacacccacagttgagctgcgctggccagagatgcctgcccacagcctggtgatgagcagcccggccctcccggccttcctgctctgcagcacgctgctggtcatcaagatgtacgtggtggccatcatcacgggccaagtgaggctgcggaagaaggtatgtgcctccctgggggtccccggcctgggtcatacttgcttctctccacg

SEQ ID NO: 1139 - DNA, 911 bp, Homo sapiens
cagccggtaggatctatttctgaagacaatgtggaagcagagtgtgggccctccacaggtgtagcgaggcggcgtgctaccgcgaagaaggagggaagacgcctgagcccagccggtgccctgctgcccctctgcctcttcggccactggggctgagcttcagccttaccaatccccgccgcgcacgcgcgctcgcttcccgcgcgcaacctcccacccccgccctcactgcacctgccaggtcataaacctcttcccacccactctcactctctacccaaggctcaggcttgtctcacgttgattggccagagcccacgagggcacgtccaatcagcaatcccccctgcgcaacctatcccggttcttcccgcccccgccccgccccgcccgcccccccgggtacctaccgtctctgtgactggtgcgcggccaggtcactcagggcggcggggcgaggtgtgcgggagtgggcaggacgggtgggaggaggggaggggtgggagaaggcggggctcaggtgcctggcagcgcggccggggcccaggaaggggagggggcgaacgctggagcgaggcgggggcgggtgaggagggggtgacgccggacgcgtcgacagcgcgagggttcgcgcgtgagctgcgcgggtcgggcctggtaccgagctttcctgggggctagcaggtcgtggacgccggctcctggaggagagccggtaggagggagtgtgaaggtgtccgcggcgtcgtcgacggcggcgccggccatggaggagacgcagccgccgccgcagcctaagctgcccctgtgcgacagcctcatgatctgggtgagtgcgaggaggcgagagggcgagggggccagggggccgaggcgaggagcctggggcgcccggttctcccaggtgagct

SEQ ID NO: 1140 - DNA, 1001 bp, Homo sapiens
gagatcttgttaagccgtcttgcgtccctgttctctaacccagggcgagacttccaaccctccagggaggcgaggcaatcgaagcagacaagacggccacctcacctcttccggggactcgcaggcccgctccctggccatgtcagagcctgatggaccaggctggaggggacgcagccggctcccccgggagcctcccagccagaacccccgcgccccacggtccctttccactgcccccaccccttcgaaacgccaccgccaccaccctccttactcctgaatcccctctcctcaggagtaccccagtggagttaccggcccactcaaaagtaagagcgacggccacccctctcggtcaccctggccccactgtcaccgccctgctcccggcctctgcctacgccgctggctggctccggtgacgcccgggtcggtaccttgcggacccccttgtagatatagaagtacagctcccggcccacattgaagcagaggcggtcgccgttgccagactggtcgttgaggtttacgaaggagacgcggacagggttggatccctgcgagttgaagggcacccggttgggccggctgtactccgagtgcggcagcagcttgtacagaccttcccgggtggtgaattgggtcttaatctcgttcatctccttccctcctccctccgtcgccatcttggaaagcagcgttcatcctgccctaagtgcccggatcacgcccaccgcgcaggcgctgttcctggtgctccctcttcccccaccccctgcctcttccttctcgcccctcccacccgcgggccagccctgcgagggcgggccaaagggaaggggtgggcttgtttacggcccgactgcgcaggcgtgctcacctggcgtgctccacccgactgggcgtccgcaggctcctcccccgggtgtggcctccgggcggcatggctgcttcccaggtgatgccggcttcagctagtggggtctagttgaccgttc

SEQ ID NO: 1141 - DNA, 904 bp, Homo sapiens
aaatctcactgacctgccttgagtttaacatgccccccactgacaatccctctagatacctgagttctgagttctaggcctggctcggcctcaggcttattctgggacccaggcacatttctgcttctctggcctcactttttcttatctgtataatggagggttaggagtcaaggatctgaagatgccaggcaggacagcggggaaatggaacacgccccttgccagtgacactcggagggcgcaagagtcagtgtcgggctcatcgtgagcaggttctttctgcccccagttcagcaacccgtctgaacagatctggcgtcctggagaattctagaatgaaggggaagagaggcagggaagagctgggaaatacgcaaagcgcctttttctccactttcggagatggtacgtgcgcgcttccacgcagtggcggctgctgcggcgagcacgtcccctgcgggacccacgcggggagtgggctggcagtgcgcgcacagcggcggcgagtgggtcgtgcacgcggatgcggggtgggagtgggggcgcacgcgcgggcgtgggcgagcgggccccggcagtgcacacacacggcaggggcgggcgacagatgcagtgcgtgcgccggagcccaagcgcacaaacggaaagagcgggcgcggtgcgcaggggcgggcgcccagcgggcttggcatgcgcgcccccgcccgaggctataaaagcatcgccacctgctgccactagccaagccgcgcgtccagttgcttggagaagcccgttcaccgcctccagctgctgctctcctcgacatggaccctgagacctgcccctgcccttctggtgagcccccgcccccgctcgcatcctgcgcactgcgcgcccttgtacctgcaaagaaacccac

SEQ ID NO: 1142 - DNA, 948 bp, Homo sapiens
ggtttaaaaagccctggagaagagagacgtgaacagaagcaatattatccactaacaacctaactcccgcttagacatcagctgagagatcagcagcatcattgaacaggggggtttgtcttaagataatgactcatcttgatttctttcaggatataaaacttgtatttaaatcaattcagagaagcacttgagctttaaacattagagagcagggagagcctatttaataaacagcattatttcattttcaaagaatgatactggcagtagctctaagtttaaattttgtattattttcctcaattataattatagatgggtctgaaaggaagcatgcttattactgtcatatttattcttttgacaggtgttatgggactgtaatttggtgaaatgattcaaaacgcagattcctatccaaacacaattcttgtcatcaacacgagaggttcaggaaaagtcctccagcaagcctttcagagatcttgaacaccccatattcatagcacaatccatattcaggaataaggaggagagagtgcctttagggcttatatccggcgtagcaacagccagaaggcagagtgggtgtttgaggtaacaggtaacgaaggctgttagtggggacagctttcaactgggtggggtcggatctaggaagaggcacccagtaggaccccgagtcccgcgcgcggccggcagagggcgctgggctcaccgtcgccgggcaggggcggtgccgctcagtccccggggcgcaggcgcactcgtcgccgcggcggcgtccggggctggcgttcccctggaggctggtgagccgcgctgcgcaggccgaggccgagggcgggggcgcgggggcagcggcggccggagccactgggtggcgggggcgggctagggatgtggaggcctcgggtgtcctcggatctattgaagacctagggg

SEQ ID NO: 1143 - DNA, 1025 bp, Homo sapiens
tgacttagccatttgttctgggtatgaattccctaagatttctctaaaggagtttctatacctgcctctttacttgtaagaaaatgaagatctgcataaaccaggcagacagtgttatgaaggttaatgccatgggttttaaagtacattttgaaaagcattcttcctttccaaccaccaacaaagggattccaaattacacctcttcctaaacgatgcaacatgagtgagcacataggcgagaggtcgcaggggatgataagagggttctagccctggagcctggctttccagagaggctgtggccaaggttttacgctcccatttggcctcctgttcatatgaaggaaggcccaggaccatgagttctcagatccgcgggctctgagcaaaccgggtgcaccctgactcggcttcatcctctctaactccacggtggcgacttgcatgggagagaggagcaaccaacaacaccttcgggctggttagggggtttaggagacattggttttgtacagacatgacttgatgctggattcccactttcagaagacaaactattcagttctgcaaactccacaatctagaataaggaattagataaccaaccccctccttcacttaacagttaaaaatcatacaggactctgaaaacaaaacaaaacaaaaacttaacctttcttagatcctaaaagcgttccttggatggaaaaccaactcttccactggctaaagatcaaaagcatctttttctctttaatggggccacagttgggcaaaacgcccatcactttaaaaccacctctcggctggaagtacgtaatttttagcgagtcacagaaaaatagggaaacttatgcggcgtttccttggccacttccccatctgggtgatcatgtactcagacccagcactgcagcctgggggtgctccccgtgaggaggaaaaggtgtgtccgctgccacccagtgtgagcgggtgacaccacccggttaggaaatcccagctcccaagagggtataaat

SEQ ID NO: 1144 - DNA, 1086 bp, Homo sapiens
cagtcacttgctgaagactagcgaagtggagggggaaagcccgagggagctgcagactcgaccactgcgccctcccctcctctccctgcaaggagcccaaggtgtgatcctgccaggcgttcgttcgctgcatgaccttggccatccttccattcccctgggtgtgaattctcattggcaaagtgagctggtgggcataagtgggttttaagtttaaaaatttaaaaaccctgtctgcccccaagtgtggtatcaagattttatagtatgacacttaaattgcttttttcatccgggcgcgtaacagcaacaatgaaaccagcagataacgcgtgagtagtatcagctctgggcctggcactattttatatgtattagctcattttttttaaaaaactgttttcaaccactccatgagatgagtgctcttatgatccctttttcacagaagaggaaacggaggtacaaagaaattagtgcacaaagccagtcggagagagcccctggccaggcaccaagctccagaggtcgctctggcgagcgtttgcttcgggatctgatgccctggagtcgccaactcaattcgcgggtcgcagccaggctccatgggggtagtagagccaggtcgtagtggctaggtgagttgtctcaactaactctagtggagccgccgcagccctggaggagccgggccgcgactcgagagcgcccggcagctctccaatgctttggaaccggcgggacccctgcgggctacccggggcagggcggtgtccgcaggggtctgtccagccgcgcctgctcctccgggtggagagttgggacacccggccagctcgctcgcagcccgcggactggcccagccgagccgtctccgcccgttccccgcccccgcagcggcggggctagagccagagccgcgcccggcagttcccggccgcgagggcgggcgcagcttgtggccggcggccggagccgactcggagcgcgcggcgccggccgggaggagccggagagcggccgggccgggcggtgggggcgccggcctgccccgcgcgccccagggagcggcaggaatgtgacaat

SEQ ID NO: 1145 - DNA, 1005 bp, Homo sapiens
actagtgtctcactgggctctgcagggcagctcctacggtccctcaggcttggagggtcactttaaacaataaaaagcaacaggacacaaaaatccctggctggaaaaatccaaaaagcaggtctgttagcagggcaggcccggagtgacttcccctttctctaacattcccacgtggtcctgcacaccacacatccccccgaccctggggagtcctgggccccttcctggtggagcagcctctctcttgcagggaaaggccctggggtaccccaaggcctccaacagggagcctgttggagaagtcaccaaggccctctgagtctggggctccacagaccctcccccaggcctcctgcaactctccagctctgagagtctgatcccagcccaaggaccaagtgggaccctcccctgtgactctaccacaccctcaccaggtcaagccctactccagggagaggcttatcctcctggtctggacccccaacccagtcttgaagcgggatctctcaccgctatctggagcccctcatcacagcacagatcttcaacctcagctttccacaaggagtctggggaccccaccccggtccaaagatccccacccaaggtccgaattccccagttcccatccagattccccaccccaagtccggagactcccacccaacgtcagatcacttcacagcggtccgaattccccacaccctatcccagtgttccaccctaggtctgaaggcccccgccccgaatccggccgcattcggccccggtctagccagcgctctcacctctcccgcgacggcccgcccgggactggacccgccccggtccggcgcaggcagcgcggcgggcagccctagctgccccagaagccccacgacgatggcggcaatggcggtggcgctgcggggattaggagggcgcttccggtggcggacgcaggccgtggcgggcggggtgcggggcgcggcgcggggcgcagcaggtaggatggggtcg

SEQ ID NO: 1146 - DNA, 942 bp, Homo sapiens
atagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgcc

SEQ ID NO: 1147 - DNA, 996 bp, Homo sapiens
caaacttggtgccaaattcttctcccctgggaagcatccctggacacttcccaaaggaccccagtcactccagcctgttggctgccgctcactttgatgtctgcaggccagatgagggctccagatggcacattgtcagagggacacactgtggcccctgtgcccagccctgggctctctgtacatgaagcaactccagtcccaaatatgtagctgtttgggaggtcagaaatagggggtccaggagcaaactccccccaccccctttccaaagcccattccctctttagccagagccggggtgtgcagacggcagtcactagggggcgctcggccaccacagggaagctgggtgaatggagcgagcagcgtcttcgagagtgaggacgtgtgtgtctgtgtgggtgagtgagtgtgtgcgtgtggggttgagggcgttggagcggggagaaggccaggggtcactccaggattccaatagatctgtgtgtccctctccccacccgtccctgtccggctctccgccttcccctgcccccttcaatattcctagcaaagagggaacggctctcaggccctgtccgcacgtaacctcactttcctgctccctcctcgccaatgccccgcgggcgcgtgtctctggacagagtttccgggggcggatgggtaattttcaggctgtgaaccttggtgggggtcgagcttccccttcattgcggcgggctgcgggccaggcttcactgagcgtccgcagagcccgggcccgagccgcgtgtggaagggctgaggctcgcctgtccccgccccccggggcgggccgggggcggggtcccggcggggcggagccatgcgccccccccttttttttttaaaagtcggctggtagcggggaggatcgcggaggcttggggcagccgggtagctcggaggtcgtggcgctgggggctagcaccagcgctctgtcgggaggcgcagcggttaggtggaccggtcagc

SEQ ID NO: 1148 - DNA, 1024 bp, Homo sapiens
ctcactcaatggaagctggatttcctctcctgtaaaatgaggtaggccctctcggctcaaggtcactccctgtgattctacacagagagggagtgggaagagagggcgctcggcagcagaggaggaggaggaaggagggaagggcgaaggcgggagtgggtgcagaagcggggggtctggcggtccaggggggtagaagggaggggcggattcgagtgggcgccaggtggaggtggggccagggttgtcaagggagcacgaaaggggtcgcggtgtgtccggcaaggactgggtagggcagcgcctgctatggactaggggcgagggctacgaaagggttgttggaggggtggatgcgggtggatcccgaaaccaagcggctccgaggggcgactagaggtggggagggggcgcgcaggagttgccaaggtcggacagaggggagcgcggtctatccggctgggaatgggccggacagggcgcggggttccggggtcgcggagaggcgcggaggtagatctgagccgagtggagggcgcgtgggggtgggtgcagaggggcgccgaagggatccgggcccagcggccggtggagaggggccgcggagaggcgcaggtgggagctgggcggccgagcgagcgcagagggggcgcggcttgcgcggcttgcgcggctgggcgggaacaggcgctcggtcgggggcggggggtgcgccggggtagccgagaggcggacgcaacagcggggtcccgcgctgtctgggcggccccaggggctgtcggctcacttccgggaacgccggggaaccgcagtagccgcctgctagtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctg

SEQ ID NO: 1149 - DNA, 1086 bp, Homo sapiens
gtctctggtcactacctccctcatcagctttgcgcctccactgtcaccctcaggaatgttccacatactcagcgagtatgcttggggggcaaaagggtgaaagatacaaaagcttctgatatctatttaactgatttcacccaaatgctttgaacctgggaatgtacctctccccctcccccacccccaacaggagtgagacaagggccagggctattgcccctgctgactcaatattggctaatcactgcctagaactgataaggtgatcaaatgaccaggtgccttcaacctttaccctggtagaagcctcttattcacctcttttcctgccagagccctccattgggaggggacgggcggaagctgttttctgaatttgttttactgggggtagggtatgttcagtgatcagcatccaggtcattctgggctctcctgttttctccccgtctcattacacattaactcaaaaacggacaagatcatttacacttgccctcttacccgaccctcattcccctaacccccatagccctcaaccctgtccctgatttcaattcctttctcctttcttctgctccccaatatctctctgccaagttgcagtaaagtgggataaggttgagagatgagatctacccataatggaataaagacaccatgagctttccatggtatgatgggttgatggtattccatgggttgatatgtcagagctttccagagaaataacttggaatcctgcttcctgttgcactcaagtccaaggacctcagatctcaaaagaatgaacctcaaatatacctgaagtgtacccccttagcctccactaagagctgtaccccctgcctctcaccccatcaccatgagtcttccatgtgcttgtcctctcctcccccatttctccaacttgtttatcctcacataatccctgccccactgggcccatccatagtccctgtcacctgacagggggtgggtaaacagacaggtatatagccccttcctctccagccagggcaggcacagacaccaaggacagagacgctggctaggtaagataaggaggcaagatgtgtgagc

SEQ ID NO: 1150 - DNA, 1099 bp, Homo sapiens
gaaatcccaaattttgctactcagaagtaactcaaacatttcgatgaataaacttctaaacgtctatatatattcatatgataccaacacttgtttttttttttgagacagagtctcagtctgtcgcccaggctggagtacagtagagtggtctcggctcactgcaacctctgccgccctggttcaagcagttctcttgcttcagcctcccgagcagctgggattacaggcacctgccactgcatctggctaattttgtatttttagtagagacagggtttcaccatcttggccaggctggtcttgaattcctgacctcgtgatccacccgcctcggcctcccaaagtgctgggattacaggcatgagccactgcgcccggcccccacgttatgtgttgtatgtgggatcatgtttctgttttttttttttttttttttcagcaacagtattatgaacatctttccatgtcaatacatggagatatgtgtcataattttgaatggctgcataatattccattttatatacataccctaatttttaaaatctatattcagaatgatggacatttaggttgcgttcatcactgaaacatcctccattaattcttttttctttttattttttactctagcctcccaatgtgctgggattataggcttgagctaccacacctgattggaaactcattaattctccttgtggatatttttacatatgtatttgaatgtctccttgaagtaaatccttagaaatgggatttctgggttagagagaaagcttattttaaacaattccatatcttactgctttccagaaaaattgcattcattttctagtttccccaattagtgcataagaatggccattttctcatacctttccaagcactgggttttgtccatttaaaaatttttgccaaggaaaaaaaatcagttttgttctttttacgtttcttgtttattagtgagattatgtatcttttcatatttttattggcctgacaaatattttggtgttttggctgtagctcatggttgacagctcagagagagaaagatctgagggaagatggatgcaaaagctcgaaattgttt

SEQ ID NO: 1151 - DNA, 1093 bp, Homo sapiens
actcatccttgttgtcttgctccagaatcatatccttgacagcagcctctccacttttcttccattggaattactggttacccatcttcttgctgggtctgttttatttttactccttttacaaatttcagcacagagattacaggacttcagcccacagggtggagaaggaagctggagttagtgggttcggacactagtgggaacatggggagtgacaccatagtgtgctgtagtgcagtgcccctgttccagaggagagccagagctctacctgagccagcactgttagctgaggtgggagggcatctccccgggctgccttgggactggtttcaattccctaatgccaaaacctgcctgcctactagaaggggctcaggcaggcatccagggctcggtatccaggctggaagcaccagccagaggagacaggacctggcctcttcttgctttcccaggtccagtggccatcctcttctctattgcagagaccttggcccagcctgctgatcagaaaagaatgtcttacagaggatctcacggctggttaaagccgagcatggatctgcagtcagagttctctgattctcagtctaatgattttctgtacattgtgctataaaaatgctaccccatggaggccctttgggaatcatgtgccctgtcttcattccagaagtaagagggaccctcccttgcttggacttcaagaaaaatcctttattatctctcactaaaatgtttggataagaatctagatttttcaaatatgcatttgttatggtttcataggaaatccaagtaaccgatttttcagaacctaagcagttaatgctagaaattttgctgcaaataaattgatcagtatgcaagacagttgtcacggctgaatcatggtccacagttaaggtaaacagatctgtgatgacattttctcagcagaatacaaatgcagctacatttcctcccagaggtttctgacatttcttctacacggataacagattctcctaagaaggtgttggtcacaaggaagaaagatctttgtttaatccctctgaaaaggtagggctgtgatatttgatgtgct

SEQ ID NO: 1152 - DNA, 1079 bp, Homo sapiens
ggccttgtgcttaggtcttacaagcttttcaaaggcccaaagaaatgattcagacaaaaaaaaaaattagactccaaaatactaaaagaaaactgcaaaaacaggtgaattaatggtgaaagatctgtaggacatagcagtaaggctaccacaacccagctttttgaggttgtcttaaattaatgtgatatggggtgtaggtatgttaacatgcttgataatggaagagtgaggatacctgcttcttaaacagggcctgctcatttttttctggcctctagtacatttctttctggcaaaactcaagctctgttttcacggagatgatgcactgagccatggcatccctaggtggtttgattcatttctgcaccccggtgtctagcaaagtgccacgtgcatgtgtttaatcaaaatagcttgtggttgtcaagctctttgtattcttccctccctccctgtgatttgatttcctgaaagtatcctttccccaaggattatggaacatacacttgttaaacactggacccattttcatgatcatttaaatgtcatgacctttctgacaccttgatatggtttggctctgtgtccccacccaaatctcatctaaattataatccccatgtgtccagggagggatctggtgggaggtgattagatcatgggggcagtttttcctatgctgttctcatgatagtgagtgaattctcatgagatctgatggtttaaaagtgtttggcacttccccccttgctctctctcctgctgtcatgtaagacgtgcctacttccacttccaccatgattgtaagtttcctgaggcttccccagccatgcggagctgtaagtcaattaaatcctctttcctttataaattacccagtctcagatatttctttatagcagcgtgaaaatagactaatacatgcctcttgagatcctcacagcaattggtgcctttagacctcttcattcacacttcactcatgtgttcttccttccccaggtagacgcaccctctgaagatggtgactccctcctgagaagctggaccccttggtaaaagacaaggccttc

SEQ ID NO: 1153 - DNA, 961 bp, Homo sapiens
cactcaggatggtaaacaagggatatggtgttgtttatgcagtatttagactctgaatggtctccactgtgggggatccttcctccactgggctcaaagttgtaatcagaactccgaatgctaggttgcagtaggatcaaagttcaatgcagatcttagttccactgggacacagtcaatgtaaaggaggggtctggagtgtaggagactgtcacttcatctctccatttccctaaagtaaactcatatgggcagccacagacacacgcgaacacatgcatacacacctatgcctcagtgacacatgttagtgagtgctggccatgtgctaggcatcgtgctggattttagtgatacagtgaagagcaaaatagacttagtgcctagaattatgaaagaattatgaaacctacgttctgaaggaggaagatggagttttaaaaattcaaccctaaatgaagatctcattacaattcaggaatgttttgatgtgaaaacacacacacacactctgttacatgggcagaactgccatacatagctcagcatgtcacagattgtttattcatagaatggtaatatttgtagcagtactattgttctgaactttggccttggaagcaggatttagtagaccaggcctgaaattcttcagactctgttgtatcagagaaataaattattagggatttcttccagaagaaaaacttcattgccttgaaattttattaattttatatggctgaaagttctgagaattggttactatattaaggattataaaaatcttctaggttgtttttttaaaaatctgtgtgccagaagatttttaaaccttcataagataggcacacttttgtttgaaagctttggctgaatctgttttattctgttttccagagaagccatttgaagcagaatccaaaccatgaattgtagagaattacccttgaccctttgg

SEQ ID NO: 1154 - DNA, 979 bp, Homo sapiens
caatctctgacctggactaaggctgccagcctggcccagttaagagtttcccagaaggatggcccatacactttaaattaaaggggccagacacgtgcacactacttccagccactctggaagctgaggtggggggatcgcttgagtctgggagttggaggccagcctaggcaggcaacatagtgagaccccatctccaaaaaaacaaaacaaaacaaaacaaaaaaacaccaaaaaagctcccagaaagacctctgaatctttctggatctctcagtggagacctggaaatctgaactttgacaatccctctcacagtggggccaaggaggaattaggcaagccaaaagaagtgaactttactcttctattgcctgtttgaattttgtatccaagcaagtgttacttaagtaatttaagagactggttcatcgaaaaaataaaactccccaaattcccatagctggtagactgtggtcacagccacagtgcactaagactatctgctcagcacttctggtgacccaaaagggtctgaggacaggagctcagagttgggtcagctgtccaggtactcagggttgtcacaggcaaaactgctggaactcagggcagcattgcaaatgccacgccgctctcagggccccttgcctgccgctggaattaaacccacccagatcttggaaactctgccctggacccttctcaataagtccatgagaaatcaaactctttcctttatgcgacactggattttccacaaagtaaaatcaagatgagtaaagatgtggtttctagatagtgcctgaaaaagcagagaccatggtgtcaggcgtcaccacttgggcctataaaagctgccacaagacgccaaggccacaagccacccagcctatgcatccgctcctcaatcctctcctgttggcactgggcctcatggcgcttttgttgaccacggtcattgctctcacttgccttg

SEQ ID NO: 1155 - DNA, 949 bp, Homo sapiens
ggttgatgtaaccgtaagccttgttctctctcagtccagtgaaagtatacattttactgataatctaaaagtattaattcctatacaccaaaagatctgcgtatcatccccctcttggaatacacattcacttgcacatatccccagcctgctcctcgcaacagagcttgctttggggaggaaatttcaggatcacctccagaagaaaacaccgacagcgctcctagagccatcgtggtgccctctagcaacttacgggctccaagcgaaaaaagagctcgggttggtgcgggggggcggggagcgggaaactccatcacagacgcaagtgaaaactcctgcggcttctagattccatccgagaaggaaagatgaaaatcaaggttagaaagcagtggcagggcggtgtcccctgccttgctttaattcacgcggctctcgtaacaagccacagatgtgcatcactcaagcgggcttcccagtcctcatctcccctctggatggtcttctgcgaccgcagagtggtagttagggaagatcgcagcgggcagaaactccgccaggggagaaaggagcctgggggcgacggtccgcctaatcgttccaggaagcccctccgcgtgccggtgggcgggcgctcaggcccgaggatgcggggcgaggaggcgggtactggtgattctcctggcagcccccgcccgccccgccagggggagcgtctgcgcccgacgtaggctgcggggcctgggctggcggcgcagggcggtgactcggctcggtggctgccctcccgcgtccccaccccctccccgcccgcccccggcgcggccctgcccgccccctccgccccctcccgcagcgccatgcgcagactcagttcctggagaaagatggcgacagccgagaagcagaaacacgacgggcgggtgaagatcggccactacattct

SEQ ID NO: 1156 - DNA, 950 bp, Homo sapiens
caaaagaacttatcggggcttctcatcagtgatagggaaaagactgggcatgtgcctaaacgagctctgatgttatttttaagctccctttcttgccaatccctcacggatctttctccgatagatgcaaagaacttcagcaaaaaagacccgcaggaaggggcttgaagagaaaagtacgttgatctgccaaaatagtctgacccccagtagtggggcagtgacgagggagagcattcccttgtttgactgagactagaatcggagagacataaaaggaaaatgaagcgagcaacaattaaaaaaaattccccgcacacaacaatacaatctatttaaactgtggctcatacttttcataccaatggtatgactttttttctggagtcccctcttctgattcttgaactccggggctggcagcttgcaaaggggaagcggactccagcactgcacgggcaggtttagcaaaggtctctaatgggtattttctttttcttagccctgcccccgaattgtcagacggcgggcgtctgcctctgaagttagcagtgatttcctttcgggcctggccttatctccggctgcacgttgcctgttggtgactaataacacaataacattgtctggggctggaataaagtcggagctgtttacccccactctaataggggttcaatataaaaagccggcagagagctgtccaagtcagacgcgcctctgcatctgcgccaggcgaacgggtcctgcgcctcctgcagtcccagctctccaccgccgcgtgcgcctgcagacgctccgctcgctgccttctctcctggcaggcgctgccttttctccccgttaaaagggcacttgggctgaaggatcgctttgagatctgaggaacccgcagcgctttgagggacctgaagctgtttttcttcgttttcctttgggttcagtttgaa

SEQ ID NO: 1157 - DNA, 966 bp, Homo sapiens
ggatggctttaagcatttgtgagttgtctgctccctgatggcagaatgcagagacatgaagctacaagcaggttcgctcccaacggcaaaaaggaggaggggtgttcagaacatcaggtgcttctagagaaagcagggagagagtatctggccttgtggacaatgtcacggcagaggccaggtatagggcatgggggtaactggaagcgggatggaccctgttattccctaagacatggcttccacgtagtgctcaaacaaggcctttgcccttgctgttccctccacctggaatattcttccccttccttgacattgctcaggtctccactcttatgtcaccctctcagagagggcttccctggccactttccctaaaatagccacccactcctaggtccctcaaaagcatatcctgctttggattttccctatagcaatatgccctatgaagttattttatttgctaacttgtttcttgtctgttttcctttgttagagcgttggggaccttgtctggcttgttcccaatgcctggaagagtgcctggcacacaggattaagccaacacatatgttttgaatgaatgtgtgcacacatgcatgagctggcggcagtcggggttggggtaagcacgaaggcccagctcagttctctgcatgtgacctcccatcttacgcagataagaaccagtttggtttctgctagcctgagtcaccctcctggaaactgggcctgcttggcatcaagtcagccatcagccggcccatctcctcatgctggccaaccctctgtgagtgtgtgggaggggaggctgggctcctccttgtactctctgaggtgctctggaaggaggggcagctccaccctgggagggactgtggcccaggtactgcccgggtgctactttatgggcagcagctcagttgagttagagtctggaagacctcagaagacctcctgtcc

SEQ ID NO: 1158 - DNA, 965 bp, Homo sapiens
tttctattccttgtgcatgattgaagtgtacacattttttagttaaaatataagcatatagaaggcacaagttcaatatttttcatgataaggatgtgtaattaaactggttaggagactcatcgactagagggggacatggtggccccaggctgtaagaacaggccacaccgtccactgggccgcttgctttgtgctaagatgacactttgttctgagcctcacagtgtcttgaccatgttcctggaaccttcttgttggagggagttcatcttcccctatgactctgtccctagtctaaggtgtcccacaggaagcttgagggcgggaagttttccagcccaggagcctgagctcagcggggcaggaagagggagcagctcctccgtgggggacctttgagagcccaggagcaggatttcgagggacacctggtggggagcaaaaggtgctgagtctgtctttgaccttgagcccagcttgtttctcctgcatcctcccccaaaaggggctttgcctgtcattctgcagttctagtgtggggtctgggcgcagttcttttccctctccagcctcggagtcttcctctgtggactgcgcagataggactggtggcacggaccagctctgcagccctggagtcaggagcagagccccccggctcccagcccgccgtagccgctcctggcaccgagcgagccgcgatgacaatggctgcattgtgcttcatgtcccttcccatcaacatttctgtgctggactccttccactcgcgggtcgtctccagagctcagaaaatgaggtgatcagtgggacgagtaaggaaggggggttgggagaggggcgattgggcaacccggctgcacaaacacgggaggtcaaagattgcgcccagcccgcccaggccgggaatggaataaagggacgcggggcgccggaggctgcacagaagcgagtccgactgt

SEQ ID NO: 1159 - DNA, 1157 bp, Homo sapiens
ctctccccagctacttgcatctgtcccgcgactggtgcagctgcaggccgccgccctgggtggctcgcggcaggagggactgagcccggggcagcccacaggggcaggaccgcgtcgcttacccagatgccgccgcggcggcaggccgactcctccgtgcaggaggggcgggctcccaagccgcgcactgcaagcagtggcgccggctcacgcacccctcggccgcctctcgcgcggcttcccgcgccggcagcccgcgatggccccacgtgaccgcgtgtctggtagcaggggaaagaggggcgccagggccggggtgtgcgtgcgtgcgtgcgtgcgtacgtgcgcgccctcccgcccgcccgcctcagtggccgggcgggggtcggcccgcgctctgagtgccgccgccacagttcgcagttgtgactctgtaggcggaagcatagggacaagcctgagcgtcacaggctccccacaaacaaccgcgtgacccggggactttccccagggtgtgcaaaagcacaggcaccccctcagttctggggtgaaggtgggggtggggaaggatgcgcccgcgtgttcgctggggaagggatgagggcgcggggccagggaggccgagccgcgggagcctgggtggagaggcggactgggcgaggtggggcatggcgggggaagtgactcagggccagaggcagcaggcccacggaaggtggggtcgggggggcgcggggactgggcgaccctgaaccgacggggcagggcgaggttgccggagcactcgaggcggaccgcgagtgacggcccagctgctgggcccaacgggcaggggtctgacatctggacggagtgggaaagcagcctcgcatcctgccctggggagtcgggaggagcccagttccatccagctgtgcaaacaggaggaggaggaggtcccaagcctacccttgagaggggcaagaggggtggtcaagccgccgccgccgcgacggcccccgcggtgcgggttgcgccagcctcctcggagctcgacgcagaaacttgttgcaacaaacaggcgaccgcgggtgcccctagcagccagcggcagagtgggtgggcgggcgagagggaggggaaggctggcggacgccgcagcgaactggtgggcagac

SEQ ID NO: 1160 - DNA, 1053 bp, Homo sapiens
tgggaatcagagtacctttctgcagaaggcgcacctgttgcctgctgctcggctgcattgtctgcgaaaggaaaaggggcgacgcttcactctgacttttggggtttctaaagagctgggtcacggtcactgtctaccctctccccttcctctcccccccccccgcaagcaccacgtcctccatcgaacgtgggcactgcatggaaataaggaaacatagaaaaataagccctacccccactcccattccctttcagatgggagtgtggggggtgggggtggggtagagagagtgagagagagagataattagaatgaatatatgccagaagaggaggaggcctgggacaggaaaagggagtaaaaggggatgaaccgggtagggaaatcccacccgaactgcgtgagccctctgagcgtctcgtgtcatgggacatctgtacgctcttccgctaagggggtgacgaaggtgggtgggagaggttagggcgctgcaaggcacatcccattccgtgcggctccaggtgcgtactacctggccacgccggccttgccttccgccggtgcttttgttgcaccctccccacatgtgagcggccgagccgctgcgcgggcgcaggggcttcggggaaagtgaagtgtcgcgacgctgcgggctgcgcagacctgggagaggtcacacctctttcggaaaaaaaaaaagaaaagaaaaaaaacaccaaaaaccacccaagctggctaccaaggtgaacgcagagcggttcccaccttaaaatcggccctgctcgtgacgtcaggtcggaaatataccaaagcgagcgcgggccaggagtccagggagcgcggcagcgcggcgattgggcggcgggccgctgacgcgcgctgacgcgcggagactttaggtgcatgttggcagcggcagcgcaagccacataaacaaaggcacattggcggccagggccagtccgcccggcggctcgcgcacggctccgcggtcccttttgcctgtccagccggccgcctgtccctgctccctccctccgtgaggtgtcc

SEQ ID NO: 1161 - DNA, 746 bp, Homo sapiens
cagcatataaaaccccaatccaaaggtcaaaccaggcacttgaatctctccagtcacctgcttggcacttttccaagtgttctttactttcattcctgctctaaatcttgtctcggtctctcactctgccttatacccctcagttgaattatttcttctgaggaggcaagaactgaggctgctgcagactgatatggattcaccactgctaacacctcctggttggaactacaggaatagaactggaaagggaaaaaaggcagcattcaccacatcccaatcctgaatccaagagtctaagatagtcccccactcctatctcaggcttagaggattagattaatctcctggagggaagactcttccttgaaacatttttttttatctgcctgtagctattgggataattcgggaaatccacagggacagttcaagtcatctttgtcctctactttctgttgcactctcagccttgttctctttttagaaactgcatggtaactattatatagctaaagaagagcattctgacctctgccctctgccctgggacttcctggatcctcctcttcttataaatacaagggcagagctggtatcccggggagccaggaagcagtgagcccaggagtcctcggccagccctgcctgcccaccaggaggatgaaggtctccgtggctgccctctcctgcctcatgcttgttgctgtccttggatcccaggcccagttcataaatggtgagtc

SEQ ID NO: 1162 - DNA, 900 bp, Homo sapiens
gagctccttaaaatggaaaataagaggccggacacgatggctcacgcctgtaatcccagcactttgggaggccaaggagggtggatcacttgaggtcaggagttcgagaccagcctggccaacatggcaaaaccccgtgtctactaaaaatataaaaattagccgagcgtggtagtgcacgcctgtaatcccagctactcaggaggtggaagcaggagaatcgcttgaactcgggaggcggaggttgtagtgagctgagatcatgccactgcactccagcctgggacaagagcgaaactccgtctcaaaaaaaaaaaaaaaaaaaaaaaaaaacagaaaatgagaaactttccccaaacagtattacacggtgacttgggcaaaactgactctccaccaagagacacttgactgtagttttcctggcagggagagcatctttgaggtctctagtggcccaatctgttgccctcagattacctggtgtcatgtagggtggaggacagctgttgtttgccatgcgttcctgacagaaataacccttccagtcattcaccatgagcctgactggtagagactttagcaatggggaaataccgtagactgttccatcaggacaatgctgggcctgcagtccccagggggcacccacttacttagccaaaccccagacgtttcatttaaaagcagaagtgaaaggaagaccaggttcctgaaagggttattctgacttaatctggctataaaaatgctattggctgttatttggcatggccaaagtgcacccagaatgtcttctctctccattcagtgcacgcgttactttggctaaaaggaggtgagcggcactctgcccttccagagcaagcatggagcaacaggatcagagcatgaaggaag

SEQ ID NO: 1163 - DNA, 815 bp, Homo sapiens
aactcctgatttcaggtgatccacccgccttggcctcccaaagtgctgggattacaggcgcgagctaccgcgcccagccaaaatgttctaattctttattggtggctacacagttgtcaaaatttatcaaactgtccacctacgatatattataagcctgtattaaatgtaaattagaactcgattgaaatctgtgtgtataaatataaatatacacttatttacatttctaatctaatctgaaggtccattgcaacgaatcccgctccgctctgacccaagaactccgcactttctctccaccagcctttcaaatacctgaacttcatgccttcaagaggtggattccggcttctttacagcgcaatcactagcaggtcatttccgtctagcttgcagatttcccattactgacacaaacgctccctcagggcgtccccgtctggactacaggagaaagtttgggaggcaggttcaacttttcaacttggcggggaattcctctccctcttacacagtttgcagcgcgggggcggcggggtgacagtccccgtgcatgaatcagccacccctcaggctccgccccggcgggggtcggccggacgctcgccccgcataaagcgggcacccgggccgcctggagcagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggtatctgg

SEQ ID NO: 1164 - DNA, 972 bp, Homo sapiens
ccttgaatgcaaacctttttctgagtatttaacaatcgcaccctttaaaaaatgtacaatagacattaagagacttaaacagatatataatcattttaaattaaaatagcgttaaacagtacctcaagctcaataagcattttaagtattctaatcttagtatttctctagctgacatgtaagaagcaatctatcttattgtatgcaattagctcattgtgtggataaaaaggtaaaaccattctgaaacaggaaaccaatacacttcctgttttatcaacaaatctaaacatttattcttttcatctgtttactcttgctcttgtccaccacaatatgctattcacatgttcagtgtagttttatgacaaagaaaattttctgagttacttttgtatccccacccccttaaagaaaggaggaaaaactgtttcatacagaaggcgttaattgcatgaattagagctatcacctaagtgtgggctaatgtaacaaagagggatttcacctacatccattcagtcagtctttgggggtttaaagaaattccaaagagtcatcagaagaggaaaaatgaaggtaatgttttttcagacaggtaaagtctttgaaaatatgtgtaatatgtaaaacattttgacacccccataatatttttccagaattaacagtataaattgcatctcttgttcaagagttccctatcactctctttaatcactactcacagtaacctcaactcctgccacaatgtacaggatgcaactcctgtcttgcattgcactaagtcttgcacttgtcacaaacagtgcacctacttcaagttctacaaagaaaacacagctacaactggagcatttactgctggatttacagatgattttgaatggaattaatgtaagtatatttcctttcttactaaaattattacatttagtaatctagctggagatcatttcttaataacaatgc

SEQ ID NO: 1165 - DNA, 954 bp, Homo sapiens
ggcagtttctcctctgtgtaggatcaaaagggctgtgactggttggtttgaaaatttcttataccctagactattccagtgcctttcagaagtttccaaggccctctcacactaatctattatcatattgggcaaaactccttgcagtttcagctactattccctgattgacttttcagtaaatctatctctcagtctttcagtatccaaagaagattggttctaggaccaccatcccgctgcctccacagataccaaaatcagaggatgctcaattccctcttataaaacgttgcagtatttgcatataatctgcacatgtatttctgtatattttaaatcatccctagattacttataatacctgatacaatataaatgctaaatagctgtaacactgtatctttaaaatttacattattttttgttgttgtattattatttttattgtatttttaaaaaatattttccatctacagtcagtagaatccacggatacagaacctatggataggaaggaccaactgtatcttttagtgttttgaggttcttgaattctcaggtcgtttgctttcctttgctttctcccaagtcttgttttacaatttgctttagtcattcactgaaactttaaaaaacattagaaaacctcacagtttgtaaatctttttccctattatatatatcataagataggagcttaaataaagagttttagaaactactaaaatgtaaatgacataggaaaactgaaagggagaagtgaaagtgggaaattcctctgaatagagagaggaccatctcatataaataggccatacccatggagaaaggacattctaactgcaacctttcgaagcctttgctctggcacaacaggtagtaggcgacactgttcgtgttgtcaacatgaccaacaagtgtctcctccaaattgctctcctgttgtgcttc

SEQ ID NO: 1166 - DNA, 944 bp, Homo sapiens
agtcaacgtgatgtgttttggaaccctgaattccttggcttgcccggagggttttctttttgttaatatctttgcttgctttctagtatttaaaaaattgtgttttgctctaactatgcaatggctttaagtcttagacaaatttccagggagcaaaacacactcaaccatttcataataatcagaagagagctctgatcaataaataagcaagactgaattttacaaaataatccaaagtttaaaaccaaagcccactttttgcatgatcctttaagagaaagaaatctggaagcaaaacaccttataaaatgacaatgcactttcaggagcccagggcactgtggtgaaatgatgatggctagtacaggttataagccttggggaattatttatgaattctcaggatccttcagttcgccgcatccttctccattatttgaatattggaggctgcctgaccagaatcttgtcaggactttgctccttcatcccaggtggtcccggctgactcctgaggacgttacagccctgaggggaggactcagcttatgaagtgctgggtgagaccactgccaagaagtgcttgctcaccctaccttcaacggcaggggaatctccctctccttttatgggcgtagctgaagaaaggattcataaatgaagttcaatccttctcatcaaccccagcccacacctccagcaattgaacttgaaaaaaaaaacctggtttgaaaaattaccgcaaactatattgtcatcaaaaaaaaaaaaaaaaaaaaacacttcctatatttgagatgagagaagagagtgctaggcagtttcctggctgaacacgccagcccaatacttaaagagagcaactcctgactccgatagagactggatggacccacaagggtgacagcccaggcggaccgatcttcccatcccacatcctc

SEQ ID NO: 1167 - DNA, 934 bp, Homo sapiens
caggtttgtgtctgtgtgtgctagtgtgttcatttctcccttaatcttgactatttctgtaacaatttccttcttggggagtttatattctaaggatacctacaagtgcatgaatgcgtgcatataactgggtcagtattgcagcaggatggcctgatctccaataaaaagccctcttggcagggcacggtggctcacgcctgtaatcccagcactttgggaggccgaggcgggcaaaccaaataccatacattctcacttataagtgggaaccaaacattgggaactcgtggacgtaaagatggcaacaatagcaacttgagactactagaagaaggacggagggagcgaggcagatcacgaggtcaggaaatcgagaccaccctggccaacagggtgaaaccccgtctctactaaaaatacaaaaattagctgggcgtggtggcgcgtgcctgtattcccagctactcaggaagctgaggcaggaaaatcgcttgaaccagggagtcaggggttgcagtgagccgagatcgcgcctctgcattccagcctggcgaccgaacgagactgctccatctccaaaaaaaaaaaaaaaaaaaggcctgtgagggatcctgtggctaaagtgagcccctctccaggtgccacatgcctcgacatgtgcctgcagcccgggatctcacccacccccactcacgactcacacactcacaacgtgcagttgggcgcctaggattgtgcatgtcaagtctccacccactccctttgtttaatcgtcggaatttccagcccgctgctgccaaccgctccccagctgcgggaggaggagttagaaggacccgcccaattttcaggagcacataaattacctctgccggcagccgaccctcacttggccttacactccgctcggctcaccatgtgtcactctcgc

SEQ ID NO: 1168 - DNA, 1021 bp, Homo sapiens
catttttgttggctcactgactgactggctgagggagataggggcctgagatcctggacattcagtccgggctctggcccctgaaaatgtgctggcctgtcctcggaattgttccacctattgccttccaggcgcctctttcatgatctcaaaagaatagtgaaaccaggtgccgtgtctcacgcctgtaatcccaacactttgggaggctgaggcaggtggatcacaaggtcaggagttcgagaccagcctgaccaacaaggtgaaaccccgtctctactaaaaatacaaaaattagccgggcttgctggcacgcacctgtaatctcagctactcaggaggctgaggcaggagaatcgcttgaaccccggaggtggaggttgcagtgagctgagatagcgccactgcactccagcctgggcaacaaagtgagactctgtctcaaaaaagaaaaagaaaaaaaaagtgaaaaaaattcctgaatgaaggcctggactgaggtggctttccatttggaggtccagccccaagcatctgagagtccctcctaaattcattacctacagcaacaacaactagcaacaagtaacaactggctacgatcctaacaactaatgacagggacatttatctccctcatgaagaaacggtcccaggaccatctcccacccagcatccattgcggttccctgtgcaagatgagtctctgagtgggaatccagcactctctccctcttcttccccaccaccttcaccctccttaacggaaaaacaaaaggcatctgcacctgcagccctgctgaggcccctgctgctcacacttgcagcagagggtggaggctctgggttcttgccttctctcaaaggccccagccccaacagtgatgggtggagccagtctagctgctgcacaggctggctggctggctggctgctaagggctgctccacgcttttgccggaggacagagactgacatggaacaggggaagggcctggctgtcctcatcctggctatcatt

SEQ ID NO: 1169 - DNA, 930 bp, Homo sapiens
tgactcttaaccactcatgctgcctacatctaccattcatgtggtccttgctgctttgttttggttattcctgcatttatttgtccttttattcatttatgtataaacatttagtaagcacctactaatggatagggctcattgtagacttggaagctctctgagggtgggagtatgcctcgtccatctgtctttactttttgtagcaagggaggtaaagctccatttccatccctccttagtgagtcagtagtcagtggtgaggctaaggcttacctctccctttctcactcagcacagggggctggagatgagcaagggaacgggaggaggtcagcccagtatgggaatcagttcttctcagggaacccagacatccatccctcaagattccagtccttgtcctagtccggcccttgacctcagagacgggatcagctcttcctccagcacctaccttgagggtatagaagaatgcaaaccacattggaaacctggagatctgtgttctcatttcagctctgctgactggcttcctgcaagctaccttccctccctgggcctcagtttctctctctgctgagccagaagatgtctaaagacccctttggttccaccctgagagcctgtctccctaacctcaacttcttccccagttcagagaacccaggcatccagctgccccaccccagctctgggtaaacaggaagctgggtgaggggagcaggggtgtgcggaaagtcccagccaggtgtgcaggtctacagggagggggtgggcccgtccctgaggtatgaaagccccctgctctggctctggttcagtctcaatgggggcactggggctggagggcaggggtgggaggctccaggggaggggttccctcctgctagctgtggcaggagccacttctctggtgaccttgttgct

SEQ ID NO: 1170 - DNA, 910 bp, Homo sapiens
ctcaccctcacccagtctttgtgcagggcgccggcggccattgtgtccgggcggggaatggaggacccggcaatccccaactgccacgttctgggcctttggggaattcagagcaaaccagcggcatttgttgggggtctccggccttcaacatcacagacaggcctgggggtggccttcccaaagtcagattgcagatctgaggcagtttccccctccctgcgtccctcactgaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatgtaggtggtgcgggggagcgggagtggggcgggggggactgcccagggagtgactttccgaggaaggcatttcggagaagacgggggtagaaaaggctggtgggagattcagagtccactggtgctttcgatttgacttaagtgaagtatcttggaacctagacccagaccttcgtaagacccacaaagaaaccag

SEQ ID NO: 1171 - DNA, 1043 bp, Homo sapiens
tgagagtgataaggaaggtttgctttaaataaaccaatcaatgagtgatttagatcatatgtaacaggaatattagatttgatatgttcttgtggacaaaaaggtatttctattggatacacctttgtatcttgcttaatacctaaataagtgttagctttttctttctatgagttatagacaatacattttaaagcagccattttttatatttcagaaacatctgaaaagtataataatttaattctttgtgtttatggaacttaattcagtgaatatttatgtcatgggttgtggcagattttggttttttgtggaagaggtcaccatgtatatactattttgaagggcagaaaatagttgtttctatttttgtatattttggttataaactgcttttaatggcatggagttgaatttagggatgtttaatcttcatattcttcacttgatttgagtgagaaaaaataaaattttcttggttataaaattctcaaatgattaacaatggtttctttaaaagactgaagatacatattcagtggctgtagaaatggctactgctattgtaaactggattaacaatcagtacttctacaaatctaagtatttgtttgtttttactttttactagtatgactctggaatttttcaattcagggaaataatagaatagaaaagctttgctaaggcattgtaatcagacagaactggcctcaaatcctggctgtcatgtacttgctatgggcctagagtagcttacctaaatgctactaaccttcctccataccattattgtaaagattaaaggtgatgcatctgttaagtaactaatagagtgcttattaaaaggtaggtgttcaataagtattaattccctccctttctttttcttactagtgcacttgtgtttttaatggatcatactttaccctagattgtattgtaggaggcattgtggatggatggctgctggaaaccccttgccatagccagctcttcttcaatacttaaggatttaccgtggctttgagtaatgagaa

SEQ ID NO: 1172 - DNA, 1454 bp, Homo sapiens
tccaagttccttttgccagtttacttcatttgcttctgcaaatataagtacagtggtttggctttctttttaagcctttaataaaatgtctaggtgttgagactaacatcagactctttctcattaatataatacaaagccagctcgattctaattaactagttggaatttcacatgttagctctacaaatcatttttcacgcattattcctatctctataagcttgttaaaaagtgatttataaatttgttccagactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatc

SEQ ID NO: 1173 - DNA, 938 bp, Homo sapiens
acagtgagcatgccaacttacaagcgttaccagaaagaaaataccctcttctgaaatagtaggaattagctatttcatttgtacatcttgaaatttccacactctttccatgtccaactactacctttaatttttatttttatggtattcacatttgtaaagattttatattcgatcctcaaaaaattctggggatgcataggtcttccaggaagtacgacttcagtgacaataaaaatgaggtctgatttccctcagataggaagtctatttttctatttccttaaattaacaagaaaagagcagtggtcctgtgaaatcccatatgaattcaagttataaacatagaacacaatcgacgtgtaagtctgtaacaacaggagaccagagtaacttgtaacagcaggtgacttttctaacaaaggtcacactgtgtgggctaagctagcacctcatcactgcaagaagcaaaacaaaaggaaaaaaaagcttctctctctcttttttttttttttttaaagcagcagcataattcgctggctcagcaaatgtttttccctgttatagtttgggaaagaaggcaacttggaggccttgtttacccttagcccttcctcccgcccccgactgtaccattaaatcctagattctagggtgactgaaaaggatagggaataaattagtaattgtcaaaatgttttccccatattatgcatggcagcacttgctactttcttttaagttgataacaatcagctcaggggtttgctctgcttgcaaggtcactgcaagaatgaacattgaactttggactatacctgaggggtgaggtaaacaacaggactataaatatcagagtgtgctgctgtggctttgtggagctgccagagtaaagcaaagagaaaggaagcaggcccgttggaagtggttgtgtaagt

SEQ ID NO: 1174 - DNA, 1636 bp, Homo sapiens
cagcagggaagagagagaaatgagaaccaaacaaaaggggtttccccttataaaaccatcagctctcatgcgacttattcactaccatgagaacagtatgggggaaaccacccccatgattcaatgatctaccaggtgcctcccacaacctgtgggaattatgggagctacaattccagatgagatttgggtggggacacagccaaaccacatcactgaggaaactgagttatagggagattagtaacgcccaacacagctggtaggtggtggagccaggcagtctgactctagggtctggactctgaactgcatcatgctgccaagaagttcctcattttttcctctctctaagtttcccttattcccctacagtcattccttcaacagcatttccttcaccatcttttctacttctactatataattaattttttcttcttggtcccaaattccaacgtgcaaatgcagccttatataccctaattcatctttacctttagactttcttccaatgtttctacttcattccattttaaatttatccatgagatgcctatttacaagctgtaaccatcatgaagtgaatgaagaataatacctactactgtacaatagaattccaagagtataaataggagttatggctttctgacttgaaactaaatacttgatacttgattttgctgtctgagatcaatctgaaaagtaataataatcactaacatttgttgagcatcaattgtgggccaagtgtcatttcaatcactctgtacatattaactcatttcatcctacaacaacccggtgaggcaagttctgttattctgttttacagttgaggaaacagaggcatagagagcttaagtagtttgcccagtagatagccagaagaggagccaggatgggtctcgggcagtttaacagcacagctgaagtcttaaccactatgccaacagctttttggtcctacacatcccatgggaagaggaaaataaaaaggtatctatttgtatacctttttatttctgatataagaagcagaattcctttcacatgacctatgtctatttaatacgtcattttgaaacttaccaataaaatttcccaagcgccagaaaactgttagtggctttttccatttctctctatttttttttgtgctactaattttgcttctttccctcagaaggctgccggaatagtaaacattcactgacatgtcataattactggaaaatgggcactggaaaatcacattgtaattaattcaaagcatgttttccaaatgtactactttaaattggagcttatatcataatccaaggaaacctttgtgtgtgtactgttcccacattgctcagcctgggatatccaggagtaattcaccttgcgcctgcctccagaccatcttccatggaagggggtgaccccttgcctcttggcaaccactatttctaagctgccaacattactcttgcattatcaacattctaacttcatgggaagggctgtggtgagtttctggaatgtgaataggaagttgtttttctaaacagcctgacactgaggggaggcagtgagactgtaagcagtctgggttgggcagaaggcagaaaaccagcagagtcacaga

SEQ ID NO: 1175 - DNA, 1188 bp, Homo sapiens
gatcatgtgaaggaaaaggttgggtgatattctaacccaagttagctgtttctcaaccaagttctctttgaaaaattcaacaaccacctttggggaattatttacaacagaggagtgaggatgggaccaggataggtattgcctatgttggtggaaccagggtttttttcctggattaccaaagagatggtatgcattgctcccagaagctaaatatcttcaggctttcaatggtggccttcacctgaaaatgttatccctgttgaagctttcaagccagtattttcataagaactatattttctttggtgaactgaggcattataatgatgactatacaggttcttgagtgactgaagccatcattagcattgtcattatttttgtttagttgcatctccatagcagctcacattcacaatgtgctttgcaattgttccttagcaatagccctcacaagattctcaggaggagagggttaatcaggattaacatttctgtgttgcctaaagaggaaccaaggtaagcagaaatgtagccagttggctggcatcactgttgcttcaggattcatccttagacacccaagcttctaccctagtctggtgctacacttacattgcttacatccaagtgtggttatttctgtggctcctgttataactattatagcaccaggtctatgaccaggagaattagactggcattaaatcagaataagagattttgcacctgcaatagaccttatgacacctaaccaaccccattatttacaattaaacaggaacagagggaatactttatccaactcacacaagctgctttcctcccagatccatgcttttttgcgtttattattttttagagatgggggcttcactatgttgcccacactggactaaaactctgggcctcaagtgattgtcctgcctcagcctcctgaatagctgggactacaggggcatgccatcacacctagttcatttcctctatttaaaatatacatggcttaaactccaactgggaacccaaaacattcatttgctaagagtctggtgttctaccacctgaactaggctggccacaggaattataaaagctgagaaattctttaataatagtaaccaggcaacaccattgaaggctcatatgtaaaaatccatgccttcctttctcccaatctccatt

SEQ ID NO: 1176 - DNA, 1177 bp, Homo sapiens
tagttcaacttgacccatgcagacataatttgagagacgccaaggaggattaggaaaaaatgtatctggtcttactcaactctgaacattgcatgagtcaaacgttttcctagctctctgtttgtgtgatgggtccactctgatggattcttggcgatgtatctttcatgaccaaaattcaaaagaggccattcgaagtggctcccacaaaagctgctgcagagccccagacattcagaagccaatagtgaaggggccaaaagccatccctcaatgttcactgacactttgcgagccttggggcaagttggcgatgtcaaaacatgtttttagggcgtgtttgccaacatacaggtcttgggcaggattgcagacctctgcagatggtaccaaagtaaagggggagatggtagctgaataatctcttatcatccctaaagtgcaaagtgaaatgagagtggatttttccttccaaatccacttggagtgagtcccgaaagactcacttttgcggcaatccccacaatgacatcactggagcggaggttatataatttaaagcaaccacatctccacagcacttcccagaagagaaaactcctccaaaagcagctctcactatcagaaaacccaactacagttgtgaacgccttcattttctgcctgagtaagtaaatgaccaccttttttttttcttttatgagagtacaatatgagaggaaatctgtgtctcttagaaaaacaaaaaacttccttttacacctacctattggcaaaattttccacttctgtgagggtactttttaaaaataattctaaatcaatttaagagacttttatttcatgcctagtttgggtcttaattgcttttccagaacaggaggaggagggaaaggttttagaactcgtaggaaggttccagtagctccttatatcaaagtcaggtgaaacatgtcagggctgaatgcagccaccagagttcgcatggactgaccagttacagcctgcaaattctgaatcataaaaattaaattagtctctctgggatggcttacaagatttcataagaccaataactggttgggttattcgtggcttgaaagtagcatcttactatgtgaccgtgctgatggtctttaacatctgtggctgaatttccaatgcctttaacatcacc

SEQ ID NO: 1177 - DNA, 1411 bp, Homo sapiens
atcagctcatgggattgttgtttttgctttcctctctatctttggctccgggattttccccttactttaatgggagctcatctgtaccttttaagtttttattaatatcatgtgaacacagacctgtatatattgttagaagcagaaatctctaagtttacttttaaaacatgatccttgcctcgaaaccttgtagaataatataatgtccacataataccaagttatgaaaagaaacatacctaaataactaaataagtatattccttttttcccccagctttttttccccattctaggtttacccagttgtactgtgttgtttgtcataggccgggtgaggtggctcacgtctgtaatcctagcaatttgggaggcgaaggcgggtggatcgcctgaggtcaggagttcgagaccagcctggctaacatggtgaaaccctgtctctactaaaaatacaaaaattaactgggtgtggtggcgggtgcctgtaattccagctacttgggaagctgaggtaggagaatcgcttgaacccaggatgcggaggttgcagtgagccgagatcacaccattgcactccagcctgggcaacaagagcgaaattcagtctcaaaaaaaaaaattatctataaaagtataggtgcaactcctcaagtattaaagacaagatagctcggattggacttgactttcagagccataactattcttaatatgttggtttatcttggaatcagaccattttcagtttcaacctgtaaaacagtgtacaaaggaaacatggaaagttttctatatataaagggttgtgaaataataacagctcacagaaaatgctgaaatgatgatttgcttcagtaccctctgaaatttctcccctaccacccctccttcatccccattgctatcaattcaaattacaacagctaattctcaggagaacagtagaagcccagtttctctcctctttcccctctgaccctcctccaattaatctgactgcagcgtaaacctttgcggtttaatattgtgcaacttccacatttccctcgctctcccacccagccccctcccccaccaaattcaggggaactcccgttaccgcagtgccaccagcattactcattcatccccattcaggctttcctcagcatttattaaggactctctgctccagcctctcactctcactctcctccgctcaaactcagctcacttgagagtctcctcccgccagctgtggaaagaactttgcgtctctccagcaatgcatctccttgcgattctgttttgtgctctctggtctgcagtgttggccgagaactcggatgattatgatctcatgtatgtgaatttggacaacgaaatagacaatggactccatcccactgaggaccgtaagttcact

SEQ ID NO: 1178 - DNA, 1052 bp, Homo sapiens
tttttgctggctcttttcatttctgtgcagaatgctctatttatccctttcttcttcttcttttgtttttttttttttgagacagagtctcgttctgtcgcccaggctggagtgcaggggcgcgatctcagctcactgcaagctccaccgcccgggttcacaccattctcctgcctcagcctcctgagtagctgggactacaggtgtctgccaccaagcctggctaattttttttttttttttgtataattttagtagagaaggggtttcaccgtgttagccaggatggtctcgatctcctgacatcgtgatctgccagcctcggcctcccaaagtgctgggattacaggcgtgagccaccacacccggcctatccctttcttcttggaggatagaaagaacagtcagaacttggtgtgtctcaaacaaaagttaggttgtgtttgcagaatgttacataagtcacagacttatttttataagccacagtctgaacataactttctggagacagaattcatgggctaggtatttttaggaagtggaattatgtctgcaggatttatagaaattcatagttaggactgtgaagttaactatgaagaagagtgacaggttttctcttttacaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaagtaagacagtctttctgtggcttaaaataccttaaggggaaggctattaaatacacacacgcatatagacataaaataaaagtgtaaataatgtattaagtcacacttttagaaaaactatgtgtttgcatagaacatattagaagagagaaactaggatgatacacaccaaaatgtttacagtgggtttcctagggttatggaa

SEQ ID NO: 1179 - DNA, 1174 bp, Homo sapiens
gagtgtgacggtcatcatcattgctagattttattacttttatggatgggcatgctagctaaaattgcaaaacctctaatattttctaactgcctctgctgtttttctcctcggcccttagcactctctcctacaccatgtgataatttatattgattgctgtctatactgttccactcaatggaagcttcgtgaagtaggaacttttagtctattttatgcactgctgtatctctaagatggctggcacgtaaagagggtctcaataaatatgccttgaattaatgaaaacagtggtttctgaatcatggcctccaaagagcatttgccttttcccctctcacccttctgaaggtgcccaggctgccctggcaggatgcctctttctctgtggggtggcattctctgctctctctctaatactctttctttttcttccctcctctcccccaactgcaggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactct

SEQ ID NO: 1180 - DNA, 1767 bp, Homo sapiens
catgtctgctggtgtaggacagtctttgccctggggttccccactggcaatgctgaaattttctgcactgtagtctgaggctcccccgactccaaaccttttcacaggtgttaattgacatcatgttctgaagactttccctactcaatcttgctccctctccccttcatctttttgttttgaatttttattttattttatttttttcagagacaaggttttgctgtattgcctactacactggagtgcagtagtgccatcatagcttactgcaacctcgaacttccgggctcaagagacccccctgcctcagcctcccaagtagctgggactacagggacacaccaccatccctggctaattttctttttgtgtagagtcggggtctctctatgccgtccatgatggactcaaacccctgagctcacatgatcctcctccctcgctcagcctccccaagtgctgagatttacaggtgtgagccactgcgcctggctcccctttatctttcacaggcatttcccaataaatttatttcctttctaattcctgttgataaatgcttcatggagcacccaaactggcatagtttatgatttctgatgttctattctatttcgttactgtgaaaggagacctggttttccatcacattctcccctaagtgagaactctggggaagacacactgactgctagattttgcttaggatgtgcaagcaacgtatgtctgtcaggctttgtctaatctgtgttctagaataaggggagcttattcgagaatgtcaactttcaagattggacgtttttactttctctaaagtacttcattttagagaaatgaagtattttttttttcttaaaataaaattatctggtgttttccctaagggcaaatgccaggagcatatgctctatatgttttgcctcgggtggggttggggttaaatccagggagcatacaccccgggttgagggccaggcgtatgctctctggaaggttatgttttatttgaagccattgttagaaatacagcattctcatgaattgtctccttttaacctctcttctcattcttgtcctccttttcacctaagccctaagtgagcctgatgctctgtggttacaatcccacccttggacaatgcccgccatcaagtattccttgttgtcacttgtcatcctcatcctacactctttctatcacagaaatgtcctgggacctttcacgcatttatgacctccccacgctccatgccattcttctccttgacattgtatgtttgtttcaatgtttacttcagagaggtcttgggggctatggacttcaattccattagccacatcacaattttcaacaagaatctcctgactgaaatgtactgaaatggaagagaaagtcctctcaccagaattgaggaatgtcaaggctggaaggtatcttagagatcatctaatccagttcttgcttcagaaacgattcagggaagcaagtgaagtgacttggactttacctatggtaatactctctccccaccctcaacactgcccagctggcatttctgtagccccaacacctcccccacactgtgccttggtgagtgttcaccaaggaacgctgcattttgataagcctcagtaatcaagagcagcctctgcccataaatacacctgccctgctcctgcctggggtgattccctccgacttgcgtctgcttctcgccagcagccccagcattatgcagagacttgtgctgctattagcca

SEQ ID NO: 1181 - DNA, 1096 bp, Homo sapiens
gccagaagttctcctcttccttcctacacctgcttcctccctccctccctccctctttcccttccttccttccatccatttgtgaagaagacatgatcaccctcattctgagagtgaagagacagaggctcaactaatgaaatgatttgttcaaggtcacacgggtggcacaaggcaagtggcagaggttgaatttagacccattcctgtccaaatgctgagtttatgtcatcgtcccgagaccataactttaaagatgtaagatagtgggaaaagagttgatttcaaagcacctctcagaaggactcactttacatcaggggtcagcagactcaggccaaatccggtccattccccgcttttgcaaagaaagttgtagtggaacacagctaggcttattgatttatggattgccaacgtccttttgtgaaacagacagctgagctgagtaatcgtggcgcacaaaacctaaaatatttactatctcgtcctttacagaatgtttgccaatctatggtccggagtccaaggctgtccatttttcaaagaacacaaagtgacatgagactgtcccatgtgcagggagccctatcattttattatgaaaaaacggcctttctgctcaaatctgttttttaaaaagtcaacaaacagactctgggtacctgtcaggaacagtagggagtttggtttccattgtgctcttcttcccaggaactcaatgaaggggaaatagaaatcttaattttggggaaattgcacaggggaaaaaggggagggaatcagttacaacactccattgcgacacttagtggggttgaaagtgacaacagcaagggtttctctttttggaaatgcgaggagggtatttccgcttctcgcagtggggcagggtggcagacgcctagcttgggtgagtgactatttctttataaaccacaactctgggcccgcaatggcagtccactgccttgctgcagtcacagaatggaaatctgcagaggcctccgcagtcacctaatcactctcctcctcttcctgttccattcagagacgatctgccgaccctctgggagaaaatccagcaagatgcaag

SEQ ID NO: 1182 - DNA, 1076 bp, Homo sapiens
ccattaaagactttgcctcccttataccctctccaactagggtgcctagtgttatgaacaaagggatatgtataggttcttgtgttgcctctctctttgatatttttagccatcagataccttgtctgcaatgtgtgctcagagagtgaggggggaactagatgattgattttccaaatgtgttccctaaatgtgttccctggggaataagggcacgagaggctgcctattctatttcaaacaaatccccttcactacagtgtatttgatgagttggggtttgttttaattccatttggaaaagggctttagcagctaagcaaatggttttaaagtgcctcagaagtcaagattaatagaaactatccagttctgatgtcctatcatgctaaaatttcagggactaagattctgtgatcattacattgaaacacagcagcaaagctgtggtgtgttgtccttcctggttcagagatgcaactatgtgcagggctgctgagctctctctgcatctgggtgggagcctaatggaagttttggggctccttcctggtctccaaaatcctcaagaccaccatgtgaacacaggaatcaaggaaggttcttagatcgactcatcccccaggcctttggtttccttgctcctttccccaactacaggtgtttcatttcaactcatcccctagggccttggttttcttgctctcttcccccactacagatgtttaacttcatttcataaccacatattcccctccttttccaaggcaagatccagatggattaaaaaatgtaccaagtccctcctactagcttgcctctcttctgttctgcttgacttcctaggatctggaatctggtcagcaatcaggaatcccttcatcgtgacccccgcatgggcaaaggcttccctggaatctcccacactgtctgctccctataaaaggcaggcagatgggccagaggagcagagaggctgagaccaacccagaaaccaccacctctcacgccaaagctcacaccttcagcctccaacatgaaggtctccgcagcacttctgtggctgctgctcatag

SEQ ID NO: 1183 - DNA, 927 bp, Homo sapiens
atgcccagccctgcatttaaaaaacaaaacaaaacaaaaaaaacttttttcttgtggtgagctatagcttatatacaaaagtgtgcacaaaacctacatgtacagttcaaagaataattataaagtgagcccccatatgacaaccaccctgagttaagaaggagagcattgccaggcagtgccttaccagcctccctggtctcccaacccagtcatggtcccttccctctcttagaggtaactcttctaaggtaaaagcttgtgatcatcattcccttgcttttctgtagtaacttttccacctatatgtccatcccttggcaatatgagtttagcccatttgtgaatttcctacaaatggacttgcattttcccagctctggtctgtctgcttcttccacattctctttgagatccgtccatgttgacgtgtgtaggggtaggcagtccatttttattgcagctggagccttctttataaagcctgcttcttctgctgatccacatcctttagagtgcctagcacagggctgaaaatgcagcagctgctctgtaaagacctgttgattagattggggggaggaaatccccgagaacgtgcgaggctgctgtcgagagctagcagaaagtgctctgccaggcctggtggccccccaggcattctacttttgtctttctctcctctggatctggctgttgcatttctgtcgtggacaatctgagatgtttccatctccctgtaaaattaattcccatttctgtgtcccttttcagaatgccgaactggggaggaggcaagaaatgtggggtgtgtcagaagacggtttactttgccgaagaggttcagtgcgaaggcaacagcttccataaatcctgcttcctgtgcagtgagtacgccccaggccctattgctgttgccttggacac

SEQ ID NO: 1184 - DNA, 1057 bp, Homo sapiens
gaataaatggcagagatggcaactggacacaaagttattttaccctgttcccttcacataaaaggcaggcttgggatcacttaggtttgggggcataaacatcctctcagtgtctgagtactaaagaaatgataaactactatcaatagaaaagtaacagatcacttaattatcaatcagtctaatggtgattattttaagacttttgccacaaactgaactgccccaaagcaaatctctcatgcagtttggccttaatttcttttaccctttttttttttttgagaggttattatgcagtgctttcccgtttaaaacactgtttctaccagggaatattagggggtcttctgcattacagactaagcaattccgtcttttctcaagaaaaactgccatgttacatctggacaaaaatggaaactttaaaaaaaaacctcacatcgttttattttcctttctgtgtgtgtattttttcccacataagtatcttattatttcctaatcgaagctcattcttctctatgaggcgctggcttggtattttcgcctgacaaatctcccggagcagatggtcccttcagggaagcttcaggaaagtgctgggtgtctagttatgcctggaccctccctccctcttggggccccaaatgacaagtcatcaaaccagtttctctccagcaagggtccttgatccggtagcagcaggtttgggtttcaggcactgcagagaccctttgcagttgggtttagcagctacccaagtctgcagcctgcgctggtcctgggggtgagagtgatatccctgttgtccaatcagagaagcgggtttccctgtggtccccgccccactttccctgctgccccaataaccgccctaaaaggccgggcttctgctgtcaagtagccagggtgggctccgccgaggcgaggaggggcgccggtggggagatgcgctcccaggtgtttgcagcggaagtgggaaacctgtagggtatggtccagctgtgccgcaccgaggcgagcaggagcagggaacaggtaggaagctggactt

SEQ ID NO: 1185 - DNA, 901 bp, Homo sapiens
ctatgtgcttttcttggtgatttcactttttttttttcttttagagacatggtcttgctatgttgcccaggctggtatccaactcctggcctcaagccatcctcctgcctcggccttccaaagttgatttcatttttgtcttccagtattgttttactgttgttccctttgaaaaattctaacctatcttttctgaacttgagctgagaagggaaggggttttgcctctgttgggcaaaaggatggtggcaagtagtgtgaccaagtgccctaacttgccaggacttaggggtttcccaagtcaagggacttttcagtccttggcagactggaatggttgatcaccctagtggtgaggaaaatgaaggtttggaggtggcttggaggagaggttgctgggagagctcttctcctgttctctgttgatcaggagtttccctcatcaacctgctgactttgcgtggtggtttcattacaagttgtgagccccttattgggggtatagggaggagaagtgagggcagcctttaaactagtcataggccccagttgagacaattattgccgggaaagaagctgaaatgcttgactagcactgatgctgtgggggattttccctctttcttcaaaaaaacagaaaagacccagtggaaaaaaaaaaaaaagtgatgagttgtgaggcaggtcgcggccctactgcctcaggagacgatgcgcagctcatttgcttaaatttgcagctgacggctgccacctctctagaggcacctggcggggagcctctcaacataagacagtgaccagtctggtgactcacagccggcacagccatgaactacccgctaacgctggaaatggacctcgagaacctggaggacctggtgagtagacacgggtagct

SEQ ID NO: 1186 - DNA, 1408 bp, Homo sapiens
ccctcctcctccatctctgttatgtgaccagtttaagctcttcctgcctgtgtgtatagcatgggacatacaggttctctagggaacagaaagctttcaggaaaatggaaattcacatgtgcattaatgactttataattaaaatgaaggtcaggcctttcctctttaacactcatcttccctgcactgagatttgcagacctctggagaaccctaaccttgtttcctgcagcctccttagaaccccatgttgacacccctgaccctggcatcctggctcattgttagttcgtctcatcacttggaacctgtctgattcacctcactctcttctccccaaccctgcaggtaacatcatgtctcgggtaacagaggacacgtccaccctgagtgattctctgagtgagaatctgagcttatttctgtggtacctggtgcgaggcctatgtctcttggggatcatgctctggggatcagtgtccctcaccatggtcaccctgatcaccctgcctctgcttttccttctgcccaagaaggtgggaaaatggtaccaggtatgttcatggagttggcccgctctacacagaccctcatctcccagacttggcagactcagttcctctcacattgctttcagtccagctttcctggcacccttactgattctccatcttcatggaacaccctgtccctgtggtccatgttcccaggttgctcaacattaacctccatactctctgggtcttcttttctagcttctccccacaatctgtctttaagaatttgatccccaacccgttctgagtcattttcctcttcctcgtatttctttagcatccaaggggcatagctgtgtctctttctcttttctccttttcctctgtctcttctcacctttaatttccaaataggtaactcaggtattagtgtccctgatggtttgccaacccgtgtgacatctcttgtccatgtatccacagttgctggaagtgcaggtgcgggaatctctggcaaagtccagccaggtggccattgaggctctgtcggccatgcctacagttcgaagctttgccaacgaggagggcgaagcccagaagtttagggaaaagctgcaagaaataaagacactcaaccagaaggaggctgtggcctatgcagtcaactcctggaccactagtgtgagcacctgaagatgaatacccattcccttgtccttaagatgccgtgactccattcccattcctatgaccctgctcccactcctcctttactgggaaatggttggttcagtattttcgtcctagcaacctgaggctcaatgactctactcagtgtccctagccccctccctctctttaaagatgctaggtggcttcctttcagtatggtacataaaatccacccaacc

SEQ ID NO: 1187 - DNA, 930 bp, Homo sapiens
gctgctatggatcttttctttcctctttgatactatttcactctttggttaacagcatgcactgtggaggcagactgggttcaagtctcagccccaccatctaccagctgtgtgaccttgggccagttagctaaacttgcagtgcctcctcagtttcctcatctgtataatggaggtcatatgatctactgaagggtaggaacattaaatgaatgagtttataaagctgttggaaaagtacctgactaccctaggcattaaataaacaagcaattatgattctgccccaactcccaaagtcagcaggaattcccaaaaatgaggacagcagcagctcaaagcaggaaagccaggaggtcacaggggacagtgcttccaggaactgggggtgctacctgcctacccttgccctagtggagggggtgtaacacagtagctttctcttacaatttatcagatttcattaaaagcatcccactgctcagccatccatgagtggatgagtccttctccctgtcaaccccagaccatcccccactgcctccctgaaattcttgaaagatccggcccatctcatgctctgatgctttccactagtcttttggatgacagatccctacccaacttcctgtttctctttctgtgggagactagatttaggaagtaaagatcacagggtgggaaataaaagctgtggcccccaggagttctggacactgggggagagtggggtgacatgagtgactccaaggaaccaagactgcagcagctgggcctcctgggtgaggctgggttgggacgctgggattctgggaagggggaagggatggccagccatggcctcagcctgcccaggctctgatttcacgtctatccattcagaggaggaacagctgagaggccttggattccgacagactcgaggataca

SEQ ID NO: 1188 - DNA, 952 bp, Homo sapiens
ctttttatctacccttctgcccatgcccaaggcttcactgggcctcacctgtctttgatcctagataactatttgaatggtaatcagtaaagtctttagaacttagcactaaattctgatttcctggcctcaacatggggacctaaacagttagcaatctgggtttgggagtgggatgaggggagggttggaagaaatatttagtgtgtttcatttgcctttcttaaatacagggcacccctgaaacaggctttgttcgcagctctgctctgtcctcggatttaggttatcgaacaggcttcctccctcccctgcacaagggttgggaatgagtcgatttgctttcactcagcaagagcaagggactagtggtgaccaagtggtagactggagaggcctctgccccgtggcacacagctccaccatcagagagggtgatgtgggtcataggtgagggatctggaggcccggtatcggaagagcttctccaggcactggcattttgacagcaaactgcttccgtggctctttcaggactgttcctggcaatatgttattggcaaggactattttagggctatccagttgtctccccctctccccaaccttttatctagcttatcagtagctatctttccttgctctgtacaaaaacctatagcaccaataggcccagtaatcatgaagggtcagtgcaaggaaaggctggaagcccttcctctaacagccgtgctgtgactccactaactttgtggggtctcccattacatagcgtgggtatcctgagctgtgcagcctgcctcactcaccaccttggtacctgacaggactactggatgtgcctgtccttttgtaggacattctcccatcccaaagatgaggctgtgctgccgtgtgggcaagctctgtggggagaggggaggccagtgggttgtttttgccatcacagaat

SEQ ID NO: 1189 - DNA, 1421 bp, Homo sapiens
tttgggaaagccaaattaactgattcctttcgagctttaaatgttaatattgggggttgaaagcgtttgtataacccagattctcaaaaggaatggcttggctatcataattttttcccacaactgctttgctctgcccaccccttggctcttggaaggatcatccccaaaggcgttggggcctctgagcaacggaagcctcaaaacacggccagtgcagtggggataaagcctccctctaggcaaattcctggggaggagtgtgggtcctggtctccaatgtccataggaccctcccagcggagggcaggcctggaccatcctgtgtctccagatagccccctggccggtgcgagggctgggcttgcacaggtggcacagcccctgagtacaccgaccccccagccccctggtccccagccccaggaaaggagagaaggaaagagtcaggcggggtgtagaactctgcagtgcagacaccacactgagtggcaccaacgcctgacgctgtgtttctctccctcaagggcaccatgccggtggaaaggatgcgcatgcgcccgtggctggaggagcagataaactccaacacgatcccggggctcaagtggcttaacaaggtgagtgggtcagggtgggtgtatgtgtgagagaggtcctggctgaaacacgcccatgcggactgctgaaagtaaaatcgtgtgtattcaaaatcttaggcttattcatgacaaaaaccagccaacccaaaatgatcataaaacatcaagttatcatctcaaaggctttttttcttttagagacagggtctcactatatggcccacgctggagtgcagtggtgcagtcataactcactgcagcctcgacctcttgggttcaagtgatcctcccacctcagcctccagagtagctggaactacaggtaaacgtcaccacacctggccaatttttgtatttttttgtagagctgggatctcgccatgttgcccaggctggtcttgaactcctgggctgaagtgatcctcccacctcagcctcccaaagtgtggggattacaggcatgagccactgaacccggtcacaaaaggatttgtatcctgtacgactgtagcctcagcctggagtctccaatgtctgctcacctttggtgttttggctgactgcctctcgaaagctccttgctttttttggaaagctccttgcttctttgaggattcttaccctcttccttctccaaattccttttttttgcttctcctggccttttaggactagaggacatggaaactccagggttttatattaggaatggagcatttccttttccatgttctctgtttaaagaaagcttgtttttgtctttaaaaaaagccttctttttacctctgtaatgaagccctatctgtgtgtccacctttc

SEQ ID NO: 1190 - DNA, 1765 bp, Homo sapiens
agtgctgacttcccagtacatcctagaatgtgcaccagtatgtcacgcctctgtgcctttgttcttcaaggccagtggaatatcccggatcacctagttccaatctcctcattttacagaatcatcctacattttacagaggaggagaataagcttagaaacaatgacctgcttgagaccgtacaaccagaaccccaccctttatctctggccagcctcttctccctcttctctttagtcctcctctgctgctcactggccgaagtcccctttccgtctttgcctggctcccgtcgctagctccaagatggcagggtagcagaacacagatcctctctgtgccgtgtggcacatgtgctgtgctacaacccacacagcctccctgttctggaacctgtgatttgctgtgaaattgcagtcctactgcagctgtgttgcctctgtgattgctttctctctgtccccacacctgtcacagatgagttttggacctaccattctgagacatactgatgcaagaggctcccaggaaacacttggtactgatcttcctcccctcagctccgtgctcaccactggtcacactttctcctttaaccctgctcccctcctccccttcattcattcattcattcattcattcattcattcctcactcaacaactatttattaatcatctcctctatctcctagatgacaggatctatgcaactaacccagagatgacacagagatgaatgagatgtggctcctgtcatcaaggagctcatgattcaatggggaactaacacttagatgcatgggcagttagggacatgcaagaatctttgtaatgcaacaagagagaagttacaaggcagcacggaagtcaatgccggtgaacccagatggcctggtgagaggagcctggactagaaggtagatgtgtgaccttgggccagctgtttgagctctctgagccttagcttcctcctctgtgatatgaggatgagactctcacaggctgttggttggagtgactgagggagtgtgagtaaagctctcagcattgtgccagcacatagtaggtgatcaggaaacaaatggctctgaaaggcacaagtcctgtaggagtttaagagagtggacatttctctctgcctcatctccctattccctgcaccacctacactttcctctctgaccctactctctctttcctgataaggaattactctcacttccaccacccgatgtatggaaactgctatactttcaatgacaagaacaactccaacctctggatgtcttccatgcctggaatcaacaacggtgagaagctccctgcttgctccatggcgccctctgcttcagccactcacctgtacttaccttgagctcacctcctagagctgctgggaggggtcctgcctgctgtctctccccaataggtgccacatagtccgttccaggcatgagaggaatcccgtcccaggtcttcctcctgcctccagattccagctcaggggttgccaggtccctttgcgggtcttcctgaacttgcttctcttgcagctttagagactgggcaaggaagggagagtggatttccatctcctaactcttttctaggattcccgcctctgccaactctgctctctctgcacccctaggtctgtccctgatgctgcgcgcagagcagaatgacttcattcccctgctgtccacagtgactggggcccgggtaatggtgcacgggcaggatgaacctgcctttatggatga

SEQ ID NO: 1191 - DNA, 2734 bp, Homo sapiens
atccacttcagatgccaatcctaagtcccgggactccagtacttctgatgagttggctacaaattgggagttcccacgactccctcttcatacttgacaaatagctacaatggcccacagaactgagaagcactttacttactattaccagtttattataaaggatacagatgagcagctgatgaagaggtctatagcgtacggcatgtgggaggggtcctgaacacagcagcctctgtccctgtccttgtggagttggggtgcaccaccctcctggcacatggatgtgttcgtctactcgaaagctctccaaacctagttgtttgggatttttatgcaagttccattatgtagacatggttggttaaatcactgattgaactcaacctccaacccctctctcctctctggaagtcggggtggggcgggtgggggtgaggtctgaaagtcccgaccctctcctcacatggcacccagcctccatctgaagctctctaggggctttcagccaccagcatttcctgaatatataaaaaaagacattcttctcactctggagatacttttttttttgagatggagtctcactctgttgcccaggctgaagtgcagtggtgcgatctcgcacctccgcctccagggttcaagcgattttcctgcctcagcctctcgagtagctgcgattacaggcacacgtcaacatgtccggctaatttttgtgtttttagtagcggggtttcactatgttggtcaggcttgtctcaaactcctgacctcatgatacacccacctcgacctcccaaagtgctgggattacaagcgtgagccaccgtgcctggtctttttttcttttttttcttgtttttttttttttagacagagtcttgctctgtcacccaggctggagtgcagtggtgcgttcttggctcactgcagcctctgcctcctgggttcaagcaattcccctgcctcagactcccaagtagctgggattacaagtgtgtgccaccatgcctggctaatttttaaattttttgtagagacagggtttcaccatgttggccaggcaagtctcgaactcctgacctcaactgatcctcccgcctcagcctcccaaagtgctggaattacaggtctgagccaccacacccaggcttactctggagactctttggttcttagtggtccttgtgtcaggaaccagggacagagaccagagacgtttttcactatgtcacagcacaggagccttgccaacacagtcccatcctcccaggcaccctttcccaggctgtcctcttccctcccagcacaggcccccattctcctggatctgaaccacacaaggaggcagaggggtggagtggttaaaaatgcaggcgctactactttctggaggtgtgatcctggacaagagcccctgtgtccctatctgtaaatggagatgataaaacactcctcaaagggcctccgtaaagatcacaggaaacaaagcatggacaacgtgcctggcacgaaggagagcttggtaagtggaggcaagtctgagtgccagagccttaaaaccatggactcttaggtttgaaggaaatcaaaatattcctctctaaaaacctgcggattttagttaaaggtaaaaggttaaaacccaggggcaccctctgccccttctctctgtcttgatcagctcagaagcagagctcagaggatcctggatcagacttgactgttcccatacattcaccttcccacatttccagccctttggaaccctgaagatatcctcttctctgtcctgtcactctatgggacttacggctctttgttaaaatactatttaagcaaggcccctaagccactgccttgagagagaaatacttctcaactgaggcctctactgcataatgggtacagcatgtgttaatcaactttggctgatttttcttttgttaagttgacttttgtttccaggggagcgtgtcaactaagaacctaaacagggaaagaaaagaaatgttttcacccctgcacgtcgtccaaacttcctcctgcgtgtttgagacgacataacggaggccagagaagaggacttgtctgagctcaccaagggtgcacagcccctttctgcacccactcatctgtggatgagaaggggagacaaacaaaggtgtcttctgtttcaaagtgctttcctgtctagggagtggacatttgcctgtttcttgaaacattcaaagagccttatgaatccaaaggcctgcccagaaacaagtgatgagggccctgggcagccaatgggatcgtgctggcctttctacctgcctggggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagaggtatgtgtgagcaccaggaaagggcacaccgatcctggactgcagagccgtgcgcatgtgctgggaagaagcaccggccaggagtcacaggaaagagggattca

SEQ ID NO: 1192 - DNA, 943 bp, Homo sapiens
acaaaatcagaggcaaacagagcttcaccctagaaattggggaaaatgaggaacaggttttctgcacaaaagtttatttgtttctcatttctttttcagaaaataaaggatcgctgttgttcccaacaggtttgtagggaagaaaattggagaaacattattaccttttcttagatgttggcaacggaggcaacaaggactgcaaaagaaaattgtgtgtcccccattcctaaataatcaaaattggcagtagggatggaagagcattggggttttagggctgttagggtttcatcaagccaatgtattccctgccagattttaaggagaaaaaggcgctggaaaattgagtgatgttagccccctttcttatttttcactgctaccaaagactaactctatctctctccccaacccttctctccatctccctcctttagatgtgtttgcacagaagagtgcccagtgaagagacctactccttggatcgctttgcgcaaaatccaccccttttccctcctccctcccttccagcctccgaatcccgcatggcccacgctcccctcctgcagcggtgcggggcaggtgatgagcctctgtgaactactaaggtgggagggggctatacgcagaggagaatgtcagatgctcagctcggtcccctccgcctgacgctcctctctgtctcagccaggactggtttctgtaagaaacagcaggagctgtggcagcggcgaaaggaagcggctgaggcgcttggaacccgaaaagtctcggtgctcctggctacctcgcacagcggtgcccgcccggccgtcagtaccatggacagcagcgctgcccccacgaacgccagcaattgcactgatgccttggcgtactcaagttgctccccagcacccagccccggttcctgggtcaacttgtcccacttagatggcaa

SEQ ID NO: 1193 - DNA, 2259 bp, Homo sapiens
tgactagacactggggtgctacagatgcccgtaagttgtccctttaccctcgatgtccccagtgttgggaccacctgggaatgcccagccttgtgtgctgattgacttgtagtcccctggccctgactggaagcctagttttctctctcatgaccagctaggcccctagctccccagggaagaaatccaatctatttcctctgatagtaatggctaatacttaaataatgccaaccacatgccaagcactttacagttgttagcccagtcttcacaagcaccttgtgaggtgggcaagagtcttatcttactctcattttatagatgtggcccaggatcccacagctatagttcatggtgctgggatttgaacctctggccaccagagcccaccttaatgtgtcctcctcctgttgtcataacagaaaagtacaacaccatgatgacacatcaggctatcctggcaggttcccaggctgccccaatgcccaactttctaggtttacaaagttgacatttacgaagtttccaggtttacaaatctagtttctgattctttagtcagcaggaatttctctacaaaagctgcttcgaaaatttccagccaaaccttacacaccttggcattacatcttggtgagccaaggcggaagagaacaggaagtgaaggccccatgggaagtccctgcggtcgggagcacccaggcggggcggggggtggggggctttcctgtggccggctccctgcccctcccacccccattcaggccctgtgagttgaatgaagagaccctgggaatgagtccaggtctgcagggttagaggaaattgaaggcccttaccagatccctgttgagaagtttatgaattatgagcccttctgcaaatgagagggttcttccctgtcaggagggacagattgtaggtggcaagattggtggcagccagtaggctggtctgctccttcctctctatttcatatgtgtatgaaggcattacctgcagcaagggcctgtgtaaatgcatgtgatttacagagcattttatgtactgcgtgtcattcatgcttccggtgagccctaagtctaagatagggcagatagcatcaggtccattttgcagctgtcaaaatgaggtctgaagggcagaagtggtgtgcccacacacacacaactggttggctgcagacctggggactagacccgggacttcgtcctgcccaggggtctcttgccactgctccccatcaacttggatggctttaagcatttgtgagttgtctgctccctgatggcagaatgcagagacatgaagctacaagcaggttcgctcccaacggcaaaaaggaggaggggtgttcagaacatcaggtgcttctagagaaagcagggagagagtatctggccttgtggacaatgtcacggcagaggccaggtatagggcatgggggtaactggaagcgggatggaccctgttattccctaagacatggcttccacgtagtgctcaaacaaggcctttgcccttgctgttccctccacctggaatattcttccccttccttgacattgctcaggtctccactcttatgtcaccctctcagagagggcttccctggccactttccctaaaatagccacccactcctaggtccctcaaaagcatatcctgctttggattttccctatagcaatatgccctatgaagttattttatttgctaacttgtttcttgtctgttttcctttgttagagcgttggggaccttgtctggcttgttcccaatgcctggaagagtgcctggcacacaggattaagccaacacatatgttttgaatgaatgtgtgcacacatgcatgagctggcggcagtcggggttggggtaagcacgaaggcccagctcagttctctgcatgtgacctcccatcttacgcagataagaaccagtttggtttctgctagcctgagtcaccctcctggaaactgggcctgcttggcatcaagtcagccatcagccggcccatctcctcatgctggccaaccctctgtgagtgtgtgggaggggaggctgggctcctccttgtactctctgaggtgctctggaaggaggggcagctccaccctgggagggactgtggcccaggtactgcccgggtgctactttatgggcagcagctcagttgagttagagtctggaagacctcagaagacctcctgtcctatgaggccctccccatggctttaggtaagctccttccac

SEQ ID NO: 1194 - DNA, 2254 bp, Homo sapiens
attcattccaaggggaagctttttgggggaattcctaccccaggtctttttaccctcagttaccaaccccttgcccaggccagaccttcctgctatcccctcctgggccacaagcctggccctcctctgtcccaattgtgatgaaggggcagttcaaaacttcttgattagtcatcttctcccctatcgacttggctttaaaaaatgaccttttcagacttctagtctcgttcactctttttgatgatgctttgccgtaacccttcgtgggtagagaaggattctgtgcccattggtggtctggataaaagaaatagagacctcacaggaagcagtggactggcctgtttccccactgttctttctgttttcacacctgtggccttctccccaccttcttcccaatcaacctattgtgtacatagcccccctcattgtcctttattcttctggaaagcagaccttggagggaggagtgagggggaggctcagctgtggtctctggggggtgggggttgggagctggggtggaagtccacgaagcatacacttaagatgctttggtgaagttctaaacttcatattacccaggctgaaaaaagagcacttgttcctagggctggaaatggaagccaaaacaccacctttttcagcctgtttcagcatctttagagatcagcccaacccacttacacagttgagcagagttggaggcctagagaggggagggactggcccaaggtcataccaactcatggccagagcctgggcctcctcactggccaggtgttatttcttccctctgggtagggaacctatttcagggacaggattgctatgtggtagtggtggtggggtgcgataggcgtggcaggctgggccacaatttggagtagtcatgccagagtcctgcatttatttattctcaagggccccgcctctgtggcccagaattaccccttcatgctccagtgcaccccaggcttcgtggccagcctgggaaactgtctctaccctggtctcccttcagatcagcttctagaaatgtttcgtggctacagtggcagcactgttttttccatgatgcaagcagtttgccctcttgggcggggttatcagtggctggcagggctggcacagcgtgtccgcccactgccacctgtgggttccaggagggcccagcccctgtgctgatgcccaccaccttctcagctcatgtctggggaagaggactggcagggggaaaggtgcctcctcctgaaaggtgcctcctctgtttttgcctaatataggcttgggaacactttgatgtcagctaattctgactcctttacttactagctgtgcggccttggggcaacttacttagcctctttgagcctcctgttccccatctgtaaaatggaatctcaatagtgtctaatagtaccatgtggagaaacttgtgtgaaatgatagctgtggactactgtacacagtactcaggatgtagtaagtgctcaataaacagctgttggtatggttgacgttatggtagtggttgtggggaggacgtaggaaactggagactagcttggcaaagctggctcttcctccttttagggaaagcttagagcatccccatggggtatacccatactcagactgtcctctggcatcgaggttggcccaggattcagttcagctgtcacagtgaggtggcgggatcagatgtggcaggccatgtcccttggaacttgagtacatcgtgtgatctctggaatgaaaacaggccttcaccagtgttgatggtggaaagcttagggaagtgcttcaaacacagtaggagggacttacgttagattttggaaggacttgcctgattcggaagctccaaagagtggcattacagagctgggtggagagaggggctagccatcttttgtgtcgcccaccgggctcatgtgtcatcgcctctcatgcagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagattt

SEQ ID NO: 1195 - DNA, 905 bp, Homo sapiens
acttaggtggctccctgtcttctagggagctcccaggctgagggttttaaaggaaaaaatacctggtagaaaaggccaaacccatcctttcatctggggcagggctaacgcctgtggaaacacagcctttgttctgcagaactgactgtccccatgcctcccgtctctccttgaggtcccgaaatagccaggtgctgggatacttgatatttccatgccaaatctcagggccccagttattgcatgctcaccacgtataaggcacccaaacttggtcatttagattgagtcttactcaggcctgtgagggagggattctttcccccattttgcagaggaggaaactgaggcaaaatcctgcccatggccacacagctggtcaggggcagagtgggaacttgaaccccggcctcttgaccgacttccctctcggtcgggtgattctcctcacgctgctctttcctccaagctttcaccagctgcagggagcagtttctgcaacaatctctataaaatggggcaattacgggtcagctgggcccaacactctttgtgggtttgttcactgagactccagccagagcccgtttgacccagggagaaatatccactgaagcaacacgggttgttttccctgagccatatgtcacctaggaatggagacgggggctacttctatcttccaaattcatcaatagatgtagagcttgttccggaatgtacagcttgttctggaatgtagagcttgctccggaatgtagagcttgttttggaaaaagtgccagggaagccccgtgggcctctgtctctccgggaacccttcccgctcagggctcacagtggatccggaagcacaggagaccaagagaccagagataccaggatgagagataggacccctggtt

SEQ ID NO: 1196 - DNA, 2300 bp, Homo sapiens
catagctggaaaatggcagagccgggatggaaatccaggacttcgtgactgcaaagcagatgttcattggttagtgaactttagaacttcaacttttctgtaaaggaagttaattatctccatctcacagtctcatttattagataagcatataaaatgcctggcacatagtaggccctttaaatacagcttattgggccgggcgccatggctcatgcccgtaatcctagcactttgggaggccaggtgggcagatcacttgagtcagaagttcgaaaccagcctggtcaacgtagtgaaaccccatctctactaaaaatacaaaaaatttagccaggcgtggtggcgcacgcctataataccagctactcgggaggctgaggcaggagaattgcttgaacccgggaggcagatgttgcagtgagccgagatcacgccactgcactccagcctgggtgacagagtgatactacaccccccaaaaataaaataaaataaataaatacaactttttgagttgttagcaggtttttcccaaatagggctttgaagaaggtgaatatagaccctgcccgatgccggctggctaggaagaaaggagtgagggaggctgctggtgtgggaggcttgggagggaggcttggcataagtgtgataattggggctggagatttggctgcatggagcagggctggagaactgaaagggctcctatagattattttcccccatatcctgccccaatttgcagttgaagaatcctaagctgacaaaggggaaggcatttactccaggttacactgcagcttagagcccaataacctggtttggtgattccaagttagaatcatggtcttttggcagggtctcgctctgttgcccaggctggagtgcagtgacataatcatggctcactgtatccttgaccttctttctgggctcaagcaatcctcccacctcggcctcccaaagtgctaagattacaggaatgagccaccatacctggccctgaatcttgggtcttggccttagtaattaaaaccaatcaccaccatccgttgcggacttacaacctacagtgttctaaacattttatatgtttgatctcatttaatcctcacatcaatttagggacaaagagccccccaccccccgtttttttttttacagctgaggaaacacttcaaagtggtaagacatttgcccgaggtcctgaaggaagagagtaaagccatgtctgctgttttctagaggctgctactgtcccctttactgccctgaagattcagcctgcggaagacagggggttgccccagtggaattccccagccttgcctagcagagcccattccttccgcccccagatgaagcagggagaggaagctgagtcaaagaaggctgtcagggagggaaaaagaggacagagcctggagtgtggggaggggtttggggaggatatctgacctgggagggggtgttgcaaaaggccaaggatgggccagggggatcattagtttcagaaagaagtctcagggagtcttccatcactttcccttggctgaccactggaggctttcagaccaagggatgggggatccctccagcttcatccccctccctccctttcatacagttcccacaagctctgcagtttgcaaaaccctacccctcccctgagggcctgcggtttcctgcgggtctggggtcttgcctgacttggcagtggagactgcgggcagtggagagaggaggaggtggtgtaagccctttctcatgctggtgctgccacacacacacacacacacacacacacacacacacacacacacacaccctgacccctgagtcagcacttgcctgtcaaggaggggtggggtcacaggagcgcctccttaaagcccccacaacagcagctgcagtcagacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggtgggcaaacacctagtctagagttggggagggctgtccgtgagggtgttgagtgtcccagagaggatgcagggcctcagaggagatgctttaggggtgtgttggtggtgatgggcgtatctgaagaacagaggtgtccagggttaggcagtggggggtcttgtggaggctttgagcagtgatggccagaaatgggcaatggggctttcctaggtgggaaat

SEQ ID NO: 1197 - DNA, 1261 bp, Homo sapiens
tagcctgcattcaataaaccctcaatatatttgagaatattaaggaatattgttaatttttaaatttgatcttatcatcttgagatttattattaagtattgagagaaattgaataatgtgggatttccccagttggagtaagggtggctattcctgcttagaaaaaaagaatggaccttgtgtggtcactgccggatggtaggttcattattctttctactttttttttttaaatttaagagacaggaactggctgtgttgcccaggctggagtgcagtggtgcgatctcagctcactgcaacctcagcctcctgggttcaagtgattctcctgcctcagcctcctgaatagctgggattacaggcgcccgccaccatgcccagctaattttggtatttttagtagagatggggtttcaccatgttggccaggctagtctcgaattcctgacttcaggcgatccacctgccttggcctccgaaagtgcttggatttcaggagtggccaccgcgctcggccctaaattcttttatttaacttttaagttcagggttataagtgcaggtttgttataaaggtaaacctgtgtcttgggggattattgtacagattatttcgttttcaaagagaatttgcaagtatgtcacaaaagcctcataaacacgttgtgagattttaagaggcaatgaccgaggcttggagatgtctcgtcctgtccaatgtcaccgctagacctgagaatctgcacttgggagcttacagacccggttctcaggcttcacttgagaccccaagaaagaaaaaaacccaccagccaaagaggaggatggcagcctggaagaacctaaggaagcgaggctcagaggtgaagcactgtggctcctctcccccttctcccccctccgccccctctccttctaagatgaggcattttctaggggagcaaagctgcagcaggaattcggcgaagtggcggagctggggccccagcgggcgccgggggccgcgggagccagcaggtggcgggggctgcgctccgcccgggccagagcgcaccaggcaggtgcccgcgcctccgcaccgcggcgacacctccgcgggcactcacccaggccggccgctcacaaccgagcgcagggccgcggagggagaccaggaaagccgaaggcggagcagctggaggcgaccagcgccgggcgaggtcaagtggatccgagccgcagagagggctggagagagtctgctctccgatgactttg

SEQ ID NO: 1198 - DNA, 2520 bp, Homo sapiens
actggtgctttgacatgatgagaggccttaggagctgcctcagagtcaaggtccctgtaagcttgtcttgttcccccgacaagcacagggagagacgctctctggaatttccttatctgaccaagaacacttctttacaaaagaaatgcaattgtgttaagtctttttttcctttgagacagagtctcgctcttgtcacccaggctggagtgcagtggcactatcttggctcactgcaacctcctcctcctcccgggttcaagcgattctcctgcctcagcctcccaaagtgctgggattacaggtgtgagccaccgcgcccggccagtgttaagccctttttctagtaatctcatcaaatatccaggaaagatcaaccactggagagagaaagagactgggagtcatcaccagacccagacagatttacctgttcttctgaggacagtgccaagagattacctgggggactttatctgcctaggacaacctttgtccctgtgcggctccacctccaccttcccttaaagtcggcctttcacctccagggccattccttcttgctaatgatttactgtctttcaaaagaattgtctgcattccctatctcccttctcccctataaaaaaggctgggtagcctctgtactccactgggttacagggtcaccattcttccgtgattaccccattacaatacatttttgtatgtcttttctcctcttaacctgacttttgtcggttggttttcggggaaccttcagaggaagaaggggaatttttttcaaggccccttagctcacccttgggaggatgatcctttccaatacaatctcagaagtgcctctgggctgtagtggccctaggctgaattccaggaagttttttttttttttttttgtttttttttttttttgagggacagcgtcttgttctgttgcccaggttagaatacagtagcgtggtcacagctcactccagcctctacatcccaggctcaagtgaacctccagcctcagcctcccaagtagctgggaccacaggcatgtgccaccatgcccagctaatttattttatattttgtagagacagggtctccctatgttgcccaggccagtctcgaactcaaagcaatcttcccacctcgactgggctcaaagcgctcttcccacctcaacctcccaaagtactgggactacaggtgtgagctaccatgccaggcctgaaagccatcttaaaaaaaaaatcttagaatgagaatcacagtattgggaaaggactgtatgaatcatctggtccattcgttttgtcctctgggttcacccagtgaccctatttcccccgagttctaaggagtccacctcatgcagaattgattcaataggcgatcagcaagggccagctctgctctgggccctgagcaggcactgagtataagtcagacctgaatgtgcctggaagagtgtcccacgcattccagcagggaagcagtttgtatgacaggtgtcccagtccaggcggataccaggtgctgccagagtgtggaggaggcaggcggggacttagtctcctccctgggtttggacactggcatcctgctttatgtgtgacaccactgcacccctctgagcctcggtttccccatctgtaaaatagaagcgatctaccctcacaggtcagttgtagggatgaaccatgaaaatactagagtctctgttttttgacaggaactcaaaaaacagatcctaaatgtacatttaaagagggtgtgaggaggcaagcagtcagcagaggattccagcaggtgacattttagggagctggagacagcagagcctggggttgctaagttcctgatgttgcccaccaggctattgctctgagcagcgctgcctcccagctttctggaaccttctgggacgcctggggtgcatcaagtcccaaggggacagggagcagaagggggggctctggaaggagcaaaatcacacccagagcctgcagcttctcagatttccttaaaggttttgtgtgtgtgtgtgtgtgtgtgtgtgtgtgtatgtgtgtgtgtgtgtgtgtgtgtgtgtgttttctctaaaagtcctatggccagactttgtttcccaagggtcatatgactgctcctctccaccccacactggcccggggcgggctgggcgcgggcccctgcgggtgttgcaacgcccggccagaaagtgggcatcagctgttccgcctggcccacgtgacccgccgagcataaatgtgaccggccgcggctccggcagtcaacgcctgcctcctctcgagcgtcctcagcgcagccgccgcccgcggagccagcacgaacgagcccagcaccggccggatggagcgtccgcaacccgacaggcaagcgcggggcgcgggacgcgggacgggcgcctttctctcccaaccctgcttgcgtcctagccccaccccgggacactgccacacagcgacagagcccaggagccagaaacttgggctctggagtcag

SEQ ID NO: 1199 - DNA, 1470 bp, Homo sapiens
cctgtttttacgttgtgccatttcccttttccccaaacatgtaggagccaagcagctcaccctggaggacccgcagatgtccatgagccacccctacaccatgacaacgccttacccttcgctcccagcccaggtatggtggagggcactgggctccctgagggcgaggctgtgtgggccagctgcccacatggccagagaaccacagcagcccagacagcagaacttgccatttgctatggctgctccaacagcccagaaaaaccccaggtcactgaacgaatgtctcactttccacacggtgctgccattggtgtggattttaagttggggagggtcgggcgtgtccgcctgttggaatatgcttctcaggtcttctgggaaacagatgttttgtggaagtggaagattttggaagtagtgccttatcatgtgaaaccacagggcagctgatctcttcaggctttcttgatgtgaatgacagctttgtttcatccactttggtgggtaaaagaaggcaaattcccctgtggtacttttggtgccaggtttagccatatgacgaagctttacataaaacagtacaagtatctccattgtcctttatgatcctccatgagtgttttcacttagtctgatgaagggttcactccagtcttttcggatgataaaatgcttcggctgtcagtctaataagggattccctgaggagtttggaggctgtaagagcaccccccgtctcaatgccagtgcttcttatctcagcctctcctgcactcctttacccccgtctcgatgccagtgcttcctatctcagcctctcctgcactcctttacccccgtctcgatgccagtgcttcctatctcagcctctcctgcactcctttacccccgtctcgatgccagtgcttcttatctcagcctctcctgcactcctttacccccgtctcaatgccagtgcttcctatctcagcctctcctgcactcctttaaccccgtctcgatgccagtgcttcttatctcagcctctcctgcactcctttacccccgtctcaatgccagtgcttcctatctcagcctctcctgcactcctttacccccgtctcaatgccagtgcttcctatctcagcctctcctgcactcctttacccccgtctcgatgccagtgcttcttatctcagcctctcctgcactcctttacccccgtctcgatgccagtgcttcctatctcagcctctcctgcactcctttacccccgtctcaatgccagtgcttcttatctcagcctctcctgcactcctttagcaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggtaaggaggataccagtgca

SEQ ID NO: 1200 - DNA, 1247 bp, Homo sapiens
gggcagttctctcctcacttgtaaacttgtgtagtttcacagaaaaaaaacaaaatgcagttttaaataaagaaatttcttttttccctgggtttagttgagaatttttttcaaaaaacatgagaaaccccagaaaaaaaatgattttctttcacgaagttccaaacaggtttctctcctgttccccagccttgccttcatgatgcaggcccaattgcacccttgcagacaacagtctggcctgaaccctattgatgcaactttgcgcaatcaagatggggctccagtgggtcaccaggcagccctgatggactgatggaataaataggatcgggggctctgagggaatgagaccctagagggtacactccccatcccccagggaagtgactgtacccagaggctggtagtacccaggggtggggtgataattatttctctagtacctgaaggactcttgtcccaaaggcatgaattcctagcattccctgtgacaagacgactgaaagatgggggctggagagagggtgcaggccccacctagggcggaggccacagcagggagaggggcagacagagccaggaccctggaaggaagcaggatggctgccggaacagcagttggagcctgggtgctggtcctcagtctgtggggtgagccactccctcaaccccactgaccctccctgcagaaagcactttaaccccacaccccagtcgtcctagaacttttcccagaacccgaggaagtgcctttcaaggtccctcacccaccctgtccaaattttgttagccctcattcccttcctacccctctaccatggtgctatctcccaggggcagtagtaggtgctcaaaacatcacagcccggattggcgagccactggtgctgaagtgtaagggggcccccaagaaaccaccccagcggctggaatggaaactggtaagcggggctcctgttgcagcctcccaacttccagggagaccagcaatgatttggatccccgtcactctgcctcacagtcctttcccaaaggccttgcactgtttaggccctgcttctctgcttctagaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtc

SEQ ID NO: 1201 - DNA, 1476 bp, Homo sapiens
agattgaagacacctccttgcaggtaattttttggcaatatttgacaaaattggaaactccccttcacctagcacaatttccttgaggtatttattctaagaaaataagcaattttagagcaaagatttatctacactgaagtttcccatagcaatcacagtattgtttctaatattagtaatacaaaaagaaacaacctgtatgtctaacactaatcgattctaatttatggtgcaactgaacaatggaccaaaatgatgctgttggaagtttttaatgatgtggaaccgcttgcaaattattaagctaaaagaaagtaggttacaagatagcaggaagaataaaccattaaaaataccaatctgtgcactgacaaatgttataaatattttacgttatgttatgttataaacattttataatataaaaaaatgttaactgaagttacttcctggatgaattacaggtgatttcattgtcttctagaattttcttttccaaaaatgttgtgtatgcgtgtaattattattttaataggagacactctcctttggtgatataatttaaacaggacggtactgactgataacctcccggggaaggcagggagccaagtactacagacttgtatgtttccatggaaatctaacgcgcctttgattatcacagattctggagaagagtgaggacttgggttcaccagtgcgttcccaaggacaggctgggcttctgaggaagttgcccaccctctcggaatctggtttggcctccgtaaaatgggcagatcccgctcggatggcccggttcccggcttccttttgcgggtcaacggcagcgtcacgcgcgcgagcgcggtctgcaaagcccccagcgctgggcgtcacgcggggattgctgtcgccgctgccagccgcagcagcgacgcgaactcggggcgcccggcccgggcgcgcgggggcggggacgcgcacgcggcgagggcggcgggtgcgacgggggcggggacgggggcggggacgggggcgaagggggcggggacgggggcgccccggcctaagcgggactaggagggcgcgccacccgcttccgctgcccgccggggaatcccccgggctggcgcgcagggaagttcccgaacgcgcgggcataaaagggcagccggcgcccgcgcgccacagctctgcagctcgtggcagcggcgcagcgctccagccatgtcgcgcggcctccagcttctgctcctgagctgcggtagggctcgcgagcgcctgtctcgcctgtcgccccccgcccctccacgacaccccctcccgtcggtcgcttgctcacgacgcgctctctctttcttgtagcctacagcctggctcccgcgacgccggaggtgaaggtggcttgctccgaagatgtggacttgccctgcaccgccccctgggatccgcaggttccctacacggtctcctgggtcaaggtaggtg

SEQ ID NO: 1202 - DNA, 1178 bp, Homo sapiens
ttttcagcgctttacttactggctggctatgatttatctttgacacaagcttgggttacattctgtgtacgaatggaacaagcagaggaatttttttttttttttttttgcggtggagggagcgcaaaaacagtcgttctgttctcgctaatatgggaatgtcacgaactacgtccccgacatgaggccgcggatcagaaccggggctgagggcgaactgtgtaagctgcgtctgctacgctgcccgaggtcccgtcatcagccccctctcccacggagcccttctttacctaccccacggaggactgggaaagcccggccggctctgcggaagcttccgtagcagtcgctcccagtagtttcgaagcactccccgggccgcagaccacggcgaaaccaccaagaccagcatggccagcgccattttccctgctggaagaccgccccggtcccgcccctgctttcagcatgcgcacaggcacagaatcgggcaagcctcgcttcttagaactacaacaccccgcatgctcttggagcagctctgactctcctccaatcatagagagtaaaggaaaggtgaggggcggggaaatgaaaggaaatcggccacagtgcgcatgtgtgcggctgtgctttggctcttcgggtaaagatggcggagcgcgggtacagcttttcgctgactacattcaggtatggaaggggccctcgaggtcttcagcgtagtcgaggttgctggtactctgtcgatttagtttttcccatcctgacgtcggcattggtgcttctggagggtccagtagggaatggagttggaaatgcggctttgcaaagtcatttgccaggccgacccgggattcctggagcttccttggtcggaggctgctggagggtcggggggatgcggttttgcggggttaacatggggctgcgggacggtgaggcacatagccaaggattcgctttcactttggagaccagaaaagaaggcagttttagcttaaccatctctgggtggcccgttccgaactcaggatttttttcctggctcaagtagacctgatgcggtggtttctgaaacttggaatcttggtcaaatatgtggggttcccttttcttggaaaactctcagctttacagttaagtcggagtcttggtctccatttggcactagtgtc

SEQ ID NO: 1203 - DNA, 1322 bp, Homo sapiens
actcaggacacttgggaagttgagcttccctgggcttcccctcctctcctgtctgcaaggggtcagtgggctgagatttcagcacttaagcaaagcatttgctcttggccccagagaaaccgggctggctgtggtctcaggaaggaaggaggtgtccaggctcaggcctgggcctgggtttcagggagggcccacgtgggtcgccccttgaccctctctttcagcaaggaagtgatcctttctctacatgggcctcaccttggggaggacaatggtgtctttgaagttgtagtaactgaagtagagatcaaaaggcaatgcagatagactgacagatttcgcctgaagaggggaagcccgaccaggtaataaaggagtaagaggaaggatgttaaggacaattttaggaaacagataatgagtgaatattttttctctctctttcccaatttaaactgaagcaggagaaactgaagctagacataatgattaacttcccaagctggtgagcttcctgagctggttagtgagaacagcactaaggccaggttctcctccccagatgtttaagatgagacaggacaatgcctgctcagagacagggcctggctgaattggccctcaggattctctctgctctgaggtttctggaagaaggccagggcagaggtgtggtgatgtagctgctgggaggacagagctccgagtcacgtggcttgggcgggcctccccttcctggtgtccacagaagcccaacgtcactagctggggtgtgtatggctcacacgtaggccaggctgccctaggcttggtgtgcaagggaggggcccctacttacttgtggcctgtcccctcgtgaatgtgtctcatgtccccagtggggtttttcagtgagggtcatggtctccaggatgcacaaggctttgtgccagaattgcttggaattgcctagttctggaaggctggttggccaactctggcctccggcttttcctttgggaatttcccttgaaggtggggttggtagacagatccaggctcaccagtcctgtgccactgggcttttggcgttctgcacaaggcctacccgcagatgccatgcctgctcccccagcctaatgggctttgatgggggaagagggtggttcagcctctcacgatgaggaggaaagagcaagtgtcctcctcggacattctccgggtaagaggagcaggcattgtcccgtcccagcttgatcctcagccttctttcatccttggccgcgacatgctcccaggcctggggtcagatggggagtgctgactctgtttctgggctgttt

SEQ ID NO: 1204 - DNA, 1115 bp, Homo sapiens
tgaagtgctacttctccactcccttaaatgcccctgtatgccctgaggatactcaatgcatgctaaccaccaaacgaacggatgactcagagcttggaggaaatccacggcaggctggaaagcaaaggcgcagcttatggctcaaggattaggttgttacctttttaaattattgcttttctttaaagaaagggctgtgggggacgcctttcagcactaagagaaaacctcagaaatccttccccctggagacccagctgagaagaccacaccaggcacagggcatgaacaatgtcaaaaagctactgccctgcaggacactggggctggaacaaagatgcctcccagcagctgggcaaggctggctcccacacaagaaaagcagggctgatgtgagcgtcccgcacgatccccacctgctgagacctaatcctgggttatctctccgctggcccagagaaacctgaaaccccccaggcttttgaagggctttatctcctctttccaggaactgggctcagtccctgtactcgctccgaggtgccactgagcagctgctgcccagagcccaggcgagccctggtcccatttccagcttgaccaagtacaagaggggagccagggctgcggatcctactccctcttgctccccaggcatccgtctcacaattagaaaacccgtgtggggagcaaagcaaaaatcacatttcactaacagctactcggggtcgggggcgggcaggcgggaattcctactttcgccataaattgtatgcaaatgggttccttccctggccgagagccaggagtgagtgcgtctttcatgagctaaccctgttccgctgggagggctgttcctttaattcgccaactgaaaaagtgggaaaggatgtctggaggcgaggcgtcccattacagaggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacct

SEQ ID NO: 1205 - DNA, 2086 bp, Homo sapiens
aacagtcccatgactccagagaggacaaacccagaccaaagaaggtaatgtaggagtttgcccttttgtaaaatcctgggcaaaactccgaggctcatctctccaagatactgagaattgaaaggagagggggaaatcccatgggatcgccatctttgggcggaagcccttggtctctgacactgatggtggttctgcagtttaatggacctgtttaactattgcttagtcagtgcagccgtgaccagaaattcttctggtttctcctccttcatcttggttgggtcagatgaagatggcccaatctgcaagaaacactggttgtgtgcttctagacattttaatcttggagggccttgtttataggatggacctggccaaaggaaagatgttacttatggtagaaagcaagaaaaacctagataaacacttttttttttgagaaacactcttgctctgtcgcccaggctggagtgcagtggtgcaatcttggctcactgcaacctctgcctcctgagttcaagtgatccttccacctcagcctctcgagtagcttggattacaggcacacaccaccacgcctggctaatttttttaatttttttgtagaaacagggtttcaccaggtctcgaactcctgggtttaagcaatctgcctgcctcggcctcccaaagtgttgggattacaggcgtgagccacagtgcctggccaaatacttcattttctagatcataagatgcttaactttattcctggcaaaaagttgattcagcaaaccagggctttaagtgaagccggttggggcctgaacccttgacacctgcccagggtggaagacatagcagctgcatctatgggccacctggggtgtagggtgaccagctggaggctgtgagcttctctgctccctgaaatgcctgcacggggcactcaggaagggctggggactgggtgaggaggtgtggacagaatgtcccctggaaactgccccaggggcagcttgagtggcctgagcctgtgtctgtcctactgaaggttggagccccagagaaaagcctctatggaggcacccacttttcagaactgctgcttttgcgggagaacacctttttccaggtgttgtccttagggtagcagggaagactgggaaaaactgaggggcaagagctgttggaggggggagttacatttattgagtgtctattacatgccgggtgctgctgaaggtctgcgggtcctaccggatctccttttagcccctcacatccctgtagattacacgccgttcacagatgaccctgaacccagaagggctgtctaggcccagggcccagctagtgagtggatgggcagaatcagacctgccctggaagggtctgtcttaccctggcgcccaaaatgtgtccctcaccctctgccaccaggacaagtaaattcgagacaccctttcgttaggggctcaagtttatcatgggtctgacctctaaggtcatatctccgccttctcacctgacagacaggaaactcctgaaatgcccctcgcacgtgcaagacgttttccgcggtggcggcgacagggcgcacagtgggaccgcagcacgagctcggagcacccccagagtcggcgactcctgcccccgcccctgccggccggccttcccggggcctaggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccaggtgagtgcgccctgagtcgcgcggctctgcccgccgcggaggggcgcctgggcacgcactcagcgcctcccggtcttgccagccccgccgcagccccggggctgtcgcaggcggggaactgtgagaagtgaccgcagttagcccgggcagtgctgctcttttctggaggcactaggtccgtccccatcccgggccttcctgggcttcctggacacagttgacttcc

SEQ ID NO: 1206 - DNA, 1899 bp, Homo sapiens
tagcacctttgatttctcccaaacccggcagcccgagactgttgcaaaccggcgccacagggcgcaaaggggatttgtctcttctgaaacctggctgagaaattgggaactccgtgtgggaggcgtgggggtgggacggtggggtacagactggcagagagcaggcaacctccctctcgccctagcccagctctggaacaggcagacacatctcagggctaaacagacgcctcccgcacggggccccacggaagcctgagcaggcggggcaggaggggcggtatctgctgctttggcagcaaattgggggactcagtctgggtggaaggtatccaatccagatagctgtgcatacataatgcataatacatgactccccccaacaaatgcaatgggagtttattcataacgcgctctccaagtatacgtggcaatgcgttgctgggttattttaatcattctaggcatcgttttcctccttatgcctctatcattcctccctatctacactaacatcccacgctctgaacgcgcgcccattaatacccttctttcctccactctccctgggactcttgatcaaagcgcggccctttccccagccttagcgaggcgccctgcagcctggtacgcgcgtggcgtggcggtgggcgcgcagtgcgttctcggtgtggagggcagctgttccgcctgcgatgatttatactcacaggacaaggatgcggtttgtcaaacagtactgctacggaggagcagcagagaaagggagagggtttgagagggagcaaaagaaaatggtaggcgcgcgtagttaattcatgcggctctcttactctgtttacatcctagagctagagtgctcggctgcccggctgagtctcctccccaccttccccaccctccccaccctccccataagcgcccctcccgggttcccaaagcagagggcgtgggggaaaagaaaaaagatcctctctcgctaatctccgcccaccggccctttataatgcgagggtctggacggctgaggacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccaggtaagcaccgaagtccacttgccttttaatttatttttttatcactttaatgctgagatgagtcgaatgcctaaatagggtgtcttttctcccattcctgcgctattgacacttttctcagagtagttatggtaactggggctggggtggggggtaatccagaactggatcggggtaaagtgacttgtcaagatgggagaggagaaggcagagggaaaacgggaatggtttttaagactaccctttcgagatttctgccttatgaatatattcacgctgactcccggccggtcggacattcctgctttattgtgt

SEQ ID NO: 1207 - DNA, 1176 bp, Homo sapiens
ccacacaaggtccaaagtcaaactgttggatggggtccaggggatttctgctctgggaacaaagcgtcctgaggatgctgggcaagaggacaaggatgggggtggaaggcgagaggacaaggccctgactcccatggatgatgcgggaggcaaggccctcggcccatccaggaggggctgggttgcttaggggtcgcgtgccaaatgacagtgtgggaatttccttgtcctggcactgcctctagacttttcctctctggcccaagttgttcctcttcagctagctctgccctactgtcttgaacatcatatgtgatgcccctctgatgaaatgaaagattcttctttgctagtgttagcaggaatcaccctttgttcactggaccaaggccaatgagatgacctcgcctgaggaggggtccaaagacattcaagtgcccgcttcgctccttgtcagagccctctgcttgagcagtaacccctcttcccagccctgcccagacctctcccgggccccgttatcttccactgaggccctgattccccaggaggaggtaggaggtgaggccagttgggccagaggcctgggctggtgccagagaaagctgcctggtctctctgtggtgtctggaaaggccagggaagggaggaaaggaagtcctgcctgcagcaccgccagcagcccacaggaatgccacacctcccaatccatgtcctcaacgaccctccccgcattcccactctgctgactagcctttccttctctcccacagctggacgcacagaacagtctctccgtgggaggagacattatggggcgtccaccaccacccctccctggccatcctcctggaatgtggtctgccctccaccagagctcctgcctgccaggactggaccagagcagccaggctggggcccctctgtctcaacccgcagacccttgactgaatgagagaggccagaggatgctccccatgctgccactatttattgtgagccctggaggctcccatgtgcttgaggaaggctggtgagcccggctcaggaccctcttccctcaggggctgcaccctcctctcactcccttccatgccggaacccaggccagggacccaccggcctgtggtttgtgggaaagcagggtggacgctgaggagtgaaagaaccctgcac

SEQ ID NO: 1208 - DNA, 1172 bp, Homo sapiens
gattctaggggctttagccgaatgagtcatggggggcgggggggtttctgggggagttcccagctaatcaacttgggacaggacagcctggaactttcgatggtgcctatccaagtgtggggtgggcacagcagccaagacccaatgtccttatctcaggtaggggctcaggaggtctcccagacaggcagcctccggagagtttgggggtaggaatgggagcaaccagcttctttttttctctcttagaatttgggggcttgggggacaggcttgagaatcccaaaggagaggggcaaaggacactgcccccgcaagtctgccagagcagagagggagaccccgactcagctgccacttccccacaggctgctgccgcttccaggcgtctatcagcggctcagcctttgttcagctgttctgttcaaacactctggggccattcaggcctgggtggggcagcgggaggaagggagtttgaggggggcaaggcgacgtcaaaggaggatcagagattccacaatttcacaaaactttcgcaaacagctttttgttccaacccccctgcattgtcttggacaccaaatttgcataaatcctgggaagttattactaagccttagtcgtggccccaggtaatttcctcccaggcctccatggggttatgtataaaggcccccctagagctgggccccaaaacagcccggagcctgcagcccagccccacccagacccatggctggacctgccacccagagccccatgaagctgatgggtgagtgtcttggcccaggatgggagagccgcctgccctggcatgggagggaggctggtgtgacagaggggctggggatccccgttctgggaatggggattaaaggcacccagtgtccccgagagggcctcaggtggtagggaacagcatgtctcctgagcccgctctgtccccagccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggtgagtgaggtgggtgagagggctgtggagggaagcccggtggggagagctaagggggatggaact

SEQ ID NO: 1209 - DNA, 906 bp, Homo sapiens
ctcaactcagttccttcctccaatgtaaaaatactacaagaacaacatctcacgcttccatcaaatgggaccatgtgtgatattttacactggactacacaataggctggaaaagtgatccgcagagaggctcattgctctaagttcactccctgtaccaactgtcttgcacaaagctgccacccgggtgtcttcttccaacatttcccctagttggacttcaaagtttccttcttgcagcctgtgcggggaccaagaggccggtctagagtagccgcccagcatccagatccgacatccttttccctttcctcaggaagacttggatgcgcgccagcccagcccgggtctccaggttcagctgcggaagcttcccacatggtgcccgtcgcttgggatgcggctatccttgtgccttctctgcaggtgtcccggcaggtagaggaggagaccggtggctggtgttcctgcagggcggggctggggctcctcgatgtccttgcgcttgccctgcaagttctgcgccccaggccccggcagggacggaaacaggccgggaagcagtgacacctggggcagtcagtcatccaggagccgccgccacccgccccacccccagtctccgcgggaggtgtttgtcttcgcctatgctcccggctctttctctttcacttttcttttcgccaggggttgggactccgggtggcaggcgcccgggggaatcccagctgactcgctcactgccttcgaagtccggcgccccccgggagggaactgggtggccgcaccctcccggctgcggtggctgtcgccccccaccctgcagccaggactcgatggaggtacagagctcggcttctttgccttgggaggggagtggtggtggttgaaagggcgatggaattt

SEQ ID NO: 1210 - DNA, 1433 bp, Homo sapiens
ccctttcgagatttctgccttatgaatatattcacgctgactcccggccggtcggacattcctgctttattgtgttaattgctctctgggttttggggggctgggggttgctttgcggtgggcagaaagccccttgcatcctgagctccttggagtagggaccgcatatcgcctgtgtgagccagatcgctccgcagccgctgacttgtccccgtctccgggagggcatttaaatttcggctcaccgcatttctgacagccggagacggacactgcggcgcgtcccgcccgcctgtccccgcggcgattccaacccgccctgatccttttaagaagttggcatttggctttttaaaaagcaataatacaatttaaaacctgggtctctagaggtgttaggacgtggtgttgggtaggcgcaggcaggggaaaagggaggcgaggatgtgtccgattctcctggaatcgttgacttggaaaaaccagggcgaatctccgcacccagccctgactcccctgccgcggccgccctcgggtgtcctcgcgcccgagatgcggaggaactgcgaggagcggggctctgggcggttccagaacagctgctacccttggtggggtggctccgggggaggtatcgcagcggggtctctggcgcagttgcatctccgtattgagtgcgaagggaggtgcccctattattatttgacaccccccttgtatttatggaggggtgttaaagcccgcggctgagctcgccactccagccggcgagagaaagaagaaaagctggcaaaaggagtgttggacgggggcggtactgggggtggggacgggggcggtggagagggaaggttgggaggggctgcggtgccggcgggggtaggagagcggctagggcgcgagtgggaacagccgcagcggaggggccccggcgcggagcggggttcacgcagccgctagcgcccaggcgcctctcgccttctccttcaggtggcgcaaaactttgtgccttggattttggcaaattgttttcctcaccgccacctcccgcggcttcttaagggcgccagggccgatttcgattcctctgccgctgcggggccgactcccgggctttgcgctccgggctcccgggggagcgggggctcggcgggcaccaagccgctggttcactaagtgcgtctccgagatagcaggggactgtccaaagggggtgaaagggtgctccctttattcccccaccaagaccacccagccgctttaggggatagctctgcaaggggagaggttcgggactgtggcgcgcactgcgcgctgcgccaggtttccgcaccaagacccctttaactcaagactgcctcccgctttgtgtgccccgctccagcagcctcccgcgacgatgcccctcaacgttagcttcaccaacaggaact

SEQ ID NO: 1211 - DNA, 1174 bp, Homo sapiens
cagccggattcagagaaatttagcgggaaaggagaggccaaaggctgaacccaatggtgcaaggttttacggttcggtcatcctctgtcctgacgccgcggggccagcgggagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcggtgagtgcccgccgcagcctgggcagcaagatgggtgcggggtgctcagcgcggacccggcggcagcccctccggctgagtcggccctgggggactggagtcaagtgagctgtctgcgaagtgcattgggctccggaaagcagggctgggatttgcgctaaaccgttggagaatgtgtctgtggaagcaccatttggttgaaagaaaaagagaaagagaagaaagtttgttgggcaggctgccggcgcgcagttttgggcgaggtcgctagagctgcagcacatggcagaaagtaaccgttctcccggatgcgcacagtcgttgtctggactaacaggctcctgtgcccaagggctcgccaagccccaccgggctgtgtctaggcagggcagagctgggcggggcagagactggggctggaacagggcgagtggctgttatcaaggtggtcacagaagggatcacaattccaagtgtgagactagctggcaatgggttttccagaaaggggtcctgggttctcccagctccccactgagccttgttccaaagcttacagtccg

SEQ ID NO: 1212 - DNA, 1175 bp, Homo sapiens
gtatcattccaaaccctgctgtctccacgaagtcaccttccttggagaagaagggggaaatgaagaagaggaaagatatgaggaaagaggagcagagagaaagagaaatgagtcttttaaagtggcagaggaaggagaatggtaaacagcaggagcgaagcggctgaggagaaagaagaggaaagaaaggcgagacgtgggaggattggaacagagacaaaagggaggagagacggacagcgacaagtggagaaaatcggcgaaacttgagtggcagagaagtctgagcgctgagacccggcggccccgtgcgccttcccacctggcgccgatccactttcctcggggtagcggcccaacccacttcgctgccagccgatcccttttacccgtggctaccgggaccactctactctcgcccacttggctctgcctaagcgtcctagccggagcgcggtctctgccacgtggggaggggcgcggccgagttgctgaagagcgcttctgattggccagagggcggggttcttggcgtctcgccggccagacccctccctcaaaggcggggcctggagatccacagctggaaagggcggagccccagcagggcagctggaaaggggcggggcctgacgcgcgcggctcgccgcggcgggctgggggcgccctggtctgccataaagtgaatgggcgccggctgggggtggcagtacgcggtgaggctcactccctccgagagtccaggagcgcccgagcggagaggcggcccgggagcaggggggcggcccccactccggccgggtgcccggcccctggcccctgcctgccctctagatcgccgccgcagccgccgctactgggagtctgcctgttgcaggacgcactgtgagtgtttgaccattctaaggacaggggctcatggggccgaggagctattgctggaccttggaatccctaaaacgagacctggggcagctgaactccggtgccttgggaacaggtcgagaatgggagggcggactgcagacctggggccaggacttgggaaaagggaaactcagggtaagaaccaggggatagggaagggggagactcagaggatccggaacgaagccggagacttgaaaccaggataggggcttcgcgaggcagggagtagggagtctggaaaccat

SEQ ID NO: 1213 - DNA, 955 bp, Homo sapiens
tgttttgtcggtgaaggattttccacccatgaaggggtcagacgtgaagtgtgtggccctgggcagctcctctgagcccagagacgccagccctagccgccttgctgtgccactttgggacttccctccctagcctgagcttcagttttcctgcctgttaggcagccccatgtcaactgcacttagtaggccgggtttgatgcccgacaagacgtgaagtggtggaggtgggcaggatcccagcgctaccatcttcttgaaccagtgatctcaacacatcggatttctgtttcctcatctgcaaaatgggatcagtgagctcaggtgggtcacaaattctacaggaactactttagccaagaccggccccctgaaagttcccctcggtgggctgttagggtgattgttttcatctgtggggctccctgatgcgtcccacccaccagccttggagagggtgggatgggagggtggggtgcttggggagacaagcctagagcctgggccctcccaccccactgcctccccccatcccagggccccccacccagtgacaaagcccgtggcacttcctctacccggttggcaggcggcctggcccagccccttctctaaggaagcgcatttcctgcctccctgggccggccgggctggatgagccaggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataag

SEQ ID NO: 1214 - DNA, 1114 bp, Homo sapiens
atttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttctgtttctggtctcttttctctatcgaccagggagcacaggagttatgggtggggggtgattttgcatttgtagaagcgtccagatactaggtttttaatagaggaaccccaggagggtggaggtgcttggggatccggtgcctagctcccttgcttaggcccgggtccagggctggcgcggggccgctgcaatctctgggaagcgggggcttctgggtcgcgctcagctctgcaatgcatgcgttctgtgatcctggtgagttggtatccttctctgaacttcctctgtgacaggcagagaagaggggtcgatgacaagatagatggaaagcacctggaaattggcaggccctgagtgggcgctggacgtgtggggccgcgggccgaactgccccctcctggcctcatctcctggtgcgccccgggtggggagggaaagctgactacatgcacgtccccagccagcgcgcggcctccgcggtgtggctcctagtgcccggggaagaaccctcaccctccctattcccagcagccctggccgccccgcccccgccgcagctgctgcacccacccccaccctgcccggccctttctgcaccgtcatctcctgccccgccgaggcttgacccgtgagtggggacgcccaaaacgggccagaccgggagccccactcccggctgtgggagggaagggaaaccgagattgggcagaatcagcgccccaccacccgctgcggcgctcgggggtcgggggggcggggtgggtaggactgtgggccccgccctgccgcaggactctcaagctctgggactgggtggagggaggtaaggggcggggggggaaaatccgtgcagtcgcacatgcgcaaaggctcttcactgtcccaag

SEQ ID NO: 1215 - DNA, 1182 bp, Homo sapiens
tgtgtgactttgcagttcaacaaattcaaattcagccaacgctggcagggcctgttgtgccaggcaaccagctaggaggaggagactcggacccagcttgcagctgaagggcgctggctgccgggttctgtgggttcaccttgcggtgtcttcccttgctaacactgagtccttacaatagccccatctccaggttgaggctagatggaggggacagagggaagtgacttgcccaaggtgacccaagctcccgagtgccagggcaggatctgaattcaggctctcagactgcagagcctgagtccctccctgccatgcctgtgccagggtggaaatgtctggtcctggaggggagcgtggactcctggccttggctctggagacatccccctagaccacgtgggctcctaacctgtccatggtcactgtgctgaggggcgggacggtgggtcacccctagttcttttttccccagggccagattcatggactgaagggttgctcggctctcagagaccccctaagcgccccgccctggccccaagccctcccccagctcccgcgtcccccccctcctggcgctgactccgggccagaagaggaaaggctgtctccacccacctctcgcactctcccttctcctttataaaggccggaacagctgaaagggtggcaacttctcctcctgcagccgggagcggcctgcctgcctccctgcgcacccgcagcctcccccgctgcctccctagggctcccctccggccgccagcgcccatttttcattccctagatagagatactttgcgcgcacacacatacatacgcgcgcaaaaaggaaaaaaaaaaaaaaaagcccaccctccagcctcgctgcaaagagaaaaccggagcagccgcagctcgcagctcgcagctcgcagcccgcagcccgcagaggacgcccagagcggcgagcgggcgggcagacggaccgacggactcgcgccgcgtccacctgtcggccgggcccagccgagcgcgcagcgggcacgccgcgcgcgcggagcagccgtgcccgccgcccgggccccgcgccagggcgcacacgctcccgcccccctacccggcccgggcgggagtttgcacctctccctgcccgggtgctcgagctgccgttgcaaagccaactttggaaaaagtttt

SEQ ID NO: 1216 - DNA, 1157 bp, Homo sapiens
gatccacttttaacccccagaaccagaagactgtccttcagctgtttcacatcccttattcaaggccacctagggcccagaagaggagggattggggtgagcccagccccctccccgcagagctggtccaactagctttgcctgactctcacattggccttatcagcccaggaggcctgggtggcttcctgggaggccctctgggggctctctgacaccaagagcccagttttcccaagggactctccaaaggggtggtgggcaacaggatctagggaccctcccagggtctgtggtgggaggggtctctgggcaacctataaagggggttttctgggtcccaagagttagggggtgggtctgcatagggaccttgcccagacagccccttgggaggccacctgaagaagggaccctggggatcctccccctcggctgcatggatcgctggggttttgggatatgagtggctcaaaagtgaaatccgtgcacctgcttgcttccccctcccacacccccaacactccaccaaaggcactcttggggttagaaacctcccagcgagagggaaggggaccctcctcccgacaaggtccaggtattgctctctgaagaccttctaatcgtgtccgtgcacccatttcgcagaagggaatgcgaacgctgggagctgcggctggaagcctggacgccgcgtctccctagcgcagcagcccggctgggcgtcggaccttacacgatcccttccccgggatgacgccggattctttccagcatcaccccgaccccagcgaggcgcccacaacagggcgtggggcccggccgcccgcggtaatgacagggcccgcggcccgtgggtggcggcggcggaggaagctggaggaatctggctatttctggtcggggcgcgcccgctggcccgggccagggttggccagtcctccgggcccccagctctgccctccctctcgcgtccccagaagggggcggggagagacgagggttggcgggctcagggggcgggggcgcagggcagcgggggcggggcggtgtcccgggaccacccccggcctcctcccaccgcggtccattcaggtccctgcaccgcactccgctcggaccccaggccgccggtgctgtcgctactcaagtgagtc

SEQ ID NO: 1217 - DNA, 1161 bp, Homo sapiens
gtaatacgggaaccacctacgagcaggggagcctcatgaccctgtttggcaaggccacgcgaggaggcagtgccctctcctcccacacgttcctacacctgctggtctgagcaaaggtcaaggtgggtgccacaactcgcagcagccgagggctggacaggcgacctccagaacggcctagggacgccgctgtagcccttctatttccccaaatccgaaggactggatgcgaccccatgcttcccaaacaaaaggaaccggcgggtcaagggcgttgaaaaccatgcggcacgaaggagacgaagtcacgacttctagccattgtgtgacagcccgaccccagcccaaagccgggctcagaccacctagcagttccgcccctgccgcaggcattaccgatggcgcctcccggagccggccaatcaggggccccggaggagaacacctccctacgccaaccaatgggagaggcaggccacgcgatggctctaccccgggagccaatccaagcacgagggacggagtgcgcacatcgggagaggagagggtggggctgtagcaccaggtcagggaacgcgggagccgcagggttccagggatcccgcggctcctcgcggcttggcctgaccggcttcctccacatacgcccctctcctacacaagtccggccctcggcgctcctgccgaagcagcaggcgcctcggactctgcgcggctcccgccggccactcacctatgatggtccgcgccgccgagacgatgaccacaggatctgagcctgcattcatcttgcttctcctgccgccgtctgccctgcgctgcctgcaagctaggcaaagctcctcctcgcagcccacaggcctgccgcgggcgggacctgaggtagccccgcccctcgccctccacctccccgcgcaccacctccccgcgcatcccactgtgcgcaggcgcaaggccggagcaggggcgggcggaggcgcgcggggcgcggggcgcggggcgcggggcggaagtgaggccggggcgcggggcgcggggcggaagtgaggccggggtctgggcttgcgggcagaaccgcggacctcggacgcatttacagagcgcctgaaaccccagtgtttctggacaccccaatgttggagttccccgacttgacgtctt

SEQ ID NO: 1218 - DNA, 1254 bp, Homo sapiens
agttctctttggaccattcctccgtcttccgttacacgctctgcaaagcgaagtccccttcgcaccagattcccgctactacacgccccccatttcccgccctggccacatcgctgcagtttagtgattgactggcctcctgaggtcctggcgcaaaggcgagattcgcatttcgcacctcgcccttcgcgggaaacggccccagtgacagtccccgaagcggcgcgcgcccggctggaggtgcgctctccgggcgcggcgcgcggagggtcgccaagggcgcgggaaccccaccccggccgcggcagcccccagccttcacgccggccctgaggctcgcccgcccggccggccccggctctcggcttgcaaagtccctctccccagtccaacccccggcccccacaggcctcggcgccccgccccgccccaggccccgccccagagagttctataaagttcctctttcccacctcgcactctcagtttcaccgctcgatcttgggacccaccgctgccctcagctccgagtccagggcgaggtaagggctggagtcgggcaggaggaggggtgtgaggctgataccagagaggacccggagcgcgaaccagaggttcgacctccagggcagcgcagggtaccccggcttcggagcgggaagggagcgcgccccgtcctggagctccgactcccaccccatctgcgctgagccggaggcgctggtttgggctccaaggcccgcctccttggctctgcccgagcctccccgcctgccctccgcgctcctgcgacggggtcgccacaagctggacgggatgagctaaccggactgtcggggccccaggagtggctgaggcggggccgtccaaggcacccacacaagacggcacaactgcctgcgagaaacaggcccggccctgtggaccccaatccgaggctccttcccctgctcttcgttcctaaggggcccaagctcacggcggcctccggcgcggtgctcacccgctggcgcaggaggaggaggagctccacatttgggtcgctccgagccttgcgtgcggtggcctagccggcctggcgcggtccctgcctcccaggctccgcagctgtcgtcgccctctcccgcgccctccccgcctccgctctcccgggcctgctccggggtccggcggacgctctgcgcgcggaatcccccgtactggggctgcagcccccgcgtctgcgccacttgtcgtttgcagagcccacttagt

SEQ ID NO: 1219 - DNA, 1487 bp, Homo sapiens
aacttttccaacttttccttccgtgccctcctccgagcgcggcggcgtgagccctgcaaggcagccgctccgtctgaatggaaaaggcaggcagggagggtgagtcaggatgtgtcaggccgccctcccctgccgcctgccccccgcccgcccgccccagccccctatataaccccccaggcgtccacactccctcactgccgcggccctgctgctcagggcacatgcctcccctccccaggccgcggcccagctgaccctcggggctcccccggcagcggacagggaagggttaaaggcccccggctccctgccccctgccctggggaacccctggccctgtggggacatgaactgtaagttggttcatggggagggtggaggggacagggaggcagggaggagagggacccacggcgggggtgggagcagaccccgctgagtcgcacagagagggacccggagacaggcagccggggaggagagcagcttcggagacaggaggcggcggaggagatgggcagagagagacacagacaggagcggatggaggcagccaatcagaggcgccgcaggagggacgggccagacagggccccgagagggagcgagacgcggagaccgagcaggggcagggacgcagggactggtgccgggagggaggtgacccccatcgacccaggccccagggagcccgcggggaccgggagactccctgggattccggcagagaggctccggagggaaactgaggcagggtccgcggagagcggagcaagccagggagtagcgaccccagccggggggaggagagagactgggcgcggggggaaagcggggagagccgggcagatgcggccgacggaggcgcggacagaccgacggctggcgggcccggggggcgggctgggggtgtgcgaggcgcgggcggccggggagcgctgattggctggcgggtggccgggtgggcggggcggccggggtgggctgcggggagcgagctccggacccccgcgccccccgcgccccccgcgccccccgccgccagctctcccgctcccgcggcccggccgggcccatggctctgcccctctccgcccaggtgcgctgcggcccgggcttctgccgcccacccggcggggctcctgggagggcgtctaaggggtctcccgtgggagaggtccgtgtctcccgggctccgtcctggcttctggctccttcccctgctcccagccagctcgggctcccgcggcccggggagggggcaggttctggcctgtgcctcccccaccatgccccgccccggggcccagattccggcgtccgggggcggacgggagacgcccggcccgtctacccgccccgggccgcgtctgctccgacgggcggggcagccagagccagggagggagagggaagcccgcctggccctgcgacctgcccgcgggcgttccaccctgggacttaagacctccagctccatcctc

SEQ ID NO: 1220 - DNA, 1725 bp, Homo sapiens
acaccctaaggacagtgaccaagacactacaaacaacatgtcttctgttgctgggattcccgaggatttttgccatacatctttttatgtgacttctgggaaacaggaggaagcaaatatcatttgggagagcagatctattaaaaaaggagcttttcacatagccatcaaatggagatagaaaacaggtctctaactctttgaaacattttttcccttgactatgatgcaaataaatttccagttcttgttcctggccaatttcagctcaacttagtttagtgaaacataataaatgttttctgaggacctttttttgtggcaagtattatgatggtagctgtagagtatacaaaactgagtaaaacacactcttggcccttagaagttcatagcctggaagtataattttaaaaatacacaaatagtagaggaatatgttaaaacaatgctctgaaggatccagggagggaaggatttcctggaccaccctattcctgcatcttcgcagggtgggacaagggggagggacctgttgtttttcagaggccatgtagtacaagttatgcaagtgaagaagtcactacagacagtttattttctcttgcagctttaggtctatttatagtccagttcctggggtaaaagtagcttattaaagcattgtattatttgatgcataataaagtttgtatatatagctaatacttctattaaaatgtatgttgaattaatagcttttcaaaatctaccatttgataatgtatcaattctatagtaatcaaaagctaagaaaaggaaatagaagttcattacctagatatttccattaaaaacaatcagctgtttaattcagctagagaatttattagttttaaagactcttgccataaagtaaaacaagaaatgtgagaatacaacctttcaaatgtttccaaagcagtttcaaagttcctgaatacatattttatttagtgagtagcacctatatgcatagaattcagataagcattatgggaaaacttaggaaatacaagtttaacagcaatacaaaaaccacatagcagtaggagagaattggacttaagatatgtgcccaatgaatagtgcaaattttaagtgccatattaaggagggagatctcacaaaaggggctttgaggtttgaaataacaatgccagctaacaacctttatatatatatgtgtgtgtgtgtgtatatatgtatgtgtgtgtgtgtgtgtgtgtgtgtatacacattttagagatgggggtttgtcatattgacccagcctgttcttgaactcctgagctcaagcaatctgcccatcttgggctaccaaagtgctgggattatgggcctgagccaccatgcccagtctctagctaacactcttataagcacttattcaggcattctgctagtcattgatgtgtgttttcttattcaaccctcacagtcacatacacactgttaggtaacagaaacctgactgaaatgggagagttctctgaccctcttatgggacttgcaacaggggtgtggcttgtttgcttggccactgcacattcaaaccccttaagggagggggagcacacagacaggcaggtgcaggagacggggtgagcgcttttgggctctagccccatggcagcatctaggggtgtgttacaattaatgctcttttagcagttgctgttcgcggatggctaagtgttaaaccag

SEQ ID NO: 1221 - DNA, 1197 bp, Homo sapiens
cttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgttttttttttttctttttttttggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctactttttgtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggtttgtattgaactaacaaggtttgcagatctgctgacttatataaagctttttgattcctactaagctttaagatttaaaaaatgttcaatgttgaaatttctgtggggctcta

SEQ ID NO: 1222 - DNA, 913 bp, Homo sapiens
agaataacctagagcacagggggagaattgaaggagctgttactgaggtgacataaaagcagtctaaatgacagtaaaatgtgacaagaaaattagcaggaaacaaatgaaacagataatttaagataaacaattttagagcatagcaaggaagttccagaccacaagctttctgtttcctgcattcttacttcttactacgtgatacatctagtcaccagggaagaagcgaatgacacacttccaaaaaccaattcgtagctttctaaataaaaccctttcaagctggagagagatccatgagcatagagatcttaaaattcatgttcagcaataaatcctggggccccagacagtgtcaggtgcatagggggtgttcagtaaatatcagttaaatgtatgcataaatcgataaacgggattcctggaaaatactacactctccttctccaaattatcttcatctcaaagacaggaacctctaacttttaattctttacttagattatgctgtctcctaaactgtttatgttttctagaaatttaaggcaggatgtctcagagtctgggaaaatcccactttcctcctgctacaccttacagttgtgagaaagcacatttcagacaacagggaaaacccatacttcaccacaacaacacactatacattgtctggtccactggagcataaattaaagagaaacaatgtagtcaagcaagtaggcggcaagaggaagggggcggagacatcatcagggagtataaactctgagatgcctcagagcctcacagactcaacaagagctccagcaaagactttcactgtagcttgacttgacctgagattaactagggaatcttgagaataaagatgagctctgaaaattgtttcgtagcagagaacagctctttg

SEQ ID NO: 1223 - DNA, 1200 bp, Homo sapiens
ttttaacaagcatggttgccgcattcttgtgcttatagttgaacatttcttctttcagacacttgcacaaagggatacttctaagatgcatttgcattaggtggcaaacttcatcctgggtatgaaaaacattgagatttgggaataaagcatagtaagactgaggttgcaattactaaaggaaaaccccaacagagataagtgaagttctgcaatatcatgcaccctcccccaacccgctctgtctccccaggccccccttcgttagaacacccatgactggctatattatatcagcatttcccataatgtaaaaagggaaaatacagacctgggcgttcatggaaagtattctaactctcacaaccagaatccctgtctttgaattttttttcttggtttttagatctttaacttttccttcagcatttcagtactcaactttttgaaaatcatcttttctgaggaatgatatttcctggcacagcatcatctctgtcaagtgactcagtttgatttttttgtttgttagtataaagtggccccaacttacagagaaaaagtgggctcttggtatcagtttgatgtcagggtttttccgtgtttgagagggagctttaaataccactcgatttgaaggtgtctgcaagcgagctccagtccgctgtcaagatgcttctggccatggtccttacctctgccctgctcctgtgctccgtggcaggccaggggtgtccaaccttggcggggatcctggacatcaacttcctcatcaacaagatgcaggtaggctgcagggggagcccatgggaaagacagctactgacaaagtgaaatatgtatgaggatgaaaaaactcggggctgactaaaggttcttatctctctatctactttaggaagatccagcttccaagtgccactgcagtgctaatgtgagtgaatgctctttaagaactttccaaattaattttaattttcacatctggaatcttcactctgaaatttcccttgcaggtgaccagttgtctctgtttgggcattccctctgtaagtatagtgaaataacataatgttgaccttggatttttttggtttgtttttaagtaaaaataagttgctttatttaatatttaatgttatacattgttgcttaatttaattgttacagattagtattccctgttaaaaccacattgtt

SEQ ID NO: 1224 - DNA, 1448 bp, Homo sapiens
ggggagggatagcattagaagatatacctaatgctaaatgatgagttaatgggtgcagcacaccagcatggcacatgtatacatatgtaactaacctgcacattgtgcacatgtaccctaaaacttaaagtataataataataaaaaaatgtgtccatggctctgggaggagcatgtttgttttcctcatttcccagtctgtaaataagcaaattgaaaggggttagtgataatgtccatctccagaagctgtcagatttcctttgtcaaactctatgatttgggctgaagtaggtgttggagaggcagctaccacgtgcacccagatggccactcgtttaatatgttaccatttcccattattttcgcaggatagatagccaaagtggagccctgagagatttcttcatttttcctgtcataaagaattggtaattcagtagtcataggagtttgtaataaataactcacattgatttctctgttctgaaataattttgcttcccctcttcccgaagctctgacacctgccccaacaagcaatgttggaaaattatttacatagtggcgcaaactcccttactgctttggatataaatccaggcaggaggaggtagctctaaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacaggtaagggccaccccaggctatgggagagatttgatctgaggtatgggggtggggtctaagactgcatgaacagtctcaaaaaaaaaaaaaaaagactgtatgaacagaacagtggagcatccttcatggtgtgtgtgtgtgtgtgtgtgtgtgtgtgtgtgtgtgtggtgtgtaactggagaaggggtcagtctgtttctcaatcttaaattctatacgtaagtgaggggatagatctgtgtgatctgagaaacctctcacatttgcttgtttttctggctcacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtggg

SEQ ID NO: 1225 - DNA, 2571 bp, Homo sapiens
ggtcacaagatatgcaacttcccaatttctcctgcagataacatcactactgtagaacctaagtttggccttctgagataccttttcaggtttttttttgcattgagatactgatgatggttccacctggacccaccaacagctcctgcggcaccacccagaagccattcagcctacaggaggtgaatttcccacacctctatgattgcaccccccaagcagtcagcagcaagctccctttgcctagccacattcatctcctcccccaaactacctttcaaaaacttttaacctgtgagccttcgatgagattgatctgagtaataactctttactgcaatgcgatggtttttgtgcagcaggtacggtatctatctcaccgttggagacattcttcaaggaccttgtaactgcacacttggaagtttgttaagggggtaaatctcatgttatgtggctgatttgttttgttttgacacagggtctcactctgtcacccaggctggagtacagtggtgtgatcataggtcactgcagcctgcagcacgcccaagcacaagaaatcctcctgcctcagcctctcaagtaactgggactgcaggcccgtgccaccaagcctgtttttttttttttgtagaaatgaggtctcgctttgttgcttaggatggtctggaactcctgagctcaagcttaagtgctgggattacaggcatgagccactgtacctggccatgtttttttttaatgtctcacacacacacacacacacacacacagcctgttgtatgggggcgggggaatgaggagagccattaaataaataagcacttaaaatagaatgtgactggtgctatcgtagatttaagtaccagatagatgctgtaccagaaacactgaaaagggacacctggcccagcctcgtgggagcgacagccaagaagtctttctggcagagctgactgctgagtagagttaatgggttgctaggaattagtattgcacagggccaatttacccattaggcatttagtattggggtcctgaaaaaaaaattaactccaaaagaaaaaagtataaaatctaaattaataggtgcatcactatttaaacttaatatgcatttaaatgccattacattagaaactagaggagttgtgcatataaggagaaccctattctgaaggactttctacactcatacacaaaccttggagttgactcaagtccatgagaagccactggcagattctgtttgaaaaatcacagccaagttcgcagattagagaattccctctggtggccaccctttatcataggctttggaggcacttgaaggtccaagatggggtggttagaacttgacgtggcatcatcagtgcctgggaaggtcttctagcctctaatcttgagattttccagttctccattttcgtggccagcttgactcattcttacctttgaagtccctttgtttgggaggccgaggcaggtggatcacctgaggtcaggagttcgagaccaacctgactaatatggtgaacacccccgtctctactaaacatacaaaattagctgagtgtggtggcacatgcctgtaatcccatctactcaggaggctgaggcaggagaatcgcttgaacccagaaggtggagtttgcagtgagtgagaatgcaccactgcactccagcctgggcaacaagagcaaaactccgtctcaaaaaaaaaaaaaatccctgtttcatagtaggtagttattcagacatgagcagggcaggagagccccctgccccaccaggaatgtcagacaaccatcagatgatggtcaggcagttgttacactgtctctctaaaacagtaattggtcaaagccagcaccagcaaagacagtctcccaatagatagaaatatctcaaactggtgatcaacagtttcccattaagatctcaggagtcaggcaagtaggctcaagtatgtgcactaagaggcaaaatggcagagttcaactggtatgtgacctaggaacacttgactggtcaagaaggaatgcctcaagtgagcatgcgtacaactccagtaagcacactgtgcatgcagcccctccctagtgctggcagaccactgcgcatgcggaatgccagcatataaaaccccaatccaaaggtcaaaccaggcacttgaatctctccagtcacctgcttggcacttttccaagtgttctttactttcattcctgctctaaatcttgtctcggtctctcactctgccttatacccctcagttgaattatttcttctgaggaggcaagaactgaggctgctgcagactgatatggattcaccactgctaacacctcctggttggaactacaggaatagaactggaaagggaaaaaaggcagcattcaccacatcccaatcctgaatccaagagtctaagatagtcccccactcctatctcaggcttagaggattagattaatctcctggagggaagactcttccttgaaacatttttttttatctgcctgtagctattgggataattcgggaaatccacagggacagttcaag

SEQ ID NO: 1226 - DNA, 1353 bp, Homo sapiens
gagggctgatttatgagggtacaattgtatctttcagatatatttgtccaagtctacatctttaaaataaatggaagcaattatctgaatatttcaagggagggaaccccaccttcccatcccccacccccgatttgagggaagtctagtatgttaggtgaagagaaaaaaaaagaaaagaggaagctctaaagggagttaggaacaaaacaaaacttccgttaagaaatatccctgcttctcttatcctaagagaagaaaaacagattcccaggtgccaccggggagcaatgttttacttaaaaaaaaaaaaagaaaaaggaaaaagaaaaacctgtaagaagttgtcctgttaaatcaacgacacatggagtctgaaggaaatcagccttttcgttacaaacaggtttaaaaagccctggagaagagagacgtgaacagaagcaatattatccactaacaacctaactcccgcttagacatcagctgagagatcagcagcatcattgaacaggggggtttgtcttaagataatgactcatcttgatttctttcaggatataaaacttgtatttaaatcaattcagagaagcacttgagctttaaacattagagagcagggagagcctatttaataaacagcattatttcattttcaaagaatgatactggcagtagctctaagtttaaattttgtattattttcctcaattataattatagatgggtctgaaaggaagcatgcttattactgtcatatttattcttttgacaggtgttatgggactgtaatttggtgaaatgattcaaaacgcagattcctatccaaacacaattcttgtcatcaacacgagaggttcaggaaaagtcctccagcaagcctttcagagatcttgaacaccccatattcatagcacaatccatattcaggaataaggaggagagagtgcctttagggcttatatccggcgtagcaacagccagaaggcagagtgggtgtttgaggtaacaggtaacgaaggctgttagtggggacagctttcaactgggtggggtcggatctaggaagaggcacccagtaggaccccgagtcccgcgcgcggccggcagagggcgctgggctcaccgtcgccgggcaggggcggtgccgctcagtccccggggcgcaggcgcactcgtcgccgcggcggcgtccggggctggcgttcccctggaggctggtgagccgcgctgcgcaggccgaggccgagggcgggggcgcgggggcagcggcggccggagccactgggtggcgggggcgggctagggatgtggaggcctcgggtgtcctcggatctattgaagacctagggg

SEQ ID NO: 1227 - DNA, 2578 bp, Homo sapiens
ttcatttgatggatttaccacccagtcttactttccttcattgggagtaggagaaagcctggtgatggaaggaaagcccccggggtcagaagaccagatctgcactgtgtggttaggcaagccagtttactcagatcagctggccacagggttctcatccataaaagaatgtctgtgaggttctcccatcctctgacatcctaaaatccaatgagaaagggactggtcaagccagagagattattgttatagtttagtaactttttgaacttctcagagcctccaagatagatcatggaggagggaactgttaactgctaagcttgactttactgacaggagtaaaaaaaattgtgttaaggttagggaataattttaacagtcaatttgttcttgtgaacaaatttcaacagtgaaattttagatatgtactttttaatggtgccaagcagcagttattatagatcaactgctgtttggcaccattaaaaagtacacttcgcaccgtcaaaaagtagatctggccacaattagatcagtcagggaaaaacacttcgcaatgaaatattatttaccacgttttcttcctccctcttcttgaaaatagtaatgattttagcatttttaaatcttgaagaatgtcattccgtactgactaaaaagcctgtgcaaacacccaacatcttctctttcctgtctattttaatggatatacaaaataaatattcatctaatttatcaatatttaaggcacattgtgtatcacaatccaatggtaaacatttttcttatcaaatggctgatcttgacattgtttaaagccctatatgatttcagaaaagtcagtgactccaagtggaattgcaacaatttcttgggtcttgtaacaaacctgaagtgtaactatttctcttcagctaccttcaatcccagagagcaaagaatcacatcccaggtggagctgaagatctcttagggaaaatgactcaggctagagcctgcataaaaagaggattgcatggcttagttttgcaaacataaattttgtgggtttcagagctggcagagagctcaaagaggaaatcatcaagggcaactttctgcttcgaggaaggaaagtctacaagggctaaacctggatgtgctatttcagttcaggcaaaggaggaaaattaaaattttgcacagttttattctgttaaaacaagtggttcagtaagctaaacgagatatgtatatagtatgcattaaaatgcaagactgacttccctgggaaaacgtgggaaagaaggagagaggaaacaaacaattcttacactaagaattctccagtcgtgtcttgcaggcaatatagagtaataataataaaaatgacaggagatactttgacaggatggcttaaaatgccactcaatagatgaagagttgttctcatgcttggcaagtttacagcaaagcccagaaggagaagccagaaaataatttagaaaaaccaaagcttaaaactagtggcacacaactctggttacatttttcattttcatttttggttcctctgcatttcggtggaactcagtcccacagatgtcttcttcaatgtgggaaccatcctttctggaaccacagagctgcagatgtcacgctggaattctcccagaggcaaactgccagatgtgaggctgctcttcctcagtcactatctctggtcgtaccgggcgatgcctgagccaactgaccctcagacctgtgagccgagccggtcacaccgtggctgacaccggcattcccaccgcctttctcctgtgcgacccgctaagggccccgcgaggtgggcaggccaggtattcttgaccttcgtggggtagaagaagccaccgtggctgggagagggccctgctcacagccacacgtttacttcgctgcaggtcccgagcttctgccccaggtgggcaaagcatccgggaaatgccctccgctgcccgaggggagcccagagcccgtgctttctattaaatgttgtaaatgccgcctctcccactttatcaccaaatggaagggaagaattcttccaaggcgccctccctttcctgccatagacctgcaacccacctaagctgcacgtcggagtcgcgggcctgggtgaatccgggggccttgggggacccgggcaactagacccgcctgcgtcctccagggcagctccgcgctcggtggcgcggttgaatcactggggtgagtcatcccttgcagggtcccggagtttcctaccgggaggaggcggggcaggggtgtggactcgccgggggccgcccaccgcgacggcaagtgacccgggccgggggcggggagtcgggaggagcggcgggggcgggcgccgggggcgggcagaggcgcgggagagcgcgccgccggccctttatagcgcgcggggcaccggctccccaagactgcgagctccccgcaccccctcgcactccctctggccggcccagggcgccttcagcccaacctccccagccccacgggcgccacggaacccgctcgatctcgccgccaactggtagacatggagacccct

SEQ ID NO: 1228 - DNA, 2298 bp, Homo sapiens
gactttgcatcagtcacaccatcttttgttactttgggacttccccagctatgttcaataattactgttcttccctttggccccattgtaatggctacagcatcgacaaaaagtctacactttgaagcattaaggctcagacatcagcaccaaattttacatctttaccatcacttcaagtgaggtgaggagccagtagcctggacactggtctcatctggtgaaagactgtgggtaatggaagcatttctgtggggtggtggcaggacatgtgcatggtgaggcaggtcatcagcagcaagtgagagctgcctcttactttctaaaggtgacatagcaagtatacaaaaaaaaaataaaatattaatttaggcagagcacataaaggctttatttcatattccatttctctgtatgctttcttcaccaggaagaaatagttttagtgtcaggaatgaatgagtctgcccctcaattccagcctgctcagcacacaaggaaacaaagccctgacaatcagagtgactccctggtgactaagctccagtcctggatgcatatttgtttagcagttctgacagcatctgacccagccctctctttgcataccccaccagaaccttctttttttttttttttctttgagactgagtcttgctctgtcggaagcgattcccgtgcctcagcctcccaaatacctggaattataggcgtaagccatcatgcctggctaatttttgtatttttcatggagatggggttttgccatgttggtcaaattggtctcacactcctgacctcatgtgatccacctgcctcagcctcccaaagtgctgggatgacaggtgtaagccaccatgctaggctcagaaatttccttttataaaaatgtcattaaggatcttggctgcacaatatcgttaccagcttcctttaaatccacctctggcctgccaggaatcagggttcttcagaacctgacattttaaatgaagaggtcaggcaggtcatgaggaaagcctcattgtccccatgtctctgtcactgctgcacccctgagacatcacagacatggacactggggcctgcttgtttctcaaactgcccttagatcgaaagagggaggaaccaggatgaatgccactcattttcccaagaaaggccctctcctgagtgcccgggatggggctctgtccattgcctggggccgccaattgctactctgggttacggaagaaggacagggtcctgagagacaccagagacctcacacagccctgaaaacatggggctccttcataagtgtttcccatcaccaacagggagaccacgtggaggccttgcagccctactcggtgcttctccaccaaatcccaagggcagtgacgctgacgtctgtggaaagcagagaaagccctggctcccaaagccctgaagtcctgtggagctgacattccctgagtgacggtgtgaatggaaggaactcaagtgcgggtggtaggccacctcctggcccaggcctgggtgaactctgaggggacacatgtagtcacaatcccatcctcccattctccttctcagaggaaggaagtgggcatccatctgcctcatctctctcccgtggggaagatggggagtttcaggggaactttcacataaatttcaccagctcagatctcctgtgaggatggggcccaccatgctcccggtgctgccagaggccctgagcccctccagggtccctgggtttgagccagccctgtatcatccccaggagctgaatgtccgagcaatggatagaattagatggaaagagctctcaatttggcctgagactgtccccagatactcaggaaaaacaggacgtcgcacagagtgggcagcaggtgagtggcaggttataggtcctgagtttgagtttgttctcacgtgagacagacccagcccctcactccattcacacactgggttttaaatggtgcaagataggaggaattttctggtcccaagagcaggaggaagggattttctggggtttcctgagtccagatttgcataagatctcctgagtgtgcattgttctttgaggaccattctctgactcaccaggtaagtggctgaattctaacctctgtaatgagcattgcacccaataccagttctgaactctacctggtgaccagggaccaggacctttataaggtggaaggcttgatgtcctccccagactcagctcctggtgaagctcccagccatcagccatgagggtcttgtatctcctcttctcgttcctcttca

SEQ ID NO: 1229 - DNA, 1463 bp, Homo sapiens
ttccggaatgtacagcttgttctggaatgtagagcttgctccggaatgtagagcttgttttggaaaaagtgccagggaagccccgtgggcctctgtctctccgggaacccttcccgctcagggctcacagtggatccggaagcacaggagaccaagagaccagagataccaggatgagagataggacccctggttgccaggttcgagaagtcctaggctgagtccctggaaagttagtcttgctcctttctggcacacagtggggcctcaagaaagctcagtggatggatggattgagggagggagggaagagaaggccgagggagggatggatgaagggatgagtggatggataggtgggggggtaggtgatgcatgggtgagtggatggatgggtagatggatggctgattagatggatggctgattagacagatacaaggatgggtgagatcggaggattatctgggttttgctacaggaagggacatgggtgtgtctgtttttgcaggtgtgtctgcatgtctgtacctgagtccatgcctgcatgtgtgtctacctctgagtagccacatctttgtgtgtctgtgggtgccctctctgattttgcgtccacatctgacagtggcattggtgtctaggaggtctgtgtgtgtgccaggtgcctctggacacctgctcatctgtgtccacagctgtgtgtggctcgcggtcaaggctacctggctgtgtcaggctgtatctatgtcctggtgtgtgtctgccattcgaatctgaatttgtatccatgtcactgtgtctgcgtggccagccgtgtttggtgtatctgtgggagtgtatctgtgtttgtgtgtgtatctccacagccctgtcttggtgtgtctgcgtctgctctctgtgtatgtatatctgagtatgtgtgtgagtgtgtgcgtgtgtgtgtgtgtgtgtgtgtgtgtgtgttgggggtggggaggtgttcttgatcccagatctgacctaagagtccacatctgtgtgtccaggtgcaccccggttccgttgtgtgtttctatgagggtgctgcgtgtgtctgtatctgagtgtgtgtgtccaggtgtctgttctccaaggtctgagtctgtgggtccaggtgtgtctgtatcctgggctagttgtgtgtccctgtccgctcccccagggggcgccctcgtccggccgccgtccctccctcgggctccggtcccctgggtgagccccagcgctggcggcgtgggcccgggactgggcaatgggtggcctcccaggtcgccgccttcccgcggggccccgcccccggcccgccccaaagcgggctataagttagcgccgctctccgcctcggcagtgccagccgccagtggtcgcacttggagggtctcgccgccagtggaaggagccaccgcccccgcccgaccatggccgagggtgagtatcagagtcac

SEQ ID NO: 1230 - DNA, 1145 bp, Homo sapiens
ctgagggaagaactttcaagcagagccgggtctcttcaggagcgactgcagcaaccctgatgcttggatggagtccaggcaggtgatggtagtgaagaccttgccaacagagtgggcgctggagaaggagccctttagtggggaccctggggccacgactaggctggcaggcccagccagcaccaattaatccatgagtattgcccagcattgagcctggagcaccttccagcccctggccagagtcctgggtgttctgggaaaaacccctaaacctagtaactcctctccctactaggcctctttgttgctgaatctctggaatttaggggccagcagctttctgactcaggtcagccaggggttcatgttccctcacttgccctccccctgcctggcccatctctggcctggcccctgggaggaatttcctgggccagagggcagccgaaagcacagatgcccaccccagcaacgttcccgccacctgcccaggccagtgccccgtgcccaaccccagagggtgcgggatgacagactctgacaatcattaaaccagccgggcctgatttcccagcactgcctgctaagatccgggccaagtggcactgaatatgcaaatcacctggggccaggagcccagtctaaaggccaggaaatcccctccatccaatgagacaccagctcaggttactgcaggggacacactataaagccctgagctcagggaggagctccctccaggctctatttagagccgggtaggggagcgcagcggccagatacctcagcgctacctggcggaactggatttctctcccgcctgccggcctgcctgccacagccggactccgccactccggtaggattccccgcctgtcattccctagcccagctcttgggaaactgcagaggggtccagaggatttgcagttctgaacctgcacactccagtctaggatctccgagcaagagcgtaggtgtcctgagggtcaaagaacagagagagattgtctctgggaaggcagaatggccatgacgccgctagtctggctccagggccccagagatctgaggagggaagcccagctggaggctcctgtggtcctgccctggtctgagatcttggagcccttcttgaagag

SEQ ID NO: 1231 - DNA, 1492 bp, Homo sapiens
caaaacaaaactggtcaaagccttgagttatgtgtgtatacgtggtgtgggggattccccaactggagtggactggggagtcctgcaggcttacccaagggaagactggacttctatgtggctggtttccacatcactgaaccccaactttctacagctgggtcggcctcttccttcctctttcacctgtcagctgcccggccgttgactaacagctaccctaatcgggccacccctcctccaggtctccaatcccagaggagttaccccagcaacctggcaatgctcatcaagtctcaacgcgtggtggctgtgccagagaattactacaacacctgcaaggctgtgcgggctcctggccgcaccctatcggccgggaagaacaagcgagggagttcctactccaggaccgtggggttctcccgcggctctgacagtccccaggagggagccccaaactcccggtgccagctgcagccgcctcgctttccgagaagctttcggaagcttttcgaagtcggagaagcaactgccccggggctcacctttgcgctgaagaggtgccgggagtctcggggaaaaggcaccgctgtacagaaaggaaacattgtaggggggttagccgaccggcaacatcgcgacgaacccggcgaccccacgccccaacaccctagcccgggaattcccccttcttcagacagatacccaccccgcaccctcttttaatccggggcaggaggtatccgtccctggggcacccgcccacctcccaccacggcgaggggcgctgcacagggggaaagggagggcttgcaccccaaccaagctgctttgtgcaacgctgtcacccgaaatccgccacggcccccacgcacgcccccggagtggggagcctcccacctctgagcgccagcgaggcggtgcgcgccgccctggactgcgggcgcctctccggagccgcgcgccgcgcgcacaggacggctgcagccgcgccgcgagccccagcctcttctcggccgccgccgccgccgccgcttccgcccctgtcacggcgtgacccggggtgggaggagccgacaggactagggatgggtagggtccccgccttcgctttagccgcagcgctcgctccgccctgcccatttccgccgctgcgcaaaccccggcgcttggggaagtgggtggagtctgtgcaacgaggtacggggcgggagtggagacggggcgccgggagagggggcgggaactgaggcggggcgcgggaaagaggcggggcgcgggaaagaggcggggcgcgggcggaggcggggcgcgggcggaggcggggcgcgggcggaggcggggcgcggagaagtggcggaggtggaagcggaggcgtacccgcccctggggacgtcattggtggcggaggcaatggccggcaaccagctgtaagcgaggtaggctcactcgggcgcggagggtgcgggtgagaaagggaacgatttgctag

SEQ ID NO: 1232 - DNA, 1166 bp, Homo sapiens
gccaaggaatgttcaaagagctagcatgtattgtgggattactatgcgccaggaattttttacactgcatcacgttccatcttcacaacagccctagaaaggaagaactattattacccccgttttataggtgaataaacaagggcacaggtccttgatgtaacagccaggatcaaacagctgggaagacgagaaaacctttcccaggctaggataacagaggatttggttgaaaatacaggcaattaggtgctacctctgggaaaaggggccaggagaggaaggagacacttttccctgcatgccctgatgtcctatttgaacattttatcatgaacacgaacttcctatttaaaaaacactttttattgaaaagataaatctgtgtgttgtattgtgtcactcagttcaagtacttgaaatttattgaattgtattttctaaaaaatagatagttgagtaaaagcaagctcacattacatagacggatcacagtgcacggctgcggagctgggagcagtggcttcgtttcatgcaggaaagagaacttggttcaggagtgtctacgttgcttaagacaggagagcactaaaaatgaaaccatccagccatcctcccccattttcattttcacaccaaagaatcccaccgcggcagaggaccaccgtctctgtttagacaatcggtgaagaatggatgacctcactttccccaacaggcgggtcctgaaatgttatgcacgaaacaaaacttgagtaaatgcccaacagaggtcactgttttatcgatcttgaagagatctcttcttagcaaagcaaagaaaccgattgtgaaggtaacaccatgtttggtaaataagtgttttggtgttgtgcaagggtctggtttcagcctgaagccatctcagagctgtctgggtctctggagactggagggacaacctagtctagagcccatttgcatgagaccaaggatcctcctgcaagagacaccatcctgagggaagagggcttctgaaccagcttgacccaataagaaattcttgggtgccgacgcggaagcagattcagagcctagagccgtgcctgcgtccgtagtttccttctagcttcttttgatttcaaatcaagacttacagggagagggagcgataaacacaaactctg

SEQ ID NO: 1233 - DNA, 1756 bp, Homo sapiens
acatagccttcagggagaggaaggggaggacagaaggtcctgggcattggcctctggctggaaagtgaggctggtccaagtcccctgttggaacctccaatgccaagctcaagctgagatgcgttccctctaagcccccatactgtggttgagttacttgttattctttgatgataagatctggggaatttccgtgtgctggtggacaggaagccaggccctggatggctgaaaggaatccagttgcccccacccctgcctcctttctctgctgcttctttctcttctccttcctgcctccaccctttcatgctctctcctccctcatccctccaggtgggtcacaggaatgcagccaatgtggcctcggtgactgtccccagagtaaccttctagaacagggcaaattgtctaaagaatggttgagactgaccatacaggtttcctcttcccagccagcatctggcccaagaccaaggccgtggccactggcttgtggacggagactttcaaaggtccagccctgccctggcctccacctcctagaatagtcgacagttgggccacatcctccaagcccccggaggataatgtttttcttctttcctgtggagctagctagaatttccactctgcaccaccaggtcttgacctagtaattttcaccctcttttgtcctttttggcacaaaagtttggttttcttccccagatcacatcatctgatgagaggttggagcagatccacccagggaatgaaaggccaaagaggtgggcaggtcggggcagcattttccaaagaggaggacgcagaccaccagtgttcacggtcaaaggttcaaggtcaaagcctgaaccttgaatcccacagtgagaaagtgactgtctcctcgggtctcaatccgtccttctggtgacctcctggggaaagtctctgagggtgctgatttgcctctggcctcctaagccttgccaatctccctctttagcagtagactcaggtctgaaactcagagtccacagcacatcactgtatctggccagaattgaatatgcatgactttgtttgtattttctctctttttttcccccttgagacagggtctcactctgttgcccaggctggagtgcagtggtgcaatcacggctcactgcagcctcgaccttccaggcccaagcgatcctcccacctcagcctcccaagtagctggaactataggctcaccccaccactcccggcttgaatttttgtattttttatagagacggggtctcactatgttgctcaggctggtctcaaactcctgggctcaagcaatcctcctgcctcagcctcccaaagtgctgggattacaggcgcgagccactacacccaactacttgtatttatttactgctcctccctgcctcctacaaacagaccccaggtctgttttcttaaatgctaaactacatgaatccttaaaatgctaaactgctaaggtcctccagcctcagtgttcttttcagaaacatggggctaagaaccacacttcagtgggtagctttgttcctgccatcttctttctcatccccatatcactgtgcggcttttgctctgcaacgacccttggtcttacctctgcccagcaggtgataagatctgggaacagagaggaaacagaggggaaacagagaggggaggtcatctccccgggctcacacagccagtgagtggccagacagggcctgaggcaagtctcccaatctgagcactt

SEQ ID NO: 1234 - DNA, 767 bp, Homo sapiens
gagctcctctcttctccctccactttatatcccagcgggcattctctttcctccactccccttcttttattttctctctcacccccatccagagacgcacagacccaaatgtgcacaggcacatgctcgctgtctgtgtcttgtcatctcgtcttttgtcttggatcttaccttgtctttgtccctgaatctccttgttcctctcatctctcccggtgtttacatctgtctttttccctgagcctcgctccctccatccattcctccgccctctcattttttttcccgactccctcctgcctcctccctttctcctttgattttcctggtccctcatctctcctccctcctctttctcactctcatgctccctttttcgctctcttgagtacatgcacttgctttctctctcttgcttttcctctttctcaccttagctcctggcctcgggcgctgtctacaccccaccccatccctcgctctttgagaagcctctgtgcagtgcccaggtcctggcggcccagcttggaagttcctgtggtaccccttgagaggccctagggccacagcatttcctcccaggggtgacttggtagtgatacgctctgtttcttcacttctgcaattgccagacagcatagaggctgaggctggggccaggacccagacagagacacacggtcactgcagctgaagccgctgcccctgctacaggtaagggggaatcctggcccctgctgggcaagggggaggcatataaaaatgtc

SEQ ID NO: 1235 - DNA, 1107 bp, Homo sapiens
attcggagatctcttgtcagtggggcttctggacaactgagtgggttgattgatgcgcggcccagcacgcagtagtgctcgaggcagggagcgtgtttatcaagagggataaacttgatacgaactctgtacgaaggaaggtgtaggtggatggaggggtgtgtgctgccactgagcacaagaaccccacggggtggcctgccaaagttcaaaacgagggagacaggttgatctggacccaggaactacagtgctgaatcctaaaccggggaaagatgagacctagaagagggaggtggtaacctaattggagggtgaggagggaaagagcctgccacagatggggcatctataggggtgctgttgaataactgagagcagctgacttaagcccgaagtgggtacttctccctgggcagatgggaggtctgggacaggctcctctggcagaagggctcctggccaccctgtcctaaggtgggtcagtcacttcctccttcaccagttccacagcatcttactatgagcttggcattcgaggcttctcttggcagggccctgcactcctagcctctccttgcacattgcacccccattccagagaggtttagttaaaggcgggggttaccaagtcagtcagatcttgggcaagtcaccactcctccagagcctcagtttccttatctggaaagtggaggtcatggcaacccgccaacctggttggatgggagcctgagctgttgtgttgcaccttgcctggggcccacgactttgtagctcctgtcctgcactgggcttatgttttcattcattccagaaaccttttcagagagtccctttggggagtgtgggggacaggagggaaagaaacctggtccttgtagccgttcgtctgctccctgccctgggcagaggacgtggggactcaggccagcctgagatcactgggaccagaggaggggctggaggatactacacgcaggggtgggctgggctgggctgggctgggccaggaatgcagcggggcagggctatttaagtcaagggccggctggcaaccccagcaagctgtcctgtgagccgccagcatggatgacatctacaagg

SEQ ID NO: 1236 - DNA, 806 bp, Homo sapiens
gagctccctccaggctctatttagagccgggtaggggagcgcagcggccagatacctcagcgctacctggcggaactggatttctctcccgcctgccggcctgcctgccacagccggactccgccactccggtaggattccccgcctgtcattccctagcccagctcttgggaaactgcagaggggtccagaggatttgcagttctgaacctgcacactccagtctaggatctccgagcaagagcgtaggtgtcctgagggtcaaagaacagagagagattgtctctgggaaggcagaatggccatgacgccgctagtctggctccagggccccagagatctgaggagggaagcccagctggaggctcctgtggtcctgccctggtctgagatcttggagcccttcttgaagagacggtgtccgcagagttgctgatcttcctgcccctgggggctactcttgcccagggttgggcaaagcagagtagctgggagtgtaaggagaggaccctcgtcccctcaccaacctcatcctctctccccctacccacaggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacaggtgggtctcagcggggtgggatggggcacggagtgggagacagatccatctaagggcctgttagacaaatgggggaataggc

SEQ ID NO: 1237 - DNA, 1031 bp, Homo sapiens
ttctgcagcattctctctctcctgcctttcctctcgcgcccctacatgctctctgactgccgcgggctgccggtgtagctccaggtgtacccgagcccgggagaaagtgttcagttgaccaggctgagtgtgttatcaccctgtttcatttccagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaaggtgagcaatg

SEQ ID NO: 1238 - DNA, 1013 bp, Homo sapiens
atgagatcagctctcggaacaaggcaagtcccggcagggccaagcccagtgccgcagctaatggcttcaaagcagccagccagccctgggcacctgcgttttcgctcttggagccaaccgttgccctgaggaccccgcaggcccccagccagagcacggcccagcggctcaggcccaccgcccagacccggagcagtggcagcgcggtgggcaccagcagggagaatatgcggggcagcgcggtccggagcagcacccagtcggcgagaagtagcagtactgtccccagccatgcgagagaagctccggggaggcagcggcacccgcggggagcgggacacctagagctagccattggcactcggacgccgtcccggtcccggccgggcctgggactctccgcgccccggtggggcctgaagctccgggtaccgccgagtcctcccctactggcggctgggggagggaacgagggcggggctctcggaaagtcccaggaacaggctgatcctgcgctggcgagaagctcagccatttaggggaaagcgaaatcgaaagcggccgcctgctcactagataacgcctacttccaaaagtggcctgcccagactattttggtagcaagcgtggaaatcagatctgagaatctcgggagcagccctggtgcccaattttctccatcacgcacacccttctcgcctctccctgcctcctgcctttccacttgcaccagttttcccaccccagcctcagggcggggctgcctcgtcacttgtctcggggcagatctgccctacacacgttagcgccgcgcgcaaagcagccccgcagcacccaggcgcctcctggcggcgccgcgaaggggcggggctgtcggctgcgcgttgtgcgctgtcccaggttggaaaccagtgccccaggcggcgaggagagcggtgccttgcagggatgctgcgggcgggagcaccaaccggggacttaccccgggcgggagaagtccacaccggggtaat

SEQ ID NO: 1239 - DNA, 1094 bp, Homo sapiens
aacatagcccatttgaatgttggaaaagaactgtcagaaatacaagttcttattttgtactttggtaacatgaattttacacttagttgaacatgaagaatcaaaaaagctctggattgttgtaataattgtttagaattttagatgtaccatttgacctttgactttaagatgaatttcagtgtcctcagtaaataaaggcttacccccaaccttaaatagtgacgcacaaaggctattattaccaccactgagtggcttaaataatcctgtcaacagcaatcgcccatttccaaagccatggtgaaacatctctgtgctaatttcttttgttttgtttcctaattttttttttttggcaggtggtgggaaataatctttgtcttctttggagtaaaccttcaacaccggattttttcttttaattatggatgtaaaccccaatatccccataatttacattgggtctcgaccaattgcctaattataagaggatatatttaggctcttatttcatccacacaaaaacttgtgtaacaggtagttggaaacatctgaggcaccactttgattctgttttggatggtcatgttttttctcctccgtttccccagcatgtctgccaccatcctcatgcactgcttccaagtgcctgggagcctttatgagcgtccctaaacctaaaagaatccagaggcggggctcggatgaaccctcgagataagcaagtgagccgcttctcccctctaaaggatgtttacacgtgggtggcactcgctggaatccagcgctcgggcagccctgggaggacgcgctcagctgcgaggaggtgaccggcggcggcgcgggcagtccggaggggcgggacggggcggggcaaggcgggggccgggccggaggaggcgggctcccgggatccgcggtgtccggcagtagagctcgctgcagatccgggctctgaccatgatttggcgccgcgcggcgctggcggggacgcggctggtttggagcaggagcggctcggcaggctggcttgacagggcggcgggagctgcgggagctgcggcagctgcggcctctgggtacggggtcag

SEQ ID NO: 1240 - DNA, 1005 bp, Homo sapiens
cttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccc

SEQ ID NO: 1241 - DNA, 912 bp, Homo sapiens
gcccagttgaaggtgtctcttatgtgtgaatttttttttttttgagacagtcttactctgttgcccaggctggagtgtgcagtggcgtgatcttggctcactgcaacctcctccgcctcccgggttcaagcaattctcccgcctccacctcccgagtagctgggattacaggcatgcgccaccacgcccagctaatttttgtatttttagtagagatggggtttcaccatgttggccaggatggtctcgaatccctgacgtcaagtgatccacccatttcggcctcccaaagtgctgggattacaggtgtgagccaccgcgcccagccacttacaacatttctaaccctccctctcacttcttcccaaccagaatccttgatcttgtgggcatttctttctgttctataaaaccatttatctggcatgtctttcagtacacaaagttaggcgtgcccagcccatttgtacaccacagggcaggaggctagccaggctacagtatgagaccagaggattggcactacccactaggaaaaccagcaggactcttcaccagtcagtctatgctgataggcagacaaatgcacatttgacaggcagctattggggaaggctgctgaaacagaagataccagccaaatcccctgtagccttcttggccatgggcctaccccttcctccctctgcagaactgcactgagccaggggacaaaggtcactgtgtactctgctataagccaggatccagcaataccctttctggctaggtcctccaactcccggaaggaggggaggtgtgtgcagttgttttttgtctgctaaacagataaaaaggagctaaaatctagacccaccagataagcaaaccagcactttagagtataacatccagtgatggtcaaactgttca

SEQ ID NO: 1242 - DNA, 1004 bp, Homo sapiens
ttgatttcataatcccatgaccctggaaaaccaatttggggtgtatggaggaaaaacattttaccaattaaatgtataataccacctttgttaagtcttccctgtgagtcttcattcttcctgtaagagaaatattaactttgttttactatcttatgaccatttatttagtaatcttttagaatattgaagtttatattttcctgaactattagctgttcccataagaatcaggtatattgttaatatgttgttacagtctgcatgtttgtcctaaaatttgtatttttacttatgaagagtgttttaatttagccaagtagaggccattttatatatagaaactatacatttcttggtgtcttaaggaatcagcacttttagtagtaattccatagatgaaggccttatataccatatagtaagtttgtgatagattcaaagatttcctataggtttgcattcaagaagaggtacaacttttcctcttggagtatctgattattactgtggataagaaagccctgtaattaacgggaacattaatatgccttatttttagttctgatctcaaaaatgattagcagccaacttcataatacagttctctcattttgtaatattttcttctttgctcaaccaaaagaaggtttaaatttatgattgatgaatttttctaactgaaggctaaaaaaaggctgattgatataaagtaggtagaatgtaagagttctttctgtgaatgtcttcattattttttttggaaatggaaaactaaatttgtaataacatattttaggattaagcaaaaaactaattaatctgagttttttgctttatagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaaggtt

SEQ ID NO: 1243 - DNA, 989 bp, Homo sapiens
tccaacttcccaacgaactaaaagctacctatcttgaactatgcagttttggtgtttatacataggaaaatattttggaggcatggtggtatgtggaaattcctgtttcataaattaaagtcatttgtcagattggctaaacagctatttacagagcatcagttccttccaaatttttaagccatgttgttatatgtacattatccaagttaatgatatgaattttctctgatttctacattttcaactctttgtttttattttagtggattcaaaacctgctgtccttttaccattgtttttcagttctgcactttagtaaaagtcatcccttgggacaaagtaggtttttttttgttacattaagtaggttttttgtttgtttgttttgcctgctctatttttttttttctccagaaggttcatgcctgtttcatttcctccatgaatgagaatgtcttctggtttcctctattcttgaatgataatttggctgtgtatacattttcattcatgctttctttactgcttcactgtctttgtgtgttgacagatgcctttcatcttttactccagcatctccaatcaagcatctttggttggatttttgacatcaagtgatttctttccttttttacagaaagggctcatgacttgtatattccctgactatttttttggttgttgctgtttttgtttataaaatgtctttctgttgcccttatgtttgtttgaccacctcagttgggcataataatctttagttacagtctttcctacttgctatggtttgcatgtccccttcaaaacttatgttgaaatttaattgccattgtgatggtattaagaggtgggaccattaagaggtgattaggtcaccagggctctgccctcttgaatggatcaatgttggtgtcaaggaagtgtcctgttattaaagggagtttgaccctctcttgctggcttgctctcatgctttcttgtccttc

SEQ ID NO: 1244 - DNA, 945 bp, Homo sapiens
tccttcctagttcgacaaactgctagataaagagataccactgcccctgggaacaaagatttagtcattgctttgcatggatagttccatttctctgctgcccactcaacaacacgggtatctttagcacaaaccgttaagatcatgaagtttggattctttgccggcccctttgctgtatttggtcatgttatggagtatattcaaatcctgtaggttatgttgaggaaaacggattccatagttttgactgctcctgccaagtataactttggatttctttattagatcatgtcttggtatgtcagtatgaaccattttggaaagaatttgagcagaaacacttcataattagtgtgttagaatgaactttttttttttttcctatttcaaagtcttagattcaccttcctcctcctattattatttaggcactttgacctaatgtaaaatatgatgctttatggatcatttccaaaccccaatgaatgaaatttcaagctttctttttccagtgtcttatttttagcaaaatatttcaccatcttttatgcactattagtggtattttactaatgccccatggtaacttcccaattgtgaaaaaaattatcttgtgatcttcttgttaagggtttatttatatacggaataatttgttgtggagctaaagaattggggtgttgcatattgttatttttagggctctgtatcagttcaccctttcaccagtgtggttcctggctaactttcccatgagtttttaacctcttgctaggctctgcttatgtaacaggaaacaggctgtcaggaacaaacaaacaggagcctatcaggcgcacacttagtagcaaatgatttagtttgctctgtccttcaccctcttaaagtagggtgatacgcagactcaactttaagtcttttggcatggtgctcttaggttat

SEQ ID NO: 1245 - DNA, 1013 bp, Homo sapiens
tgtctcttttacccagcttccaaagaatatagcgttgaacaattactgtatttagcattatttcaagtatagatgatttcctgaaggcattagtctgctattatacacaagataatctccaattttgcatactactgaatttgtttgaaattaaatataattctcttttgtctcaaaactgcccaacatcaaaagaatcataaatgggttttattttccatttttaacttatcaaactagtaatctaaatgaaactaaaaatcaattcaataatacagaattttagagagtctactatttgttggatgttacgctagatccagacaatacagtttaccttacgctccttgactgcaggaaactggcaggcatataaacaaataaattataatactgtgcagcaagggcaataagagaagtgagcacaggtggaaggaatgattcattctatgagtagtgaggtaagattttcctggctgaaggacaaacaaatctttaggaggacaaggtggaaggggagctaagccaacagcatgaccaaggcactaagtatgaaaaggaacaagagtatctggggaagtacaggtgtggctggaggatagagagtgagaggcaagtggtgaaagtaaaggctggaaggtcagcagggtcagaacctataatttcattcggtatattctgtgaagatgtacagccagcaaaagctttttaattcgggaaaacacgattggacttgcactttcaaaagattaccgtggttgcacagaagagactgactgggtcagaggttagttacaggctggaaaaccagtttagatgaaactgaagagcaaggatgaaagcctgaactagagcagtggaaatgcgaatgtggagcagaggaacgattcaagaaattctgcggtaaaactcatcagacttcatgactgattaaaggtatggtggtagacaagggagggagaggaaggataagaatggagaagcaggaattgggcgttatttgaaaatttctg

SEQ ID NO: 1246 - DNA, 766 bp, Homo sapiens
acttacattgcccatgtggtcttgcatggtgttcacttttccattaaacccgttagcacattaagtagttatttttaactcccagtttgataattccaaaatttctgccacatctgagtcttgtcctgaggtttgcgttctgtcttcttctttttttttttttttttttttttgcctctaagtataccttgtacttatttgttgaaaaccttgaaaaccagacatgatgtattagataactgtcacaaaagtaaacagaggtttagtgtgaggttttatgtttccagggctaggagttacggctgtgtctcatgttcatttagctgcagttttacctggtgtccttgtttttgtctcccttgttgtccttaggtttccctaaaaactgatttttaaatagaatctgtgctttgcaaatctctcagttataatccactgatattatactggagtctgtcaatgtgttggtaaggtattatggaggggaagcattcttttctcttataattacatctcagggttttttaggagctgtgaatcactgggatgtggccttcagaagagttactcagccttttttaaaggacaggaattctgccttccccagtgatatggtttggctatgacatcacccaaatctcatcttgaattgtagttcccataatccccgtatgttgtggcagggacccagtgggaggtaactgaatcacgggattggtttcctccatgctgttcttgtgatagtgagtgagttctcataagatct

SEQ ID NO: 1247 - DNA, 1202 bp, Homo sapiens
ggctccacatagactgaaggagagtttccctaaattagaaatttttttggaggacttttatttcctgcaggtggggtgggttagatacctaagcaatcttgcccaaatgaaagaactcaaatgcagaagaaaatatttttagtaacaactttctaaagccattgctgggttggcacaaaaataagaatctatagatcccaaaaagaaggaaaagccagacagacacccaagtggtaagcaagttttgcctcagagaacttctcagaatgctggtgttcttgattttcctactggatgcatgtaccatgtatctagaatcatcttccctctgcttcaaatctatcttttcaaaccttcctttagttaaggtttctgtttttacttatttgaaaatttttggccaggtatggcagctcacatctgtaatcccagtgctttgggaggccaaggcaggaggagcccaggagttcgcttgagcccaggagtccgagaccagcctgggcaagtcagggagaccctatctctgcaaaaataaaataaaattagctgggcatggtgaggcacgcatctgtagtcctagctactcgggaagcaagcaagcagatcaactgagcccaggactttgaggctgcagagaaccatactccagcctgggtgacagaacaaaaacctatctcaaaaaaaaaaaaaagaaaaaaagaaaaagaaaagaaataaggaagggagggagggaggaagagagggagggagggagagagggagggagcgaggaaggaaggaaggaaggaaggacagacagaaaaaaaaagaaaggagagagggaaagagaaagaaaggaaaaaaaagaataaagaaagaagaaagaaaaaagagaaagaaagaaagaaagaaagagaagaaagaaggaaagaaaaagaaagaaaagaagaaagaagaaggaaggaaggaagaaagaaagaaagaagaagaaagaaagaaagaaagagaaaaagaaagaaagaaagaaagaattattttgctctcattcttgaaagggttttttgggatagaaattccaagttgattactgttttcctctcaacacattgaaaatattatcccacagtcttctggcttccatttttgctgctaaaaggtaatgtttgttgacttactgttcttcagaaggtgacctctctttgttcctggtttctttgaagagc

SEQ ID NO: 1248 - DNA, 1054 bp, Homo sapiens
gtcaggtggggtaagttgacaagttttatgagagcctctttgagtctgtgtatcacatagaatgtcctcatttgcagagaatgtttttgaagaaagaattaaaagttacctctgttatagtcttgtaaccaatctctacctacttgaagttggtataagaattgccgcttgacgacaggcatacattctcagaaatgtgttgttaggcgattttgtcattgtctgaacgtgctagaatgtacttccatacacagacggtacagcctgctgcacacctaggctatatggtacagcctgttgctccctggccacaagcctgtgcagcatgttactgtgctgaatactataggcagttgtcacacaatgatgagtagttgtgtgtcgaaatgtatcttagtgaaggtacagtaaaaatacagtgtcataacctcatgggaccgcctttgcaggtgtcgcccatctgagcagaatgttgttatgcggcacatgcttcagttttctcttttgagtcttaatgaaaggccagtgtgacaatccctaaattagatatcactcagttttagcttcttattgtagataatttgtgataaaatcattacgtttgttttggaaataaattttcctttacacaaatcatttgtggtgtatagctttagactcagtgagcagctgtgggacagtgggagtggtgggcagtgcaggtgtgtgtctaatttgaatcagctttgtcccagactactggactactgcttgttttctgttttcagtttgccccatttaaaaaaaaaaaagcgtcatagaattgagaattgaagtcctgtatgctcttcccacatgctttcagaagtggagcatgcctcatttctttctcttgcttttcatcattgtccatatcaggtcattttcagtcaggcacaggaagtgcagttttccactgtagtttggataggttcagtactctaaaataaaaccagtcactgcagatagatttccattgcagaagattcttccataaagaagtgatctgtagaacacttgcttctttatcccacca

SEQ ID NO: 1249 - DNA, 1091 bp, Homo sapiens
gctgctgattagaaaaaggctcacttgttttgaaaaacacaagtgaagaattcccatacactgactgcatatattagactttagccaatgttccctttgactttcttaacacggtaggtaaggcaaaggataacctattaaagattgggcgtgtgaaagccatgtttcttgtgatgatggggacgatggctttgagaatcccagagcaaagtggaatgcaaacagaggaactgagaaattattcctcctgcttaattgctatggatttaactgccactccaaaatgctgaattttttttagtaagggcaatgcttggtcctatagggttaaaatgtcatgtcaaggcacacaatcatagcaaacagattgctaatcataacaatgacatcatcatcatcataatctcttatatttccatagcatttatttttgaggcagggtcttcccctgttgcccaggcaggagtgcagtggtgtgatcaattctcactgcagcctcgaactcctaggctcaagtgaccctcctgcctcagcttctcgagtagctgggcctacagtcgtgcacatcatgctcagctaatgctttttgtatttttagtgaatatggggtctcactgtgttgcccaggctggcctcaaaattctgagctcaagcaatcctcccacctcagcctcccaaagtgctggaattataggcacaaaccactgcactgggacctataacattttaatcaaattgcttttttatatcttgtttcattttggtctcacttcagtgctggtagcgatgttgaactgattttgaaacatcactgtttttagacaaataaaacaccaaaagctttaagttatttgatttgtggagcaacagaacttgttatgagcaaaatgaaccaggactggaaccctggtcttttgagaatcccagaccaccagaatttgaagaactcagggaaactgaattagagtttttgatatggactgaatcactgtggaattattataagaaactctttggcagtggaacaacacttgttgtcacaggtaagtatcggaagaatacaacatttccaaggtaatagagggaaagca

SEQ ID NO: 1250 - DNA, 952 bp, Homo sapiens
gcccagcctctgctttttattatatttttcctttttttttttttcttttttgccttcctgtgcagaggaaacactattttcttctaaagcttggtttctgctgaccagtagcaatttttaacatcagtctgatttccctctgtcagcctataggctttgctgggttatctctcctgactaatttgtgtagcaacttcacatgaatttaaacatttgtatcatcagttaacactcactttgaaaatgttattgggaggcttgttaagtcaggtgtattttgtgtgactgctctacactcaggccttctggaaaccctgcagagggtagctctagtggccagctagctctcttgctgaaaatgagcaacataagtacatgaaaaacccaacaagtaggatttgaaagcggggctaattgtacccttatttcttctggggataaaagtcttaaactttgtttaaagtaaaatgtttttatttctgacggtgatttgtttcacttaaatagcttgttgtttgtttctttcatttctcttaagttttgggttgggtttggtttgtttcccgcaagttttgcccgtgccgccttcctccttgtgcctgcagggacatttgctggtgtggcagcctccaggcccgtccccagcctttttcttggcacaccttctctaggatggctgggacagtgacttagcttctacacctgtgactaaccattttcattccattctacagctttgacaattattctgccaatgttatggtagatggaaaaccggtgaatctgggcttatgggatacagctggacaagaagattatgacagattacgccccctatcctatccgcaaacagtaaggattgcagctgacttttaatgtgtcttttagagtatataattctcgagcgcttaattagtgcatgttacctatggacttgcttatattgccatca

SEQ ID NO: 1251 - DNA, 909 bp, Homo sapiens
tgtttatctttcgcagcatttcatagctacttctaatgcactatattctcattattcattgaactatcactctcacccgctatgctgtgttctgttttgtactccgagtcctgaggtcagccccagtattgggatcactcctgtaatcccagcactttgggaggccgaggagggtggatcacgaggtcaggagatcgagaccatcctggtgaacacggtgaaaccccgtctctactgaaaatacaaaaaaaagttagccgggcttggtggcgggcgcctgtagtcccagctactcgggagcctgaggcaggagaatggcgtgaacccgggaggcggagcttgcagtgagccgagatggcgccactgcactccagcctgggcgacagagcgagactccctctccaaaaaaaaagaaagggggaactaagttacctgactgctatgaacagggtcatgaggagagactctaacacattgctttagttttgtttcaacttccaaatcataagagggacattacacattgcattcaattctatagtgtaaaaataaaataaaaatatcagcttactttccttctttcttagtttgtcggtatcatttttaattctaatgttttgttaaacctcacaccttcctcttttgaatttctacttccttttaaaatggcaattgcctttttattttcatatcttttgtcttatattagtaagagcatttctctaattataacatggggaatttacatgtgggttacaggggagactagatttttacatcaaaattaattttgttttatttgctcctaatttataggtgaaaatgttattttacatggaaacctattttgttccataaaactaaataaaccataacccagaagtgcaatgagacacacacagcatgacc

SEQ ID NO: 1252 - DNA, 950 bp, Homo sapiens
agagaaatccagcaatgagatgcctagctgtttggctcacaaaactacaactaatgcattactgtgtatctcattccagggtacctggattgacagttaaatgcctaagagaaaatagccacatatgatctaaacataaacccagatttataaaggaaacacctacaagggctgacttaattttttctaaggaaaaccagaacatagcaaatggttatggcacaaatctatgtatgtagatagagaaggcaaagcaaagggcatcagaaagaatgggattaattgagaaaggttttctcaaggaggtattgggtctttgaacttgatctattagatcactgtaaatcgctataggtgaatcactgaggttgaaagagtggcattggcatggccaattggtgaaacttgttgtggcagcaacagattagaggggagagagaaattggattctggtcatccatgaatatgtggctaggaggtgggtgggtaggagtgaggaattaggatttccaccatattctggcatttttatgaagaaaaactttaccgtaaaacattgacagaaacattgctggactcaagctctctggtttggattctaagtttttggagcctgctgtgactcttccctctcgccctcctgctcttggaggagtggactcccagcatcacctaggcttgctgtaattaggcatttctaaggagaacaggatactaatgaagaaatagtaatgtaatccttggaagatttgcatctcagtaaaatcaggtggcccttgatcatgaatggctcatttgccatgctgggaaaaattaaaaaggagatgtccttcctggctggatactggtgtctgcttatacattttggtatttcttctgcctccactatcagcaccacaactgctgaatcctcaatgagtaaagatgcttcggttattctatttctctgc

SEQ ID NO: 1253 - DNA, 703 bp, Homo sapiens
ttttgagactggcaatttctacgtctgacatcttaccacagtgaacaaggcagcatcccaaactcttctgagtcaataagaaaagggtaactcttgcagtaatgccaagttcagtttctgttcactttgcaaaaaatgtatgcccactactagacccatgactgtcaactagaatgtgctgggcctcctctcctgtctgtgcatgggaatgggcacaaccaggtggaaagaacatgaacttgggagtcagatagctctagatgtgaattctgacttcaggttttatgaagtacatagcttgtctagtgaattcatatctccacttctcagattccttgtatacaaggataatgtctgtcttaccaggctgccaagatgtacctgacatgtagtatgtgttcaataattgtttcttttccagcttaggttaaaaatgggaattttcaagaaaccacaaacccacagagtttgtttagatccaaacacagatatggcatttgccagcctcataaacaatagaggaggctttcaggcaagccccaagaaagcatgttcagaaaggggaaggaacgtggggacaggaactattgctccccttctctctttgtactcagaaaatccaggaaattcttcctcaagaaagcatgacccatttcagcctaaaagcgtgcttttctctggactgtgctggcttgagaacata

SEQ ID NO: 1254 - DNA, 1124 bp, Homo sapiens
aaaaaggaaggtgcctctgaaacgcactagaactcagaagaaccttgaggacataataagccagtcacaaaaggataaacactatctgattctgctcatggggtccctggagtagtcaaattcctagagatagtggaatggtggtggccaggggctagggaaggaaatggggtgttatttatttgatgggtacagagtttcatttttgccagatgaatagagttctatggatggatggtggtgaaggttgtgcaaccatgtgaacgttcttaatgccattgaaatgtgcatttaaaaatggtaaggatgggctgggagcagtggctcacgcctgtaatcccagcactttgggaggccgtggcgggtggatcacctgaggtcaggagttcgagaccagcctgatcaacatggcgaaaccctgtctctattaaaaatacaaaaattagccaggtgtggtggtgtgcacctgtaatcccagctattcaagagcctgaggcaggagaatcgcttgaacccgggaggtggacattgcagtgagctgagatcatgccactgcattccagcctgggtgacagagcgagactccatctcaaaaaaaataaataaaaaacaaaaaataaaaaataatggtaagggtggtaaattgtgttaggtatattttaccacaattaaaaataataattaaaaaacaaacgcagtttttaaattgaattgttcccaggttaccctccaggtgatgccaagcagattggcttgttaaaggaccaggacaaggctagtcatttcctaagttacactaaacatagattcctcttcctagaaaaataagaattttcagtataaatgtgtatgcttccccaccaatcctgcagaacatggcaggtgggattttaaaaaactgtttatctttaatgacacatgcaaagtgccgccgccagtggaggctcattaaattaaacttataaaaatgtagaaagtctatctccttttacacacagctgggccaacagcccctcacccatttccccaggacaactggtagcaaaggctaaagtctaggacaaacttcagaatcaaatgcagatagcctggcggccagacaactgcaactcaatcatcaccaa

SEQ ID NO: 1255 - DNA, 903 bp, Homo sapiens
gccgattttggatctcttactgtattcacaatgatattttcagggataagagagtccccacccatcttataagatatcagaactttcattacattgatgaccaagaaccataggcagaaccatgatgaagacttggtacacaatgcatcatgaagcttgataacagaaaagagaaagctggccattgaccttcaccaaaaatgaacccttccaactctctctcagggtattattttacccctttagcttagagcatgtcagctggttcaacatgcttctaggataaacctgtgtcaactaccccagctcccactctgtctaagctcatagcaatgagaaaatggagaacctggtaagacagaaatgcccagagagaaggatatacagataagacatagaggttactaattgttgtctgtattttgagttgcctttgacacattcaagtagaaacatgcagcagaagatggccctggagatgcagtgggtgatccaatcccccaagccctagagatgtgagtaaagacacttggatgaacttacacacagtccatgaatacgctaaagcaacttctagctctgttttagttcataacaactggtttctaagaacttaggcacttgtggagacaatgatgttactgtaggaactaccgtataaggacaggatgtcccacctcctctgctcctgttcacaaggaccctgaactggcaaagctcccatcctgccctgaccctgccatgagcaccaggcttctctgctggatggccctctgtctcctgggggcaggtgtgtcctaagaacaccatgatcatcccattggaaattccagtgatttcttcaatcatttctgtctttctgttttcaaattctgtctttttccccaacagaactctcagaag

SEQ ID NO: 1256 - DNA, 1080 bp, Homo sapiens
atctcccaatgagaagagaacccatgcttattcaggcttgcccatttgggcaggtctttgcatgtcctggtagtatccaggtgaatctccatggtccaatgtcagcttggtttctgcactagcatctagtccctctatgatcatcagtgtctgagaagtctgagtcccagttaaggttaactgtaaaatcctgtctgttggtacaattcattaaaagacaatttacctataatagctacttaatgtgtctgcagtatattttcaccatagacagaatcaatagagatgatcaataaaaagaattatcacaaatttcctgacaactccatggtggcagcagctgggaagccacagcaaaggggtgggcctgttggtcgggctgcacggggtgagagtttgtctctcagcccttggaagacagtctagactggttatcttgtagtgccagccttgtggctctctaagagagctgcccacagttccttttctggtttatccacaagacccattaccttgatctcctcctacttcctcccctggctctcagcccttccctgagtagagacgggatggggtgaggctttgagcctggtctgttttgattttcattcttgttaaccccaaccaggaaactcttcacaacaagggcagccagctgcccattcacacacagtgaggttgccctgtggagttatagcagaacaaacatatgctttcattcctgagttcctcatattgtttatttacttgtgtttacctacgttatccatgcacaaaagatttgagccatcttactatcatgacaacacatcctacactgtacaaatggaatcagaattcaaggtcctggaccagaacacatgggactgtttagtggctacaacagagttgcacaaaaggagataatgattgcagacagactcccgaagcctttgaatgctgagtctacctaccatgagactactttcttgggacttatggttatgtgagtgaatgaatgcttatattatttttaaatattggaaattatgtttattgcagccaaccatgttctactggtacagatagtcccactggcac

SEQ ID NO: 1257 - DNA, 981 bp, Homo sapiens
cggtcagtgttgggttttacttcccaacaactcttaaactcattttcttccttccacttccaggagaaaaggatgtcattatcttaggggattttggccaagggccagacagcaatgactatgatatcctgaggaaagaaaagttccaccacctgatccccgcgcacaccttcaccaacatcagcaccaagaaccctcaaggctcgaagtctctggacaacatctggatcagtaaaagcttaaagaaggttttcacaggtgaggcagaactcacttgtcctttctcctgttcaggaatggagtgagagaaacatgtctgaactgacagaagtcatctcacctcctctgaggcatacataggattgtggtttacgtgactgtataactgtcatttaatcagagacagaatccaggaatccaggcccctgtcagtcccgcgctaaggaccacacagtgctttccagccattctctaattgtttttgtaactattcgttaattttattcaaatatacctcctgctgcttagatttctaaatcctcatttttcaaagtgaaagggagtgtgacaaataattttagaacacccactgacctacagcaagcagatgtgttccaggcaaacctggttatagattggcagagtcctgattcagagatgagctgataacgttacttttaggacacttagtcttctagcaaacatttgtcaaacatgcaagtgttgtgttgtaggatgcagtgtgtagacatgctatgaggtggacatgctgtgaggtgaacaggtgtctcatatagtgtcacaatgggacaggagaaatgctcagtgctctgcaaggagcagggtatgggggtgatttcaccctctctgcagactggtaacctgctgagtcaggacacagtcaacaatatggaagagacagtagggtcttttgatgaaagacaagaacagtatttctaaactctgactggacattttgcg

SEQ ID NO: 1258 - DNA, 786 bp, Homo sapiens
tctatagagatggggttttgccatgttgcccaggatggtctcgaacttctgggctcaagcgatctgatcacctcagcctcccaaagtgctgggattacaggcatgagccacaatatagagtctttaaaggtttgctgttctgattggcttgtagaggtgtgtatgtacttatataaattgaatttgcccaaattcttagaaaaaaagagaaattgaacttctgttgctttaatgtgctagaaaggtattttttactgaaaccaaatcaaatgttttggaaatgcgagtccgcatgtagtccacatatatgttaccgagcagtcaatgcactcgctgcccagtgtgtacagaggccaataccatggctccagcttttgagaaataaagcctttttgtaagtcaactagcaaggacacaggaggaaatgctcaaatctccctttcccagctgggggctatgtcaggttttgtacgcatagggtaaggagatgtgatttgattggatcttgagatgaagtaattaatgctgggaggtgtgatctgactggatcctgccatggagtgacaccaaaactcaatctcattggttcctggctcctgccacagggtgtccggttcttaaatgggtcccagctcctcagtccgagcacttaggttccacttcgtggttgcatgcttggttaatctgggcatgctcagagtatatgaccttcaacccacggatccatggcagttgaaaaacaactgccaactacattacataaaagttgaaatggacgtggagtgt

SEQ ID NO: 1259 - DNA, 1074 bp, Homo sapiens
cctgaaggcgttatggagatatgagtgtcttccatttattcagctgtgacttggcggaaaggacaccagacccacagtctaggaagtataagaaaatcttattatttatttatttatttatttgagatggagtctcactctgtcgcccaggctggagtgcagtggtgcgatctcggctcactgcaagctccgcctcccaggttcacgccattctcctgagtagctgggactacaggcgtccgccaccacgcccggctaattttttgtatttttagtagagacgaggtttcactgtgatagccaggatggtctcaatctcctgacctcgtgatccgcccacctcggcctcccaaagtgctaggattacaggcatgagccacctcgcccggctgaaaatcttattattgataaaaccattaagccttccccatagatcagaccccaaggaacactgataatttattcagactaaaacatcctttctatatcatttgcctgatacatttctatttccttagtggagtcagaagaattaggcttcagatacataaaagaggccccaaacctctttcctcatcctgacctgccctggtgaaattctctggcagggcttgtcaagcatgtggtcttggagccagctcagtcttgctttgatagtcttaacttttttattattattctagaggtaattctatgccaggtttataatctgacctctcctatcaggataaattccatccaacactgtggaattagcttattcactgaaaaaacactatttaaatgccaagtgatgagcaatatggtacccttggcacagactttttcagctcctggagcaagttcctgaccttgtaaattgagatgctcaacctttatcacttgaaaggaatgggagaggcattggtagggcctgcctgtcacagtcagagttgcaagggtgcttgggaatcacattagcatttttgaggacttgagtcactctcagactctttataaatacagcttgactcagccactgtatgactgactccccggggacatgaggtggatactgttcattggggcccttat

SEQ ID NO: 1260 - DNA, 1061 bp, Homo sapiens
acagcctagagagtacggcaatgaagaagataaaatcaaggagatgagacccagggtcagcagccacctcaacgtcggtaccgcagcaacttcaattaccaacgcagatgcccagaaaaccctaaatcacaagatggcaaagagacaaaatcagccaatccaccagctgagaattcgtctgctcccgaggctgagcagggcggggctgagtaaatgccggcttaccatctctaccatcatccggtttagtcatccaacaagaagaaatatgaaattccagcaataagaaatgaacaaaagattggagctgaagaccttaagtgcttgctttttgcccgttgaccagataaatagaactatctgcattatctatgcagcatggggtttttattatttttacctaaatatgtctctttttggtaataacaaacgtgttttttttaaaaagccttgtttttctcaatacgcctttaaaggtttttaaattgtttcatatctggtcaagatgagatttttaagcactttatttttaatttgtaataaaagtttacaacttgattttttcaaaaaagtcaacaaactgcaagcacctgttaataaaggtcttaaataataataataaaaagaactctccactgggcaccctcaaaattgcacaagttccttctgttattagttcatgctgagttgtgatgccagcacttcaagccttgttaatcattggatcaacaagtaccgagctaggtgctagagagagatggaaaaaggcacctgggcccagccctaagcctggatcgcggacagtgacgttggtccacacctcacctgccctctctgccctgctacatgccccaggcttgccctgaaccgtgagctctagaaattccaggtccgggtcgcagccacagggcagtcaggcgtgtcacgtgaccgcgccgggtagagggagacagagtcgcacggctgagacgccaggcagtcgcctagcaacagcgggacgcggagcgatggagaccagcagcagggagctccaagccgcggagtatttggaaaagcatcag

SEQ ID NO: 1261 - DNA, 1041 bp, Homo sapiens
aggggaaagcttgtaaaatcctggaggaatcacaagatatattatttgagctcctttttatttattactaaattaatggcaggaatcccatataaagggatattccttatgaaacatgacatctaaagtacaaacagaggattcttccttaccctaaatcctgccctctctccctgagtctcttacgcatcaggccacctttgtgcccataagtcatgggcaacgcagtgtggtcaccttcatccacacctagaggacagtcagcaaagtgaggtggttctgcctgctgcggtctcaccccagacatggaaagcaagagccctgggtggagctgaaggtgctcagctgggtttatcaggagtctcatctgtcagtggattgacaagaaacagagcaaaacgactcctccaatgttgatgagcctgcccctgggttttggaaacctgataacagagaaaaccaatatagacaaaggattttaaacaggattatggtcaattaagcaaattagaaaaagatacttgaaagaatatttgggacacaggagtcaaaaacaccaggaagacatgaggagtgtccctaagactctagactacagcactgtgtagacaactaacaccagaatattattatattatcgaagtaataaaatttacagtgaattacaaactgtttccaaaaggtcatgaaaatcttgtagacttgtttcaattcagacaaatgtgttcttctcattctcagctgttcactggtgcatttatcttgaatttgaccatctggggaatgggcgtggcctctcctgacaggaaggctctgggggccaggcagggagaatgatgtctcagaatgactcccttgagagtccagttcccctttcatcaatgcacagacccagaagacccctccgtcctgcagcccctgccatgagcctcgggctcctgtgctgtgtggccttttctctcctgtgggcaggtgggtcctgggcagggccccttgtgtggatatcaaggcccagcccctttccactggagctgtagcatc

SEQ ID NO: 1262 - DNA, 965 bp, Homo sapiens
ccagaactcaaaacagaggaggaaaaggatttttgtaagaaatgtttgaggtgaacctcacagacacagaaagagaaggaagagggacaagccaaggatgattccaatgtttctggcttgagttatctcaagttgagttatcctggtattgctgatggtaataccattcagcaatcgaggaataagagagggcctaagacttacagagaggccaggcacagcggctcacgcctgcagtcccagctactcagaaggccaaagcagaaggatggtttgagcccaggagccaggagttagaggttacaatgagctatgacagtgccactgtactccagcctgggccactgagcgagacactgtctccaaaaaaaaaagacttatacagatgttccatttaggacatgttgaatctggggtctctgaaaagcagcaaagagaagatgtccagtaggcatttggccatccaagaccagagctcaagagatatggaatttttattctaaaaacacattcaggcaataatagatgaaatcactcaagaatagggtactaactaccaagagataaggatgaactgtgaaaccccgagtaaagccatttttttttctttctttttttttttttgagacagtcttgctctgttgcccaggctggagtgcagtggcgccaccttggctcactgcaacctccacctcccggttcaagcgattcttgtgcctcagcctcctgagtagctgggattacaggtgtgtgccaccacatgcggctaatttttgtatttttagtagaggcagggtttcaccatgttggccaggctggtctcgaactcctggcctcatgtgatccacccacatcagcctcccaaagtgctgggattacagttgtgagtcacgcgcccagccctgagtaaagccagtatttaagagaagaggaacctacaaggtatcctgagaaacagataggca

SEQ ID NO: 1263 - DNA, 987 bp, Homo sapiens
attagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaa

SEQ ID NO: 1264 - DNA, 1066 bp, Homo sapiens
gaagcatttgggttttctacacgtttgcttgcttaaacccatgccatggggcaccactgtaaggatgtttggccgttctcatttcttcacagcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctgggtaggtattgctgggcagctgcagcagctgctgtttctggctctgagtatatctggcacatgaagtacagtggagtgcccaccccctagccctgtgttaggcagcacaagggaaatagtgtctcagttacagtttgtctttatctttttaagtaatatttcagtgaaagagcaccactgaagatggaattgatattcaagaaatatgcaaataacaggtgaccaggggaaaagtccatgaggataaagcatttccataagcagggtagggagaggggaatggaatcagagaagcatcaaatacctgaaatgtatgtttttctctttgaaacgtcagaccatcctctgaaggtcactgggctttggtctaatgtcctgtgatatttgagctttgaaggcaaggggagaaaacattaatgacctcctgcctagaaaaactgttttgatctgccaactctgcctcccctttcttcccttccgctcatcatagggatgatactgttttaaaccagaactctgaataatccaaagtagttaaaggagaaaggatcagggagagcccgatgatgtgctgctccgtgtcatgggttctggcctctctttacccacagcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaacgtaggttcctcaaaa

SEQ ID NO: 1265 - DNA, 974 bp, Homo sapiens
ccacttttggagacaggtaccactgcccctaggcagggacttgggagaggaccttatgagtcaaacctctatgaaccccaacctttttgtactcggggaggctgaacccctgcccaaaatagcgcggtgaaagctactgccttctcccaagtaggggcctccagtactgccacagcaggggccgcattcctggcgcctcttcattcgaaaaacctctttccaggagacttcgctgattctgaacgaatactttaaaatatgggcaagggaaaaaaaaagacaactcttagaaactctccccacccaacatacctggagtgcaggcgaggtccaggcaaacgggaaagcgacttcttgtacgaatagccatctcaagatgaagccaggctgtggaaaacttaaggccatctagatgggaaggaggtatttaaaagaaatcagcacacactcttacagaagccaaggcgggtctttaaattaaaaaataataataaggtatttatttcttgccccttagggaagaaaaatagcaaagtttggttcgcaggagtaaggagacagaggtgggtagggagagggaggagaaaagaggaaaagatggcccagcctcaagctctccagtcaacttggggcgggggaatacatttttccgtagcttgtaaaaagacttttcagccagtttgaggttagctgccaggggcagacagttgtaataatgccgacagaattgaggcttgtaagccgggcttcacacttctaaaatgcagttatggattctttcatcggtgttagatcaaggcaccaagttaagaaaacaaaagtcaaaacaacaataaaagaaaaaatcaaaagcttatttaattaccgagtcccgctgcccctgcggaactcgccgcgcgcgttaagctctcttttctttctgcggaattccatttgcatcccctctgcctgggtgtctccctctctcagtgtgt

SEQ ID NO: 1266 - DNA, 1091 bp, Homo sapiens
acattgtggagatcggatttgttctcacttgacagaaagccagtcccacgagcagcttggtacccaaataccagtctgtttagtgctcattagagatgaagaaccatattcataagtcaagctgagacggagtgtcatctccagacagaatcaacaccaccccctcctcaggaactgggatttggctgctttccaagccgctgctgaccaggttccattgcccagcttggctgatgagatcactggcagagtaccatgggtgcagacggggcctgctgtttcaacatgttctcaggagggctcttgcccacatttcttggagaggtgtgagcaccaaacatgctgaaccatccagcccatcactgagcagggccatctctcttcatcccttttcatttggtttgcatttttatgtcatgctccttccctggataaaagggataagaggagtttctcagatttgatttctcagtgggaactgtttgctttggaagccacctacaccaatgctaattgagaacagagctcagaatgggagcctgagaactgcacccggatgaactttttggtgggctgatttctgttgatcttgtcagaattaggttgtatatgcatgtaataccatgatcaactattttccaaaaggctgagcaaatgcatcagtgtctttttcctttgaccagttacttaccttggaaaaattatttgtagttaagcatataaagtcttcatcaggaaaactactggagatcctggccctgactacccagcaataacatttctggaactcccgaagcaatcagtgctctctgatcgctaaacatgatgggcttctattagagagattacagtaaaaaataacaatcagctctctgatgatcctgtgaggagggaacgggttgggaggagtagatttggctgaggacaagcccagactttcgtcacagggacagaccaacgtgttaacacaaagggagaacacgggagcatcctgcaccgtgcatttcagccacagatcacatggcccctccgcgggcccagcccacgccctgaccgcccggcctggccaggtctccgtatctctctgcccc

SEQ ID NO: 1267 - DNA, 1050 bp, Homo sapiens
ttgctattacggacagggctaaaagtatcttgtatttctagggttatgaagaaattcacatgaatttagtggctttgggatgccgattgatttttaagacacactggagccactttccctgttgaaagttttgctctgtctttttttttttttaaataattgagacagagtctcactctgtcgcccaggctggagtgcagtggtgcgatctcagctcactgcaacctctgcctcccaggttcaagcaattctcctgcctcagcctcccgagtagctgggactacaggcacccgccaccacgcccagctaatttttgtaattttagtagagacggggggtttcaccatgttggccaggatggtctcgatatcttgacctcatgatccgcccaccttggcctcccaaagtgctgggattacaagcttgagccaccgtgcccggccctttgctctgttcttaaactttactgaggttgccgatttaccctctggtgtggaaagaatggctgtaacttaaattactgagttttcttttactcaccttaggactataaatccatcctacttcagctaaaagtggtttagtgaaatcctactccttttgtcatgtggaagcttgcagctgtgttaacgaattgttcttagtatttccttttgaacattttcctctctcaaggaaaatgtttgagaaggtggctagaggggaataaaacttaccagcaggcccaagtgtgcccgtgacaggaactcttctccgccacttgagttgaacccctggggcagctgctggctccggtggcccgccccaacctgtgcgtctccccaggtgcgtgagcatctgctccctggccttcagcatggacggcatgttcctctccgcctccagcaacactgagaccgtgcacatcttcaaactcgagactgtgaaagaaaagtgagttgcaaatatacgtttctttaaaaatgatgcaaaaccctttgtccccacttgctgccgggatgagaggtaagcacggacccgcccaccctctgacatcgttagccagtgaag

SEQ ID NO: 1268 - DNA, 1067 bp, Homo sapiens
aaaccatcaggtgtcttgagagctcccttactactaccagaacagcatgaggataatccacaccaatgatccaatcacctcctgcccggtccctgccctgacaaatgggaattacaattttttttttctttcagaggaagtctctctgtgtcacccaggctgcagtgcaatggcgccatctcggctcactgcaacctccaccccctgggttcaagcaattctcctgcctcagtctcccgagtagccgggactaacaggcacgctgccacgcctggctaatttttgtatttttagtattgacggggtttcaccgtatttgccaggcctgtctcgaactcctgaactagtgacctgcccgcctcggcctcccaaagtgctgggattataggtgtgagccaccgcacatggacgggaattacaatttgagattagatttgggtggagccagaaagtcacaccatatcactgcaaaggatccgcagcaaggaagggcataaaatcctaaattttaaaataattgtcattatttcaatttatgaataaatattatatatcatttataaatgcatatgacattatacacaaggttaaatgcaaatatcctctgaagttggcctggctcagatcaaggaagaagccctgcctgtgaaggctgcagcctaggctgttatttttgcttcgctcagcccagtgtctgatcaaatattccctcactcagggcatgaagggtggggcctgaaaccttatccaatcaggagccgtggtctagaaactgtccaatcaggcatgcagctggaaagaacaggctacttccgtaattttgcgggtcctttgtgtttttctgcgtccagagctgcagttcttctcttcactgctctgtgtcctctgctcctagaggccaagcctatgtgtccttgtgtcctgcaggtatctgcagatttatggctaaaagaccgggaccccctggaagccgggaaatggtgagtgctgggtctgtcatcgtgagagaggggtgggggctggttggaaccggcagaaagtggctgtagcaggtcccagactttctc

SEQ ID NO: 1269 - DNA, 1071 bp, Homo sapiens
caggtaaatggtgtttgtggtcagcaaggctgtgtgcaaagcctgcgccgagagctttgtcaagcatgagagaggcaggtcactctgacatgtcaaggagtaatctcccatttacatggctaaaactagcaggaaggcaggagctggagtcagggtgtctgtactcttggagcagcccaggaaaggggtcgttgggtctcaggtggctctccctggtctgcagccagctatgcccaaatgccaaggacctgtggaaccattgcaagtaaaataaagcgttaagagcattaagagcagcacggctcctctccttcccttcggtgcctgctcccgccctattccccgagccttgtgctgcgttcggcggtgctgccgaagctagacttgggaactctgggttcagaggggagcaccattttccccgagcggttctggaagacttttagcagctggttgagaaaacaaaacacaaaaaaacaaaaaacagattgcctgacaatgtctcacttgttggtgcaaatgtgcattttttaaaaaatgtagtcttaatgccaaatcctatttagtctccttttttcttatattttttgtttgtttcttaaaccagagagagaatttgacccaaataaacactgtggagtattggatcccgagacaaagaaaccttgcacaagatccctcacctgcaaggtatttctctttccataaaaaatacttcctgctctcgctggggcctttgtcgaaatgtttgcatgccactctctgcacacggcagggtgtggaacctcgacatgacccccagctgttctttgtaagggaaatgctttcttctcgtccatggtagcagagtgcctgcctcaagctggctggctttttaagaaggagaaaaaaaaaaaaaaaaaaactaggcttcccctgttacttgtgaggccagacagtaaattgtatttataggcactcacaggcggttctaaagcctgctacgttttaatgtatgcaggagcagcggcagcggcggcggcggcggcggcagcgccctgaaaggcagccctggaggggaggatgatatgc

SEQ ID NO: 1270 - DNA, 946 bp, Homo sapiens
acctccattatctagggtgggaacctggatgtatcacacaatgtatcctctgactcctaagctgttccctctactcaaccttgccttatgcttcctggggtcagcgatctgttcctgatacactcagctcttctctgtagcttccaccccttcccagaagacccttctcctatgacaggttcattctcccacagctccactccctccctccccaagccctctttctccctcctggaaaactcctctgaactcctttttatctctgctctttgtcactagtgtcttgtgcagactgcccattagctcccccttgacctcaccagcattggccccagtccttccagctcctaccagtgctaggaatgacttcaacactgagcctctcagccccttgacatcctcatctccagggacctgcactcccacttcatgtcattgaccaatacttacggtctcaccttgcaccatatcatcaccccagtctggctttgcctctgcattttaaaattcaaacatccaatcctctactgtctccaagtctgtttggtattctgtcttcatcccagggcctgtcactgcaactccctctgccgggatctttccttgcttggtccgtctgtctcatccacgtggcagaatgttactatccaactttggatccgtacccatgctatttactggagtgctggagaaatcccacaacatagaaggcaggaaccctatggattcatagtttccattagcaactggatcccacatactgccttctacattctcctagttccattctcccaagaagatacagcaaatgtccactagtctcttaaacctgctaccatgttacccactcccactcccctaaacatggccttgcctcctactcaatggagaaactgggcaccatcagaaggagctgccacataccctcagactcaccaaacagtct

SEQ ID NO: 1271 - DNA, 942 bp, Homo sapiens
ctcatgaaggtgaccagaaggacccggtgctgcaggctgtgtgggtagctgagcagagctaagcggcttgacggaccaacatctctccagctggttgaagacaagctctcagaagacaatgctgcatgtcacagccccagcaaccaacaacaccagcctgacaacttgctggggtggccgccttgtggtctgaggtggccgtctaaactatgtggtctgatctcaggctgcagaccttgcaggactgtcttcacacagactggaagtgctaacaggtggtgaggacaccgctttacaacgatgcagggggccccatgtcaccctcacccatgggaagtttgacttggtggactcagccaagccacagaggtctaacgcttctctgcggtgatttcaggctgccctggcagaaagcacagtgcctgcagacatgctgtcactgctccacacatcaacgctggcagtccttggggctcgtaagtagttttgctcccccaatcactttggactgatattctctattgttatatatttttataaattccaaattcttggtttatttactccctcccatttttttccccagtgtgtgtatatggtgcaggtcacctagagcaacctcaaatttccagtactaaaacgctgtcaaaaacagcccgcctggaatgtgtggtgtctggaataacaatttctgcaacatctgtatattggtatcgagagagacctggtgaagtcatacagttcctggtgtccatttcatatgacggcactgtcagaaaggaatccggcattccgtcaggcaaatttgaggtggataggatacctgaaacgtctacatccactctcaccattcacaatgtagagaaacaggacatagctacctactactgtgccttgtgggaggtgcacagcagcagacagtttgagccatcccattcaata

SEQ ID NO: 1272 - DNA, 1044 bp, Homo sapiens
tactgacttctgacctgtgctgcccacaaagccagggaagccatcatggctgccactgacgatgcaatcggggcacagagccaggtgagagatgtgcttccgggctgccactgatgatggaatcagggaccaccttgacgcctctgacttccatccaagtgttactggtggagggtgtccaggttcttggcgtcttgaacaaataattggacaaaacgcacaaacaaaacaaggaaggaatgaagcaacaaaagcatatatttattgaaaacaaaagtacactccacaggttgggagcagcccgagcataggggcccaagagcccattacagaattttctgggatttaaatactctttagaggtttcccattggttacttggtgtacaccctacgtaaatgaagcagtagcctgcgatcagtgtgattggttgcagaaggtggccagtcagaggctgaagtgaagttacaaaattatactcctatgcaaatgaagacttggcttgcaaccaatctgattggttgcaggaggggaccaatcagaggtactttcaatttttcatctgccgtgccaagaagcgggggttggtgcaaagggagtagcctctggtccttttgttacttgggcgtggaaagttggagttttctttttgatttagttctagggagtcagcctgaattggccttgggttccctgcctccagaccctattcttctgcctcacagggatgtgctctctaagacctcatggcagcaaagcctcatgaagtctctgctgtctttcttgggctttgttgtttctgtggagactatccccttcctgcatctgctactccatgctgctgtggggatcctgggcagtgctgcatttacttctgtggcacagagctcttctccaggcccacgggaatctatctgcactgacttaagagtcgagggatggaaaggggccggaggggatggaggttgtagggccaaggggtggcatggggagtacgaaagagccagagaagaggtatctggtaggcaccaagtctccaagttg

SEQ ID NO: 1273 - DNA, 1076 bp, Homo sapiens
caaatgtccaaaagttgggagtcttatgactcttaaggccctgttccggttgctatggctacataacaaacccctccagactgagtgctttacatcttactatgctcatgggctccacgatcaggaatttggaaagtgcacagaaaagatgggctgtctctgctccctgatccctggacctcagctgggaaaactgaaaaacagggaaggttggaatcatctgactcccatctggactgaatctggcagccaacatggatgttggctgggacctcggtgaggactgctggcaggaacacctacacgtggccttttcctttggctgctggccttgctcacagaatggtgaccgggttccaagtgtgaacccaggtacaggaagagacaggaaacggaaactgccagtttccttaaaatctgggcccactaactagcatggcatcatttctatcatcttctattagtcaagcatcacaaagcccatattcaagaggagacaacctagacccagcctctcaataaacagtgtcaaaggctttagagagcatggtgtcaagctcccagattctaaggctgtgactcaacccagtgcactgggctgcctggctgtacacaggtgtccatattgatgcaaagcccccaagctgctcttatcctcttgtgaagcacccttagcttggttagtatttaaataattcaggaatctttcccctcctggattttgagagacctccacatcttctcctcagttctcccactctgttccctcatcccacaaaacaggctcctttccccagaactattctacctgaatacaggcgaaagatcgctcaatgagttagccttcccccacaccccagctctgactccccgagggctacctttccaaaaggagactcaacccaatttcttatagctttcatctgggaggggcaggtgggggcggggagggagaatgaaaggggcgaggtggtcttggatgagtgacctgattgcagggagtcacggctttttctgcacacatcactagctggatggctgtgtctgacctaggagaccacagtgagaacctgtca

SEQ ID NO: 1274 - DNA, 901 bp, Homo sapiens
cttttcctttgccattcaggtcatcccagccctcatccccatgcttcaattacaagctgcccactgtcaccgtctcatgtcgggcagcacaggtgattacacaaaaccttctagcagagacaggcttgtcaaggcagtttcgttaagaaaagctgtgtttgtattctggcaactatcaggaaacgaaaaggatcttttctcttttgtttatacccatccgtcctaaggatagtattttctcctactccctaagagctcggagggtaagaatgactaccagttttgcaaatcttcaaaacagctcctaaaagagagatgattttcactgtaccacaggaaaaccaagccctggaaagcatggttaagtacagtgccaaaggcactgggccactcaatgaaatgggatccttctctggtgaagtcattgcccagtgtgtggcctgtggaagttactcattaaatactgggtacctaacttacctaggtccacatggtaatggaggcaggacccaaacgcaaatctgtcagccaccaaagcagccacctggctcttgccagaacactagcttcccccaggacctgaagccctggacttagaacaaatgccatttgtccatacctgcaactgtgtggatgccatttcttattcctgaaaatggtgtgtcacccttccagtgctgtgccacccttccggtgcagcggcgtgtcacccttccagtcctggtggtagagggaaagatcagcctctgcccacagaccccctcccgacccaccgtgctttgtaaccactgctcctggcccgggacttggttcagtaggagttctggtcctcagctcctgaccagctcacagcggctgctgtccacggctctgttctgtttctgttcttctctgttccagc

SEQ ID NO: 1275 - DNA, 1035 bp, Homo sapiens
acgcgtcatctcctccaggaagctcgcgagagctggggctgggctggatgcgcctccttggggagcactgcatccacctcacctgccaccgaaatgcatctgtgggcctccgctggggttgagctcctctgggtaataaccaggaaggtcttattttctatatccgtgcgcctggctcagcggcacacttgtaggtatttgtgctaaataaaacaaagctcaaccttttcctcaggatgagcagctcttccaaaaaatacatacgaaaatgtgttattatttttaacctcaaaaccactagcaacttcaataaaacaaattttgggtgtgcttgttattgctgcaccctattaaacagattaagaatttaggccgggcgcggtgggccacgcctgtaatcccaaaaggcggtgggaggccagcaggcgtttgggaggctgaggcgggcggatcccttgaggttaggaaatcgagaccagactggccaacatggcgaaaccctgtctctaccaaaaaaaaaattacatggggtcaggactcttgacatagatactttaacacaggggaaagaaatgctttgtcactgatggtgtctggccactttatcacgccactctatcctacggtgagccgccctacttaatcagtttacacatgtgagtccataaatgccctagggaagctaaaattatattaatagatacaaaattcagcttgttacaattattactttttactgcgggttcagagcctggtctgaattttgctgcttagctttctcccgcagctgagtgggagccgcaaaaccgagacctgtttccctggtaacgctccgagcgcctgggcctgcgacccctccctttctcgcgagaagagactacctagttcttccggtaactttagagccgcttgccggtggcctcccgcttgagcttggctttgcgcatgcccagagagagtggcgcgagcctgcgttttccggccagaggacatggtgcgttttcggggtcgtgtttgtgcttcctgtcttggaat

SEQ ID NO: 1276 - DNA, 1017 bp, Homo sapiens
aatgacatcatggcagaaggtttgatgaattgcaggctgggttctggtcacacaggcacttgttgtgctacttttttttttttaaactttttttggaaacattaaaaaacaaaactaagcaatgaactgaagggctccatgtcaagcacttagtcctcgtcccagcacatgaagctcccattgaacttgaactgctcactgcatcttcccagacctcctagaagttcatgatttcacagatgagagacaggagtgctgcagggttgtgtggagggtctaaggttgcacacagagtcacaggcaaaaccagatgtgacccacgtctctctgaagccagagtgggaccctcaacaccactctggtccacaggttcttgggatgctcctgaggctgagggaccaaataatgggtgacatcagtccctctcatggccagccctctgggattgtctaaccagggtgagtggttaacagcaggcactgccatcccctgaatggggctgtgctgttttcttagtcccaggcgtgcatctgctaaacagcagcagggcgtttgcctccggctattgtgcaacatgatcttgattcctcttttaaggggagcttttaagacgagcttactcatgtcagccaaagcccagcatcaggctgaaccacgacaagcccctctggacaaacctgccagggcagctcagagaatcagtccccagcctcggtggcacttggtgcagacctgccaagtgtcccacaaaagctgggagccttgtgatgtcccccactgcccacatggcctccaacctctgtgttctccccaggatctgagggcccgattcatgtctggtcccctagcaactggtgcgcggccctggacaagtcattccctcttaaaatgctctggtttctttgttgtgtaatgaatgggtgcagtcagcagactcttgggtctctaccaccttcagtattttatggtgaggagcaagcaagcaagaaaggttattagcaagcaggaagcacagag

SEQ ID NO: 1277 - DNA, 1063 bp, Homo sapiens
atcctggtatcgttccttggactggaggaaattaggagccagacttgagctatgggctgaaggtacccacttttatagctgagaataggaacctgggtccccatcctggctctgccactgggaatgtgacattagggaagtcatttgcagtctcagggactcaagtttccccttctttaaaataaaagggttggaccaggtgattaggacccttttatgactcctgctcaagagtagaggtcttgggaaaactgaggccctgtgttctctcgtttgtgttgtctggaattctgtatttgggacctaaacactgaacagtgaacatgctggtgcaggaaggaacatgccccgagcccttctttgagcaaggctcagagcggagctgatttactcacagaccctttctcctcccccagctcttcctgctgcccacattcctgcaccccctcatgagggtagtcccagagaccaggcgatggcatctgcactattcacagcggattcccaggtgagctgtggcccctctgctctcctgagtcctcagtgtctgcctctgttcctgagctctcttcattatctccacaggccactctggatgcccctgctctcaaagaagccccaaccctgtcctctccttttagcatctttctaccacaaactcccctccacccccaggttctggccacccttttcttcccagcgtcctgtagctttgcagccacctctcttcctgactccaggtttgagcaatgggattgtccctgagtttggggggaaatgactgtttgtctcgtgttattttaggcaatggtgaagatcgaggacatggctgtgtccctcattctggaggaatggggatgtcagaatctggctcggaggaatctcagtagggacaacaggcaggagaattatgggagcgcatttccccagggtaagacggatgcaggcttactgtctgataagatggttttgtctctctgtgtgttagctgtgggatctctgatgtgttcaattgagtgttgaggagttagagactacctatccccttttgtagaccagatgg

SEQ ID NO: 1278 - DNA, 861 bp, Homo sapiens
tgcagaccgggtagcttatacatggcaggcattcatttttcacagttctggaagctgaagttcaggatctgggtgcttccatggtcagcttctggcagggtgcttttcctggctgcagactgccggctccttgtggtactctccgatggcggagagcagagacagccctctggggcctctttgataaaggagcacaaatctcactgatgagggctccaccctcatgatctcaattacttccctaaggcctcgcttcctaatcccatcactttgggggttaggatttcagcagaggactttttgggtgacacatttcagtccataacagtgtatgtgctttgaagaagttacaggccaggaatcttcagaggagaattacaccttcattgtccaggcttttgcagtatataaaacaaactgtaaacgatctgatttgatcttgacctagcaaccctctgatgctggcagggcgcagatgagcagctgtgttagaaacgtggacacaggcacagaaggggagctggtgggtgcatcagctctaggtagactggcaaggtcagaaggggccttcaaggtcacccagcagccctgctcaccccagcaggggctctcaaacacctgagtcgggatgctccgccactcctcccggagatgccagggccagtgccagagcccaggtggcccatctaatgtgcttgttgtgatgcactgatagcctctgccccaaagcaggcatgccttttgttcagcaggcagcagcatgtgtgtgtgtctgtgtgtgttatgtcttgtgtctgcgtgcatgtgtgtgtctgtgtgtatgtatgtgtttgtgtatgtgtgtgttgtgtctgtgcatgt

SEQ ID NO: 1279 - DNA, 1073 bp, Homo sapiens
cattcccagttcttggtatggttcctctgaggttcggttttcctgagcacctggggtgtttgcagggatgtggaggggttcctgcagaagacaccacccacatccacgcacctgctcagattcccgggccatggtcggggccaccgcccgtggggatgactccggatgggagtggcagaaaagggcctgctgggccgaggggaggcgtctccgggaagagagggaggtgtgagcggggagaacccactttgattcttcgctgtttgcctgatgcgcagcaccacactgcgtagagacctttggctctggttttttctttttccactgaaacacagcaaattatacattttatgaaaattggcatcgtacaactggaaaatttaaccataaacttaaaactcttttaccctgttggcccccatcctccagctgtgtccacactttgagcacagtcatgagaatgacttggttgggtgcggggtggtgtcacaaagccctgtctcttgtgtgatggctgcgcctcgaatcagtgggagggcacctcgcccgtttacagttgggcaatgcttgggctgggcggcctggctgctcctggactcgcctcccagcgtctgatgctgtgtattttccatctgccccaggaatttgacacaggtgtgacttgcaggttgtgtgggtgatgcctccctccctctttcctcttaaagcatctcatgcttcttcattcgctgatacttacaacccccagtggatatttagtggagtttgctgtagtgcttttgccatttatttggactattggaaaaatttcaggtttggttttggccctatgtcttgatggagggcaagggttaggatttcagtttatcttcccggtgaggtctgagcacgtctgtgccctgaggtgggtggtttggtgaaggtggggctttaacctagctctgccacttaggaatcagaacacacacacacacgcgcgcacacacacacacacacacacactctctctcacacacacatcgggatatttttcttgtttccttcttccagagggtgtaggagttgtgttccaa

SEQ ID NO: 1280 - DNA, 1079 bp, Homo sapiens
caacacctccttcgtcttcattctcccctggcctttcaaacccttctctgctgctcagggttgtgagatgtggaacccatctggatgctgacactgggtcggtgagtggccaaatactgttttggccacaggcaggagctgtgctctggtgaaacctctaaggcagggacctggggaagggatagagaataagaggagagatgggccaggagggatcttgcccatggggagccaaccgtgcctcaactgagagcatggctgtactcagcccaagcacactaacatcagcttcaagctgatttccctttcctttgctccacacaccttgtgttgttctttttcagcatcctgtgtatgttagctctaagcccagccaagccccatgccctccacttcagggacagagggtggctcatcccttttgtgctccctcagctccctccccagtgcctggtggctggttggcaacacagtcatgcccttgaatgatgggagctggtgcacactgcatccgtgttcatgcagtcaccctccctccacagagccgggcagaaagggctccaccacacttagacattgagggaagggacgttttgaatggcactgttttatgtgatcccgcaggacagaaggagatttcttgaatgggagtggtctgttgttgagagggatcctgaaagacagggagacaaagatagagggaggatccacataattaggaagcagctgagagcaaaggagcccctgccagaggaatatccttggggggtaaaaagccagctctgccctttctccccagccgattcatcctagcccagcaaattcaaatctaccttctatcagaacttagaaaggatgtaaagcagtcaggaagaaacatcccctgggtctggggaaactatcaggagcagtgacatcacaagaaaaaccaccaaccagggccaaggagaccagagcccagcacctcgcccaaaggaccccagtcagaggccccatctcagacccgaggctagcatgggctgcaggctgctctgctgtgcggttctctgtctcctgggagcaggtgagttaggttgaaa

SEQ ID NO: 1281 - DNA, 909 bp, Homo sapiens
gggctttcggtttttagtccttatgtttctaattcgtgcatcgaagaaaccgaaagcgggaggttttgaaagacactagtgccaaatggagaccaagactccgacttaactgtaaagctgagagttttccaagaaaagggaaccccacatatttgaccaagattccaagtttcagaaaccaccgcatcaggtctacttgagccaggaaaaaaatcctgagttcggaacgggccacccagagatggttaagctaaaactgccttcttttctggtctccaaagtgaaagcgaatccttggctatgtgcctcaccgtcccgcagccccatgttaaccccgcaaaaccgcatccccccgaccctccagcagcctccgaccaaggaagctccaggaatcccgggtcggcctggcaaatgactttgcaaagccgcatttccaactccattccctactggaccctccagaagcaccaatgccgacgtcaggatgggaaaaactaaatcgacagagtaccagcaacctcgactacgctgaagacctcgagggccccttccatacctgaatgtagtcagcgaaaagctgtacccgcgctccgccatctttacccgaagagccaaagcacagccgcacacatgcgcactgtggccgatttcctttcatttccccgcccctcacctttcctttactctctatgattggaggagagtcagagctgctccaagagcatgcggggtgttgtagttctaagaagcgaggcttgcccgattctgtgcctgtgcgcatgctgaaagcaggggcgggaccggggcggtcttccagcagggaaaatggcgctggccatgctggtcttggtggtttcgccgtggtctgcggcccggggagtgcttcgaaactactgggagcgactgcta

SEQ ID NO: 1282 - DNA, 991 bp, Homo sapiens
gcccattcccttcacttaacattactgagctgggcagtaagctcagagttgcagatataaagatgaatagacagatacctacccaggagcttactctagaagaggacagatggataagctacattttatagcagaatttggcaaagtgtactgaagctataaacagctatgatggtaaataaggtaagaattatgcttagtgaggtcagggaaggcttctagagctaacatctgaactgggacttctattggcaaggcagaaaatcaggaaaacgcacttattcctggcagaggaagcctcttgatcaaaaatcttaagagatgaaaaaggaccggttgttaggaaacagatgatggtgcccagagcgcaagatgagggggagtgttgggagatggagctaaaagatacactggtgccaaagactgaagagcctcctgtagatagcgcagggcgcagcgctgaagggaaagaaaaagttgggattgttcaataaagttggtgactgattcagtcggattaattccgccctggtggtcttgtgggaatgaagataactagcaggatagtctaagaagccctgtggaagcagagtcatgagctgtgaatggggacgtggcggccacacggccgcgcccacgccacccgcagtacggggctggggctggggctggggctggagcccgccgtcccaacaatcccggggacgagagttgggcgggaatccgctccacgcaactcggcgcggtcccggggacgtggcgctttccagccaatcccggctatgcgattgttagaccaatggctactcggggacgctatgcgacagcggcgggtttgctgatgattggtcgggaggccgccggcgaggcggatgagggcggggtgcggacccgcttccggttgggcggtgcttgcgcgcgtgagctgagccggtgggtgagcggcggccacggcatcctgtgctgtgggggctacgaggaaaggtaagta

SEQ ID NO: 1283 - DNA, 1096 bp, Homo sapiens
gcacacttgcagttggacattaggaagattaacatatcaatactgcttaggagtagtacaggtagggtggggccgtgctggaaggatgggaagagggaggccgaaaaacaaattggttcttttcaaaccatccctgatctcctccccgacttttataagtcttatctatagggaacacaactattcgagacatactctgtgcctggcgccgggtttacaagagggggtcgtgtcccacttccctggcgaactcctacgaatccttcaatacccggcggtaccctctgccagtaaaggctcataaaacacgctacagtcacaggatctcctcagatcagtggaggcggcaggaaggcgtcccagggaagggttaacttaagcgagatcccagcagagaagcaggtcgaagatccccgggcagcgcgaaaggaggttcagagagcccaccccatctcctgcaacatctctccaatgcaggcacacacacggggtccccacgagcacagacacacaaccaaccgtcctctttccagtccccacaagggaccttcaaagggtctcctccggggtaccactcagacccgcccccgccacccgagcgcggggagcaggaaaactctagcggcagccgagacgctgctcacccggcgctcggcgccatcttggccccgccccctcgtgggagcaggtcctggcagagcctaagagcaagtcactgccccttccccgtaccagaataagtcctctaggctcgcagaatgaaattatattttaaaagtttgtttctacatctatatataaggagcactccctcttggtgtaattactgcaatttattccttcactacccggctgccaggaccttcaagaggcgccacaaaacggaggcagggaaacccgtagcaacgaggccccacccttgttgggctgatcctgcgcatgcgccgaccttcctcggctggatttaaggttgccgctagccgcctgggaatttaagggacccacactaccttcccgaagttgaaggcaagcggtgattgtttgtagacggcgctttgtcatgggacctgtgcggttgggaatattgcttttcctt

SEQ ID NO: 1284 - DNA, 1052 bp, Homo sapiens
tcttcctcaacaagatggacctcctggtggagaaggtgaagaccgtgagcatcaagaagcacttcccggacttcaggggcgacccgcacaggctggaggacgtccagcgctacctggtccagtgcttcgacaggaagagacggaaccgcagcaagccactcttccaccacttcaccaccgccatcgacaccgagaacgtccgcttcgtgttccatgctgtgaaagacaccatcctgcaggagaacctgaaggacatcatgctgcagtgagcgaggaagccccggggtttgtcgtcgttgagcagcccccacggctgtcggtcagactcttgggtgtgtgttgtctgtgtggtccttgagtgggtttctcggatccgtgccctggaatacctggctcaggaatgctgtcagaccagccagccagcgagctctaggcaaaaggacatggaaactgtcacgttagctactgaatcctgggggcgagtgaaactactgaaaatccgagtgatgatgttgtgaatacggaacacctaatcacacagcttgctttgcttttacagaaacgttcctctttttctgacgcagtttaattgaggaccgtgttgtgtgtgtatgtgtgtacacacgctctgtctttaatgacagaaacacaaaaaccagctggccttgcagacggcttttctaactcacaagtcttccctgagacagactaacctgaaagctttgcctaacagtagcttgtagagatccagtgcacgccgatgctgctaaactcagtgcctgagcccggccctgcagccccagccgcagtgtctgaaggccacctcccaaagggagcacgttgccttttcaaactcccgtgccgatttcctaagagcccctagtccaagcctctcagatgaagctgaggagccgtgcctaggatcccttcccagctctgaggacgggctgcagagctctgcaggtgtggattcaccttacgcccctacagcaggctcagcccttcccaccctgccccatgcccagcagcacaacacggagtgagacaggatg

SEQ ID NO: 1285 - DNA, 991 bp, Homo sapiens
ttgatcctcaggagcttctcaacattttttttttttggccagtgcagtggctcatgcctgtaatcccaacactttggaaggctgaggcaggagaatcccttgaactcggggagacggacgttgctgtgagctgagatcacaccattgcactccagcctgggcaacaagagcgaaactccatctcaaaaaaaaaaaaaagaactacacaagaaggcaaaattaggctgggtgcggtggctcacacctgtaaacccagcactttgggaggccgaggcaggcggatcccttgaggtcaggatttcaaggccatcctggccaacatggagaaacccagtctctactaaaaatacaaaattagcctggcatggtggtgcatgcctgtaatcccaggtactcgggcgctgaggcacgagaattgattaagcctgggaggcggaggatgcagggagccgaaatcgtgccattgcactccagcagcctgggtgacagagagagactctgtctgaaaaaaaagaaaaaagaaaaaaaaagaaggcaaaatcagcagcccccaagtgaggttgtgaggtcctgtctatgtgggaaacccactccatacactgtggctcctgggaccatttccaaaccctcagctgagatgtgggtcgggacatcatcaggcgggactcctgggctggatcagggctacctccaaagatcaggatgcttggctgccctgcaaaggggtggagacctatccaggccttcctgaaacctgaaccctggggtgggggggctgtggggggaggaggggctgcctggccttgagagtccatgcctcccccaaccacatagctccgcctccacctgggtgccctttttctggggccgctccagctggtgccggccacctccactcccctttgcttcttgctgtccctaaggtcggatggggacaggctggggccaccagccagctccatggacagggactttgcctctgctcaccttc

SEQ ID NO: 1286 - DNA, 1027 bp, Homo sapiens
aaaagaagtggaggagggtgaacaggttaccaaacccacttagatacactccgcatagactaactctccaaattaaaggacaggaggtcacctgagctgaccataaaagctcagagtgctgatgcgaataagatcagggaaggctgcttattaacaccgtggtcactacaaaagttcttgagggcatctgctgtgagttttccatcgttccttattgtcctcctgcatctcctgttgcttttcttggccctctccttttcgcattttctatgtcctttgcccagcagtagtactgcaggcataaaccattgtcgacctgagaattaaattagcatttggtagccagacctctccttgagccttagaatgcttgtgtgcttgaggtccctgaagtgtaacgtcatctcaaagcgcaagtaactaaagggaacctacatgtgacaaggtgcagcggaggttcaagcagagcaccctggccgcatcgcaacagattataaagtgtaggggatgaaaatgatggaagacatcagaaagccgagctgtaaaaaagcccaaactaagcaaactgagacgcgcaagcgcgttgctcacagctcgtctcccgaggccgagccacagcgcctgcgcacagaatccggggagggtggggaagagatgagcacccaggcctggagctcccactgcctcagcctccctatccccgcaagctccgcctcctccagctgctcgccttcccaaacaaccgggttcgccgccggcgctttctgcccattggcccttagccttttccgtttccgcccagccctcaaaatccaccaatcagtttgcacttttgggtgagggtccacctccaaggctgtcgctccggttcctctgcctcctctggctgctgcctccgcagctccctcctcctaccccacctcctccatctggggagcgtctgcgggggcctgaggggcggcggcggcggcggcggctgcgatatggagccaggggccggcggccgaaatactgctcgtgcgcagag

SEQ ID NO: 1287 - DNA, 911 bp, Homo sapiens
ctcacccgacctgtatggttttttgacaggcagagatggacgtaacatcagtcatgggcaaagattaccaccagggggcagactagggcatccttgggattctgtgatcagtcatccctcctcgctggtgaatggaggcagtggtcacaactctccccagagaaggtggtgtgaggccatcacggaagatgctgctgcttctgctgcttctggggccaggtataagcctccttctacctgggagcttgggtgggcatgtgcgtgtgttggcatggtcaagtggtggccagcagggttgcaatgtggattgtttatgctcatcgaagggagagggagaggccctgctctctagaggtgtaaatggtaaggtgaaagccgccggtcagaggagatgggggattatggccctagggagatgacgggaagattgcacaaaacaaacaggactctccaggagctgggagcacagggagggagtgaggctcagctctgcctggcgtcctgtctgactcggctcccactgggctctcctctctctctggcttctgtctcagcaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagagacacagcgccaggaggggatcagacaccgcggcaagaacccctgcagctgc

SEQ ID NO: 1288 - DNA, 914 bp, Homo sapiens
gtgtatgtgtgtacatgggcaggcacgtgtgtgtggtatgggcaggcatgtgtgtgtgcatgggcaggaatgtgtgtgtacacgggtgggtatgtgtgtacataggaatgtgtatgcatatacacgagcaggcatgtgtgtgtacatgggcaggtgtgtgtacatgtatgggtaggcatgtttgtgcgtgggcaggtgtgtgtgcgtgcatgggcaggcacgtatgtataataggcaggcatgggtgtgtgcatggcaggtgtgtgtgtacatgggtaggcgtgtgtgcatgcagcttacataagtggcagtgctctcaggaggggagcacacagtacagaccaggtttcccactttccccaggcagtgtcccgtgcagccccgtgtctgaagagggtgtcaccgatgccccctgcctccacggagccccgctctttccctcggtctggaagacagcgagcaggaccttggtacttcctagggtaggcagtgcgtgggtccacagccctgtggttccgattcaaaccatgcagcccgagagactccggtgtttctgggggcacttttccaccttctcagccccgttttcttgctggagtgagagggctgcaggaagctttcccagcagcaggagcagcagccagagcagacacggcagcagccacggcagcagcactggcacccttcaaattgggactctagccctttaaatctgctcagttaccaaaaaagaagaggcatcagaccctgttaattaaagctcgccccggtccatcattctgaggagctgcagtgccctgctccttcctgatggcttagagattctccttaactcccagccatggatcttggagaatttcccccgagatcagcaggaggtatgacccttgccgatgacactctgaagcttgtgt

SEQ ID NO: 1289 - DNA, 1093 bp, Homo sapiens
cctgtaatttgggagcgtctatgctagggtagggcagcggatgtccacaaggcctgagcctcacacccggctcctgcagcctctgcagattaaggtctggtgacatgaggtaaacactcactgaagatgctctaaaagttggcagtcccgggccgatggtccctgaactacaattcccacaatccattggcgggcggggggttccaagccagccaaaaaaatgcaggctctctctggatgcagtttgaggtggcactacacgttcgcttccttgaccccatccaaattcagccaagctccaccagaacctccctcaagccttcaaggaggtcgggtgacccacccaatacaggctaggatgtccggcctagaagaaggaggtgtggccgggcgatgcctataggggctacccccttcaaataccttcgcatttgctgggcaagcgttctgtgtcatcgtcctcctccttcaacatcccagcccaagcctcgtgcacggccaaaaaaaggaaaagcaatattcccaaccgcacaggtcccatgacaaagcgccgtctacaaacaatcaccgcttgccttcaacttcgggaaggtagtgtgggtcccttaaattcccaggcggctagcggcaaccttaaatccagccgaggaaggtcggcgcatgcgcaggatcagcccaacaagggtggggcctcgttgctacgggtttccctgcctccgttttgtggcgcctcttgaaggtcctggcagccgggtagtgaaggaataaattgcagtaattacaccaagagggagtgctccttatatatagatgtagaaacaaacttttaaaatataatttcattctgcgagcctagaggacttattctggtacggggaaggggcagtgacttgctcttaggctctgccaggacctgctcccacgagggggcggggccaagatggcgccgagcgccgggtgagcagcgtctcggctgccgctagagttttcctgctccccgcgctcgggtggcgggggcgggtctgagtggtaccccggaggagaccctttgaaggtcccttgtggggactggaaagaggacggttggttgtgt

SEQ ID NO: 1290 - DNA, 801 bp, Homo sapiens
gcttgggttacattctgtgtacgaatggaacaagcagaggaatttttttttttttttttttgcggtggagggagcgcaaaaacagtcgttctgttctcgctaatatgggaatgtcacgaactacgtccccgacatgaggccgcggatcagaaccggggctgagggcgaactgtgtaagctgcgtctgctacgctgcccgaggtcccgtcatcagccccctctcccacggagcccttctttacctaccccacggaggactgggaaagcccggccggctctgcggaagcttccgtagcagtcgctcccagtagtttcgaagcactccccgggccgcagaccacggcgaaaccaccaagaccagcatggccagcgccattttccctgctggaagaccgccccggtcccgcccctgctttcagcatgcgcacaggcacagaatcgggcaagcctcgcttcttagaactacaacaccccgcatgctcttggagcagctctgactctcctccaatcatagagagtaaaggaaaggtgaggggcggggaaatgaaaggaaatcggccacagtgcgcatgtgtgcggctgtgctttggctcttcgggtaaagatggcggagcgcgggtacagcttttcgctgactacattcaggtatggaaggggccctcgaggtcttcagcgtagtcgaggttgctggtactctgtcgatttagtttttcccatcctgacgtcggcattggtgcttctggagggtccagtagggaatggagttggaaatgcggctttgcaaagtcatttgccaggccg

SEQ ID NO: 1291 - DNA, 1020 bp, Homo sapiens
atgctttaggcctggaattcttcaactttggcctacttctgtatgagggccttaaggctcctctgccattagttgtgcaatcttacataaattaaccattttaacgtcttttcccctttgtaaaaagggaaatggcaatagttgagttcttctggggactaaatgacataaggtgtatcgattgttcagcaattagtattgctttgaccctatggttccaaaacatgcctgctcatcagaatcacccgaggatctttaaaaacattccaaagtccggtgctcaccagaccaattaaatcccaatctctgagcgtgtcaggacacgctccccaggtggttccaaagtgcagacaagtttgagagccaccacagtttggattattgatgtgccacaataacacttgctaatccatctgtctttaccccaggtggaaccaggaagcctccagagcttaatggaattcagataatcgaggtgcatacgcaccctacgtcccatcctgtgacttgaatcccaatctcttccgaaattttaaagcagggagggatgggacagaggcctgacctctcctgcatactcatggcccttgagtatctgcgatctttagatatgtagggcgttctgacatttccacttgcggcgacagctgggcctgcccgggggaagcgcagagcgggcaagtcagccctcccgcaggcgctgggaccgggtgcggaggccgcagccgagccgcgagggcagatcggcagcctcagctgctgccgtagctgtcgggatcgtcccctgcggggcagcaacagcggggctccgacggctgaggggggcgccttctgcttgcgcgctctgcgtccctctccgtggtctgcccttcgccccgcgaccccggccgagggtgggagcagcgcggggtcgcatcggcccgaggctagcggggctcgccgttccgcccgcagccatggaggccgggccgccgggcagcgccaggccggcggagccgggtccttgcctgagtggtcagc

SEQ ID NO: 1292 - DNA, 1054 bp, Homo sapiens
aattttcactacatgccctttggtgccttttgaattcagaacaatttccgttatttattaaaaataaaatacagccgggcgcggtggctcacgcctgtaatcccaacactttggaaggccgaggcgggaggatcacttgaactcaggagtatcacttgagctcaggagtttgagaccaccctgggcaacatagtgagaccctatgtttacaaaaagaaaataaataaagtaaaataccacgtgttactgaatccctggtatttggcgggacactggatactggaaacaattgtggagctctttggaaatttaccttaaaagggagtccgctcaaaggcaggaatgactctacaagggtgaattttcaaatctgccataggggcctcgggcctcagcagcatccagagccctacggacgggcaggttcttacgtctcaactcccatcgcaccagtcctgcagctttctaaaggtatccagcactttctaccttgcattctatcttcatcttcgctaggcctcacagcaccgcatgattccgggggagggtgcttatcagactcgcgtgtggccccacggcacctagggcaccgtcgagcacacggtccgggaagctccaatgaaacggaacaaaccgcgagatcaggggaggtaggaggcccaccctacgccctgcccccgcggagcacaagccccgcctgcgtcccgagctcccgggtccgcaaagctgggccccaaagagctccaacgccggaaccaaggagcacggaatgccgggaacaagctcctcccgtgcgcgatgacgacaaggccgaggcgcgaagggtgggaccgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaag

SEQ ID NO: 1293 - DNA, 1033 bp, Homo sapiens
gtagctggtactacaggcacgcttcaccatgcccagctaatttttgtatttttagtagggacagagtttcaccatgttggccaggatggtctcgatctcttgatcttgtgatccgcccgcctcagcctcccaaagtgctgggattgcaggcgtgagccaccgcacccagccaacaattacacttcaaggagatggctcccaagaaacattcctgagttgaacctggccatataagaaaaagacttgagtacatttggaaaggagagaggctgaaattttgaaagaaaaagggagggggatggtttctcgtcccttcttttcctcagggaaaattaaaccctatgtataatttgtatttgcccttccacctgcatcacctttcccacatgctcccacaggcaggctcctgttcattcccaaggctccgtgtccacatcgtgcttggattccgcccggccccgcctgtgcggccgcaccaggaaggcaccacccattaggggctcagcgcgtccctccaggccacgccgtcaggcctccgtccttttagctgtaggggcagattacgtaactccagccttctggtcactaaaggagggtaacaaagggcggtcgagagactccactgagttgacacgcagacgcagcctcaggaccctaaactctacgccccagcacaccctaccaagcgagcgcccgcggccgcgtgacgtcatctaccccaaacgctgtggccccggccacgcacggcttcggggcgggactacgcggtgacgtcgaggtgcgcggcgcagcgcgcggcgtcagtcttggctggcagacctgtactccgtactccgtacttcgtagtcgcagcggcgcggtcttcggcagtctagtcatccaccgccatcctgggccccacgtgttgcctgaccattcctgagcccaggtaggggtcctgggggattgggttcagtggcgggcggcgtgggaggctgggccgcagtgagtgggggcaccagtgattcttggagaccaagccttcactacacgt

SEQ ID NO: 1294 - DNA, 907 bp, Homo sapiens
ctaaagcccagtggtcagaacagcccctcctccccaggctgcagctgaggcctgggaggggaagaggtggctgtgagaaacaaggacctcaatgctacacagaccatgctgagcacagccagcccggcaagtgcatttcccagcctctcagaggtgaagtgaccgtcacacaacctcagaggcaacactgggcgaggccaggccattggttccctctcagcaagttcagaggaactcatcctgagatgctgtgatttctgttgggaagactcaggggcagagacagcattccccagatgggaagtctttgccttaagacccagcccctctgccctgacagggtcaaggacgtgctgctcaagtccacctgtgtgctggaggcctttggcaatgcccgcaccaaccgcaatcacaactccagccgctttggcaagtacatggacatcaactttgacttcaagggggacccgatcggaggacacatccacagctacctactggagaaggtgggcaggtgggctgaggagacctccatggggagccctggccgagacccatcccaggcctgggaaggtacccatcccgacggtgcagcttaggagggctgggctgtctctccctgtggcccttctctgggcctcagtgtcctcatagtcaggactctctgacccccagcctgccttgcacctgggaatgttcagatggggtccccagggtcagactccttcccaggcctgagtccatctgcccctctctcctcagtctcgggtcctcaagcagcacgtgggtgaaagaaacttccacgccttctaccaagtaagccctgagggcaaggggaggtggaaaaatggggtggggaaagggagggcagcaagctggaccagcttgtgacccttccatcactacc

SEQ ID NO: 1295 - DNA, 1025 bp, Homo sapiens
atagtccctgtgtggagtccaaggggtaggagcagagggtccccaaacagcacgtcgcaaacatcgatacaagcaggaaccagcacgctgctggcctcaagacaccaaaatatctgggaagacatgtgtgtgagcacatgcatgtggggacatacaggtgggaacatgggtatgagggctgtgtgaggacatgtatgtgaggacatgtgtatgggaagacatatgtgcacaggtgtcataagtgctccaggaacacactctgtatccctgccatctccccaggtgtggggtgggcagggtgggctccatcatctctcccccaggcctgggccacactgccctgtcctgtggtgacaggtacaagatgacctgtgaatacacatggcccaaccacctgctgggctccgacaaggcagccgtgagcgctctcctggagcagcacgggctgcagggggacgtggcctttggccacagcaagctgttcatccgctcaccccggacactggtcacactggagcagagccgagcccgcctcatccccatcattgtgctgctattgcagaaggtgaggtgggcggggcaggaagacatccactatggaggtggggaaagcttgtgtcccaggggccacaaacacacttgtaagtttcacaggagtctctgcttgatggagacaggccagggagtgctcaataaatgctcagggccaggtttgggtctaagggttagggcctgattgaatttgactgcgtatcccatcccacctggcccacccaggcatggcggggcaccttggcgaggtggcgctgccggaggctgagggctatctacaccatcatgcgctggttccggagacacaaggtgcgggctcacctggctgagctgcagcggcgattccaggctgcaaggcagccgccactctacgggcgtgaccttgtgtggccgctgccccctgctgtgctgcagcccttccaggacacctgccacgcactcttctgcaggtactactctcagcccaccacaca

SEQ ID NO: 1296 - DNA, 1087 bp, Homo sapiens
accctcatcagagccctcctctggcctgtcccctcccctacccccactcccggctggagacggggtctgggtgggctgggtgctgggaatgagaataatcctaatacccatcatttattgagtccctgctgtaactggccctgtccagggaactttcgttacgttgtctcattatttaacccttaggaggtaagcttattatccccacttcacaaggggaccgaggctcagacggtagaaataaccctctcttggccaccagatcacgggtggcaggggcaggatttgaacccaggaccctcagttcctgaagccatgttctctcgaccctgccagcttcccctcttcgagagaaaactcagacagggagggcgcagggccagaacggctccttaaggcaggcagggctgcggggaggctgggccagccagcctgagggggtaggcagggtcctgcagggcctggggcttcccttcctcatcccccttccccactggctgggggagcagcctggactgcagctctcagaggccagggagaccctgaataaatcactgccagccatacggacttgaggaccttgagagagaagcattgggggtgcaagtgtccaccaaaccagataggcatccctggccactgcctcccagtcttgctgagcccacccgctctctctgggtccatcccatccctgagccaggggaggcagcatttcatgggcatgtctatcagaggtgggacttgcagcctctgccccacgagtttgtctctcagtggactctataggtttgctacttttgcatgacacagcaagcccagtgtcccctttgcaagctgcagagagggaaacagagtcccaggcctgctgggaagagatgctcctgcctcccaccttccagagttgggggcctggcaggctccatggcaggcaccaggtccctagcagcccagaacagctctgactggagccctcaaggcctctggggccagggtctccgtgatcagctcagccctggtgttcctctcttgctgggctgggacctgggacacagccacggcagcaaactcagagaattgaaggtgctgg

SEQ ID NO: 1297 - DNA, 1062 bp, Homo sapiens
ctgtgacgtcgcttccttaagtttggtaaacgcagcgtgcgtcagcgcgatccggaggggcggggcttcctgacgaagggcggggctcatgaattattcatgagctgttggtagcaaacctccccccctctgcccaccttcttagaagcgcttccgagggagcggaggggagaccctacaaagccaaggaagggcgggagtggaactgggctcagtaaaacgcgataggtcattataactcaccccccttgaaaatattctctgctgaattggggaaaaataaaaagcactaaaacagccgatgttgtccaacttcctcttcccccgaaacggctgagtcgttctctggctcctctaccttcccccaatcgcaatcacctggagacgccacaccacgccttcctctccgcctcaacacccacgacccgaaccccaacgcatccgcccactcccgacgcccgctcactggcccgtcagttcgcgggcctctcaacacccaccgcggcgccacgccgacttatataccagcgagtgtgggcggggacgggggttcggtccgcgctgggcccccccagcttctgccaatgaggaagaagcgagtctacgccgttttcccggggagatgcgccgcccggtctccctgccagcggagtgctgggccgaggacagggcggcaggggtgacagtggggtccaggagagtctcaaaatcctaaggtgagggcgtgaaggagaccagcaggaagaggaggaattagagaacggaaagagggaggaaaaggcagtctgaaacagaaaagttagtagatgtgcttcaggaacaatcaggcgccgcggccgccgcctaaaaatatgtgacaccaaagaggattctgggatttgtagttttcccgggacgttcgggtggaagatggcggatttacctcagctgcggaaacgcagacgctgtttccagttgcgcatgcgcctcggccccgcgagcgcaccgccctcgggtggagctagtgctcagggcgtcctcgtgccttttcttggtggcgggaaacctgggttgaggtgtgag

SEQ ID NO: 1298 - DNA, 902 bp, Homo sapiens
ccggtgggagtatttgttattcacatggaagagacttggcgcctgctaggccagctcagccccctcagcccagagatcagccacaagtgcggccgctgtgctcgcctcacgcggcggcggcggcggcggcggcggcgctgacatggagctgcgggcccccggcgggcttcctcaccgcgccctctgcggggagcagggtaagactcgccgcccggcagcagaaagcggctccgaggaaagcaagtgccgaaccacgggacaaaaagcccctggcccccaaacttccccaaaacgccctgcttgttggaaaaggagaatccccccgttttattcccctttccgttttcttctctaaaacctttcagcggacagccaggtgcaccattccttctcatatcactctagtgatttgtttttcctgagcacaagtagatggccctgcatgtccgtagtctgtgagagaaatagcgggcggaggtgacgggaatggggggagaaggagagtgggcaccagggggcgaggggctggccgggcattggagcttgattgggtgtctgttgattttacgttgcaaagaacaaggcagccacccctcttgtctgcccatgattacattacagtaaagaggttcagaaaagagggagactttacccggaactcccaaggcttggagatgtgatcccccaaaagtttagtcggcgaatgggagactgaagggtgacgggaagggggcaggcgcgctcggcgctctgactgggcgtgcggcggcaggattttaaagcgctctgcctcggatcgtctgccctgggtgacctcccggacctgccctggtggaatccggacttgccccgccgagatgacgaggtaccttcgtttcgcgaacctaacaggagggatttct

SEQ ID NO: 1299 - DNA, 992 bp, Homo sapiens
cccgtgatccttattctcactcatatcgttggtgcccgccaggagactgggctattttttttttgtctgtttcttgggggcgacagattctgaggaaaaagggcgaagggctggttgtcgccctgagaaagtttctcctcaggcaacgggtgccaggactggcagcgcctagcaccttcacctacaaccagaaactagctggctaccttcaggagcaaggaggacctaaaggcgatgggcggaaccagctgccgcagcgactccgcaagcccctcacacctcaacccaggtttcccgccaccaagaaaaggcacgaggacgccctgagcactagctccacccgagggcggtgcgctcgcggggccgaggcgcatgcgcaactggaaacagcgtctgcgtttccgcagctgaggtaaatccgccatcttccacccgaacgtcccgggaaaactacaaatcccagaatcctctttggtgtcacatatttttaggcggcggccgcggcgcctgattgttcctgaagcacatctactaacttttctgtttcagactgccttttcctccctctttccgttctctaattcctcctcttcctgctggtctccttcacgccctcaccttaggattttgagactctcctggaccccactgtcacccctgccgccctgtcctcggcccagcactccgctggcagggagaccgggcggcgcatctccccgggaaaacggcgtagactcgcttcttcctcattggcagaagctgggggggcccagcgcggaccgaacccccgtccccgcccacactcgctggtatataagtcggcgtggcgccgcggtgggtgttgagaggcccgcgaactgacgggccagtgagcgggcgtcgggagtgggcggatgcgttggggttcgggtcgtgggtgttgaggcggagaggaaggcgtggtgtggcgtctccaggtgattgcgattgggggaaggtagaggagccagaga

SEQ ID NO: 1300 - DNA, 995 bp, Homo sapiens
tcccaggactccatctctaaaaaaggaaaaagaatttgtcatacaaataacaatatgtagccaattgatagcttttgtttttgtttgtttgttttgagacgatgcgtcgcccagctggagtgcagtggcgcgatctcggctcactgcaacctccgcctccggggttcaagcgattctcccgcctcagcctgccgcggaccttgtcagggtccgcgctgagaggacgtcagggtagtcagtccgccagaatacggctgagcatgaggcctgcctaaccttgaaacccagcgccctcctgatccacacgttctaagacgaataaatcctcacagtctgtgaaaacccaccaggagaagcacgtccaacactctttacctccccaaacaagtctcagaagcgggaaaaccaacgccgcgaatgggcgggaaagccacagcgcctgcaatcgcttcaccttattagctaattttgctgtccttcccagtggcccgcctcccttgctcgcgggcgatatttttattggctttcgtctgcgaggcgtccaatctcattggtttgcctttctgttcgtcaggcttgggcgcctggtgaaaggcagagagcgcgtcactattggggctggaggccccgcctccgcgtgccgtgtgcaaaaacaaacagccgttaggaaggcggtgccgggggggcggggtctggctagaaggaggcgcgcgattgaacagccgctggggttcgaaccagcaagacaagcgggcattggccacagcagcgcgaggcgggcacggggtattgtccggctccggcggcggcggtcggtgctgcgagagcggcggcggcggcgcgggtcggcagcgggagggcgcgcggccgagcggaggcggagtcggcgccgagaacatggtaagggcggccgggtgggccgggggcacggggcctgggagagcagagcgcggaggccctggcgtcggcgccgctacctgtggagtcgggagttt

SEQ ID NO: 1301 - DNA, 1219 bp, Homo sapiens
agtgagtgggtggatgaatgaatgcaggatgcagtgagtgagtgggtgagtgggtgaatgaatgcaggatgcaataagtgagtgaatgagtgaatgcaggatgcagagagtgagtgggtgagtgggtgaatgaatgaatgcaggatgcagtgagtgagtgggtgagtgggtgaatgaatgcaggatgcagtgcgtgagtgggtgaatgaatgaatgcaggatgcagtgagtgagtgggtgaatgaatgaatgcaggatgcagtgagtgagtggctggatgaatgaatgcaggatgcagtgagtgagtggctggatgaatgcaggatgcggtgagtgtgtgagtggatgaatgaatgtaggatgcagtgagtgagtgggtgaatgaatgaatgcaggatgcagtgagtgagtgggtgaatgaatgaatgcaggatgcagtgagtgagtgggtgaatgattgcaggatgcagtgagtgagtgagtggctggatgaatgcaggatgcggtgagtgagtgtgtgagtggatgaatgaatgtaggatgcagtgagtgagtgggtgaatgaatgaatgcaggatgcagtgcgtgggtgagcgaatgagtgggtgagtggatgaatgaggaagtgcgagtcagaaaaccccagtgtaaccggtgaatgagcgaacaagggcgtgactgggcgaggagagatgggagtgaatgagggtgcggtgggtgcaggcttgcgcctgaggtagtgcacctgcgagtccggaggtccaacctgaggggaggtaacctgcgccaccagcaggctccgtgtccacgtggacggggaggggcatgtgggcgtggctaggcgggttgtaggcgtggcgaggccgggcgaggagcgcggcgggcccgcaggggcggactgtgggcgtggcgcgcgggggagggggcgtgaccaggcggggtgtgggcggggcgagggcgcggcgcggcagggctgcgcggccgggtggcgcgggaggaagtcacgtgggagcgcgggctcacatgactggccgcgcgatggacccgctgcccgcggctgcagtcggggcggcagctgaggcggaggctgacgaggaggcggatcccccggcgtcaggtagggcgtggggcggcggtagcccccacctgcccagggcgcgcggcccgaccacccccggcggacggggctcagccgccgcgcttggtccccgactcgttt

SEQ ID NO: 1302 - DNA, 903 bp, Homo sapiens
gtacgtctggaaaaacggtgactcccagacatgtccgccagacctggacaggcaggaccatgctggtgagaacttgtgggctgcagctggagactgtctctcaggtggctcacgcctgtaatcccagcacgtggggaggccagggcaggatcacttgagctcaggagtttgagaccagcctgggcaacatagtgagaccctggctctactaaaaattgaaaaatgagctgggtgtggtggtgctcaccttgtagtcccagctatgcgggggaggctgaggtgggaggatcacttgagcctaggagttccaggctgcagtgagctgtgatggtgccactgcactccagcctgcacaacagagagagaccctaccttctcccacccaaagggaagggggtgtgtcttgttttcacgccacccttctgctctccctacaccgttccccaccaggctgctggtcagcgcctcccaggatgggaagctcatcatctgggacagctacaccaccaacaaggtagggtggcgcgggctgcggggtggggcagggccacagggccctggctggctctgaccccggcgcttcccctgctccgcaggtccacgccatcccgctgcgctcctcctgggtaatgacctgtgcctacgcgccctcagggaactttgtggcctgtggggggttggacaacatctgctccatctacagcctcaagacccgcgagggcaacgtcagggtcagccgggagctgcctggccacactggtgaggggcctggcccagttcgggccctttttggggttggggggtgcactgccctccgtgtggagacctggctgaccagctccttccccagggtacctgtcgtgttgccgcttcctggatgacaaccaaatcatcaccagctct

SEQ ID NO: 1303 - DNA, 1021 bp, Homo sapiens
caaactgacaccctacttccctgcgcagctatgtccggccctactgatctcctttgtctctgccgcgcgatcccacccaccgtaggcgggggacgggagctggtgtgaaaaggtctccttgacacccgacccttgttcctgaggaatgagtctcagcggtctccgcccggctctaaatccaacaacctccccaccccgcctccttcctcccccctagtgggcagcgcctgcgcacacccttttgggcttgcgcgggtagaggcagcacgtgctgaaactggcgccccgccccccgtcttaggggttgggcctgtgacgtcgcttccttaagtttggtaaacgcagcgtgcgtcagcgcgatccggaggggcggggcttcctgacgaagggcggggctcatgaattattcatgagctgttggtagcaaacctccccccctctgcccaccttcttagaagcgcttccgagggagcggaggggagaccctacaaagccaaggaagggcgggagtggaactgggctcagtaaaacgcgataggtcattataactcaccccccttgaaaatattctctgctgaattggggaaaaataaaaagcactaaaacagccgatgttgtccaacttcctcttcccccgaaacggctgagtcgttctctggctcctctaccttcccccaatcgcaatcacctggagacgccacaccacgccttcctctccgcctcaacacccacgacccgaaccccaacgcatccgcccactcccgacgcccgctcactggcccgtcagttcgcgggcctctcaacacccaccgcggcgccacgccgacttatataccagcgagtgtgggcggggacgggggttcggtccgcgctgggcccccccagcttctgccaatgaggaagaagcgagtctacgccgttttcccggggagatgcgccgcccggtctccctgccagcggagtgctgggccgaggacagggcggcaggggtgacagtggggtccaggagagtctcaaaatc

SEQ ID NO: 1304 - DNA, 1058 bp, Homo sapiens
cccaaatcagcttctgcacttaatgccgtgatcccccacaccctgagttgagggcgtccctgcgaatcccctcaggaccccggcccaccttgggctcaccgccttcgacccaccttcactgacctgggtgggggacactgggatgtgatatccgtcccttcgcccttcgacccaccttcactgacccagggggggacactgggatgtgacatccatcccttcgccaggctgtgggcttgtctgagcctccgtttccttccctaaaaaatgggcagggtggcccctggaccatccccctccccggacaacaggggaccaatgtcagaaagatgatgggacgggtgtcccgtctccaagttgctctgccatcactcctggaggaaacagccctgagtccctggagggcctccaggggcacagactccttggctcggggagaagacgtggctattgtccccataattccagggcaaacggggcaagggcccaggggtggggcgttcactgttgttggaaaaaccctaaatgtaatcagcgggagaggacaggggccaacttggtgctgtcctgatctgcctggggtgatggccggagaggaaggctggagaggaaggctggggagggcccaccgtgggtattaccaagaaacccctgattcctgccgcagaggtctggtgcgatggggcctttgggagagcactgagctgggggccacaaggagattccatccccattctgttgtctgcacgttcactggtgcgataaaaaccaaagatgaatctcaggcaggcctgggggcttgtctcctgagagcacctgcaccccggcccccaggcagggctgggtctcagcccggcttcttgctggggactctgtggggcgggagctgcactgggccccccctggctccctgcactcaggccccttggccattcctgggctggtggtcagcggggacatccgggggctaagcctgctcccacccctaagggagaaacgggcctgaggtggccgttgctgaggaccggaccgaggttgaagggccaggaaccaaagat

SEQ ID NO: 1305 - DNA, 920 bp, Homo sapiens
cttcaaacaaagcatttccaaccccattaaatgctttttgaaaatgaggcctctctcttcccaacagagtgcgatgacatggatcctgcggacaaaccgccccagggcgtacctagcaccgaagcatcaggcgccactaggtctccagctccttctcggatgacgtccttcagcacgccccggtcccccgagatgtccagcatcctctgacttaaccgctcgtacagggactgatggagaatgaaagccaggcctcagagccgcagacccacccggccacccctcagcgtctacgcccccgaaacgtctgggccctcacctggccgggggcgtcgtccccttccaggactccctggtttaacgcgcttccccccatgtcctagctgccctccctgtggcgtgagccttcggcctggtgcgccccgctgcccttcctggctgtgactctggtggggttccgaaggcccctttatgcccggcagacccctaccgacggcggcattacattctggggccacgaggaggcactcatcgtttcgttccaaccgccgccaacggccctggccctcgcgagctctggaactacagaggtcgcacggtgagttgccaggtgtggcccgtaatcggagcgcacaaaacatgatgggacacgtaacgggaccacacagggcacattgggcacttgcaggggcgcgaggtggcggcacgtaatgggagcgcgctgagcatgatggggcatgtgcgggagcgccaggcggggcatgtaaccagagcgtgcggggcatgatggggcacggacatggggggttaggtggggcacgtaattggagctcgcggggcaggatggggcatctaactggagcgacagagagcacgatggggcacttacaggggccggaggctgggtacgtaatgagagc

SEQ ID NO: 1306 - DNA, 943 bp, Homo sapiens
cttcaaacaaagcatttccaaccccattaaatgctttttgaaaatgaggcctctctcttcccaacagagtgcgatgacatggatcctgcggacaaaccgccccagggcgtacctagcaccgaagcatcaggcgccactaggtctccagctccttctcggatgacgtccttcagcacgccccggtcccccgagatgtccagcatcctctgacttaaccgctcgtacagggactgatggagaatgaaagccaggcctcagagccgcagacccacccggccacccctcagcgtctacgcccccacgtctgggccctcacctggccgggggcgtcgtccccttccaggactccctggtttaacgcgcttccccccatgtcctagctgccctccctgtggcgtgagccttcggcctggtgcgccccgctgcccttcctggctgtgactctggtggggttccgaaggcccctttatgcccggcagacccctaccgacggcggcattccattctggggccacgaggaggcactcatcgtttcgttccaaccgccgccaacggccctggccctcgcgagctctggaactacagaggtcgcacggtgagttgccaggtgtggcccgtaatcggagcgcacaaaacatgatgggacacgtaacgggaccacacagggcacattgggcacttgcaggggcgcgaggtggcggcacgtaatgggagcgcgctgagcatgatggggcatgtgcgggagcgccaggcggggcatgtaaccagagcgtgcggggcatgatggggcacggacatggggggttaggtggggcacgtaattggagctcgcggggcaggatggggcatctaactggagcgacagagagcacgatggggcacttacaggggccggaggctgggtacgtaatgagagcgagcgggaaatgatggggcacctaac

SEQ ID NO: 1307 - DNA, 1092 bp, Homo sapiens
tttccccaattcagcagagaatattttcaaggggggtgagttataatgacctatcgcgttttactgagcccagttccactcccgcccttccttggctttgtagggtctcccctccgctccctcggaagcgcttctaagaaggtgggcagagggggggaggtttgctaccaacagctcatgaataattcatgagccccgcccttcgtcaggaagccccgcccctccggatcgcgctgacgcacgctgcgtttaccaaacttaaggaagcgacgtcacaggcccaacccctaagacggggggcggggcgccagtttcagcacgtgctgcctctacccgcgcaagcccaaaagggtgtgcgcaggcgctgcccactaggggggaggaaggaggcggggtggggaggttgttggatttagagccgggcggagaccgctgagactcattcctcaggaacaagggtcgggtgtcaaggagaccttttcacaccagctcccgtcccccgcctacggtgggtgggatcgcgcggcagagacaaaggagatcagtagggccggacatagctgcgcagggaagtagggtgtcagtttggggtggtgggcttttgcgggggctgtgggggggttatatttaaactcccagagccgttaagttggttcgtagtctgatgcgcgcgcaaccagggtggtggcggagtgcgcatgcgtggttcccgggcgaagggaacgcgcgctcaccgtgcgcgctcgcggccgggtggtagtggcggaggagaaaggggtcggcgcacgcgcggttgagtcctcgagtagttcgggtctcgcgggcctcttgttttggtctcgcgggctagtagggcgcacttggcggggaggcgcttgggcgcgagactaggcgtgaagagcagagctgcgcgcgcactcgggaaaggggggaagggagcagggtccaggcagggggggttaggccccctgatccccctcgttaccccgactggcacggaataaggggaggaaatgatcgagatggcggcggagaaggagccgtttctggtgccggccccgccgccgccgctcaaagatgagtcgggcggag

SEQ ID NO: 1308 - DNA, 920 bp, Homo sapiens
agagggaaagtgaaagaaggtggaagtaacccacagctgggagccctgaaccctgctggtggcaggtggctctcgtgtcctcaccaggttgccctgcaatcacatgctgcatcctttttcctgaacctgccccacgtgccccaccacgcagccactccgagggctccttcaagggcggcagccctgtcactcacgtgttccaaaagtgcttcccctgtgccctgacggcctcgccatgtgtcccatcatgccccacgcgctcccactgtgcgccccacctcgcacccgtgccccatcatgctctgcgtgctcgttaggtgccccatcatttcccgctcgctctcattacgtacccagcctccggcccctgtaagtgccccatcgtgctctctgtcgctccagttagatgccccatcctgccccgcgagctccaattacgtgccccacctaaccccccatgtccgtgccccatcatgccccgcacgctctggttacatgccccgcctggcgctcccgcacatgccccatcatgctcagcgcgctcccattacgtgccgccacctcgcgcccctgcaagtgcccaatgtgccctgtgtggtcccgttacgtgtcccatcatgttttgtgcgctccgattacgggccacacctggcaactcaccgtgcgacctctgtagttccagagctcgcgagggccagggccgttggcggcggttggaacgaaacgatgagtgcctcctcgtggccccagaatggaatgccgccgtcggtaggggtctgccgggcataaaggggccttcggaaccccaccagagtcacagccaggaagggcagcggggcgcaccaggccgaaggctcacgccacagggagggcagctaggacatggggggaagcgcgttaaaccagggagtcctggaagg

SEQ ID NO: 1309 - DNA, 947 bp, Homo sapiens
ctctgcagtggcagctttaatttaggttaaaaagaaaggggaaaaaaaggagtcaatcaaacagtacagccttggggctcccaaaaaagtagcacggggcattgaaacggaaacgcaaggaggcccattcaaaagaaggggccaggcgcggtggctcatgcctgtcatcccggcactttgggaggccgagacaggacgatcgttgaggccaggaattcgagaccagcctggccaacatagcgagacccccatctctaccaaaaaaaaaaaaaaaaaaaaccagcagggcgcgcctgtggtcccagttactcaggaggctgaggcgggaagatcgcttcagcccgggaggtcgaggctgcggtgagccgtgatcacaccattgcattacaacccgggcggtagagcgagaccctgtccgtaaaaaaataaaacagaagcaggagcggggccgcccatagagaccgcgcctggggctttctgggttaggggatcgacttgcacgttcacactgccaggccgggcagtggcttcccgcccctcggcctcgccgccgccccggccctgcagccgcggcccgggacccccacgacacgcggtgccgaggccggccgggctactggggacgcagccgcccggggaagcccgcgggtacccgcgctcaccaagccggcgccgcgcccggaagtggctctgcgtgcgccacgcgggcccgccccgtccgcgggttccgtccaccttccggaagtcagggccgcggcgcttctggtcccggagacttggggctcccgggcttctgagcggctcgggttccgcgctgccggcagggcttgggggcgccttagagccgaaccccgttttttcaggaaagggcgctgcgaccacccccgtcccgggcctcagcccctctgctgcagaccctcgggatcgtcgctggtaggagctctgtc

SEQ ID NO: 1310 - DNA, 856 bp, Homo sapiens
acataaaggtttgggtgagtccctggccggccggcacaaatgccggggtgggaccgcgaaccgggtgggaccgcaaaccgggtgggacacactcgttccggcccggggggactcgggccagcagccggccgccgcgcgtgcgcacttggcgcggggtgggggggaaggaggggcccgcgctcctacctgtaggtggccaacgccgggcgctgggccgccgctcctgccttgcacgttagagagccggtacatgcaggtgggaagctccacacggagaggcgcgccgcgcccgtgataaggttttacctggtacatcggcatggcggaaccaaagcaagagagggtggcgcgtgccaaacaccaacgctcagaaaccgtccgaggctacgactgggggcggacatctcccttgtgaccctgctgcggtcgttcgggaaaaaaaaaaaaagcagtccggtgtgctctgattggcccatgctctttgacgtcacggactcgacctttgacggagctaataggcgaaaaggagagacgggaagtattttttccgccccgcccagaaagggtggagcacaacgtcaaaagcagccaatgggagcccaggaggcggggcgcctgtgggagtcgtggagggaactttcccaggccccgaggcggatcgggtattgagtccatggagcgagctgagagctagaggtgagctgggctcgcggtctcccttctcgcgcgtcctccttgagaaccacggcgttccaacctccctggaaatggggggaacatggccgaggggcgtggcgaggcgtggaggccccggagcggcgtcctcagcgccccagccatccagtgctccttggtt

SEQ ID NO: 1311 - DNA, 960 bp, Homo sapiens
agaccctctgacttttggcttttaaaaattgtgccccactcgagtccccagatagaactacatttagcaaccgtctcctcctgacttcctggtactaaaagccacaaccacaagggctatttcgtgggtttgctgtaaaacaacatttgctccagtcaactcactggaaaatagactatctctactgagtacccgctgaggtgtgggtgctcacgatgtttaaaaacaaaaccacgtgtctacgcggcagcgacaccgcaggtgttacgtgccgggtttcttcccaggatggagaccggcgcgggctgggccgggaagcagcccctggcgggctgggccgggaagcagcccccggcgccccggcggaaggagaaaaggagaacggtaaaaatagccggcggccacggcccacgtgcagccgcgggagaaccgagcgcgggcgcgtggagaggggtccgtacctccaaacatgcgcggtgagaggtgagctggtaaggagccgatcaccaggcgcggcccgccggggctcccgcccaccggccggtgctggccgccgccgccgccatcctcagggctgctgtgcaccgagtcctgcgagtcctgcggaccgctgctgctgttcgggatgctgaaggaggactgcgccgcgcgggcccccgacgccacgccccccaggaaacagctgcgcggggctgccggggccaccgcggcgccgcccgaggcgctgggctggtgagcgctgggcacctgagccgggaacctccccgcggcggcggccccccggcccccagccctggtcccggtcccattggccactccgctgctactggaaggtagatccgagccgagtacgcgcgcgtgcgccgttagcggcggccaggccgctctgcctggcgctcctgtccgccctgctccggaccgggccgcgcgctgtgccccgagagccaagagggtaggagc

SEQ ID NO: 1312 - DNA, 1024 bp, Homo sapiens
gatgtggggctagttatgtccagcaggatggaggacaggtgtagtgcccaccccgtccccgcagagattgtgccgagtcctcagggtgcctggaagccccagagggcggggaacgccgcgctctagagccgctttgttctccgcggagactgcatcgatgcgggaagaaatggccgggacggtggggcttaggagggacacaggaccgaccccggaggacgccgagaaggacggctgcgcagccccgaggcggcgggctccagtccgcggtcccgggcccgccaggagcgcggcggcgcgcggtgcccgcccggccctccggttcagccccgccttacatcttcatggtgcccttgggccccaggttggtccttagcacgtcctgcagaccccgcgctgcgctgatgttgaccgccagcgccgcctgcgctcgggccacctcggccttggggttcagggtcttcaccgccgccatagctgctccagcggaggaaaaggaaacgatgctgagtgcccagagccggcgcggcgtggccgggaggaactatccgggtcttctggaaaagtcggcccgtctggccggcccccagcgtgcccgcgcgccgccgccattgggccacaggtcgtccggcgcccgctcattggtccgcggctgcacggctcctgcggtcccacccttcgcgcctcggccttgtcgtcatcgcgcacgggaggagcttgttcccggcattccgtgctccttggttccggcgttggagctctttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctgg

SEQ ID NO: 1313 - DNA, 1075 bp, Homo sapiens
gacagaatgcgaggttgattttctggagacaatcgccacccccttcctcgccctctctcctttctgtctcttcctggtttccccacctctcccctgttcttgcgttctcgtgtttctcacgccctgtgtcatggcctcctccgtcttctcctcctactctgtctctgtctcctgccggggcccggggtgcccgaccgcagccttgggccaccctgagtccctgcaggcggccctgaggccggggtggcttccgcatggggtctctgcccaaggccgttctctgctaaggaaggagcgtggccgcccggggagcccggagggctctagacccacggcgaccggacctggtgggcggaccccgcctccgcgtccccggcgggacaagcatggggcccccacggcctccgcgcccccggcgggacggatgccccgggccaccgcgggcagcgcgcgccccccacccactttccggcctcgctggattcccgggaccccctcacagacgaagcctgtctcgggggcggctttgggaggaaccgcaccggaggttcccctctcgctgcctctcagtctgggtttctgtggagcgcgtctccctgtccctgtccctgatctctccctgtccctgtccctgatctctccatgtcctgcccctccgtttcccctccggccagctcctcagcttgtctctgaccgcttccctccccagatcccgggaatccgagggtccctcaaagaccggcgtgctgcggcctgctctgagggcgcccgggcccctgggtccctcctctgaggaccgacgctcaggcagcgccgcttcttcctcccgcaggaggcgctgtaggactgagcggcagccgcggccgggcgccgggtcccagcatgcaccgcgcccggccggcgctgcgtttgggggccacccgggctgtgcgtgggagtcgggttggggcggagcggaggggagtcagtgcgcagcagggcaggttcctgcggagccgccggagacggtcgggtttgccagggccgggcgggaccgcggggaccatggcggagccgcctcgggtaagcgggctag

SEQ ID NO: 1314 - DNA, 1001 bp, Homo sapiens
atagcagacatacaacggacggtgggcccagacccaggctgtgtagacccagcccccccgccccgcagtgcctaggtcacccactaacgccccaggccttgtcttggctgggcgtgactgttaccctcaaaagcaggcagctccagggtaaaaggtgccctgccctgtagagcccaccttccttcccagggctgcggctgggtaggtttgtagccttcatcacgggccacctccagccactggaccgctggcccctgccctgtcctggggagtgtggtcctgcgacttctaagtggccgcaagccacctgactcccccaacaccacactctacctctcaagcccaggtctctccctagtgacccacccagcacatttagctagctgagccccacagccagaggtcctcaggccctgctttcagggcagttgctctgaagtcggcaagggggagtgactgcctggccactccatgccctccaagagctccttctgcaggagcgtacagaacccagggccctggcacccgtgcagaccctggcccaccccacctgggcgctcagtgcccaagagatgtccacacctaggatgtcccgcggtgggtggggggcccgagagacgggcaggccgggggcaggcctggccatgcggggccgaaccgggcactgcccagcgtggggcgcgggggccacggcgcgcgcccccagcccccgggcccagcaccccaaggcggccaacgccaaaactctccctcctcctcttcctcaatctcgctctcgctctttttttttttcgcaaaaggaggggagagggggtaaaaaaatgctgcactgtgcggcgaagccggtgagtgagcggcgcggggccaatcagcgtgcgccgttccgaaagttgccttttatggctcgagcggccgcggcggcgccctataaaacccagcggcgcgacgcgccaccaccgccgagaccgcgtccgccccgcgagcacagagcctcgcctttg

SEQ ID NO: 1315 - DNA, 993 bp, Homo sapiens
ggccacaaaaatggaagttagaaatgagtatgtctgctgcaaaatcacttttcttacttgcttcctttgtttatttctaccccctttcatttctttctcgttgtaaaactaagttgttagttttctctgaagaaactaaaattctttaaagattaagaatcttcactattgtatttgacatatatattaaagttcatgaagaataaattacagcttgggttttaaattttacttgtatagattaacatcaaattttaacattataaaagcaattctacagaggaacatttacattatgctacagtatcttcagttgtaccttcctgttcagcataaacatcatatgccaaagaggtactatattttgttgtatatttcctttgttgcttttttaagacattattattatgaatcaaatgtcagttgtttattttacttacattgaagcttttagttatagtgagttggactccaaatttataaagcagtagaatcatttgataaaagcagttggattagatcattcattcattaaatattaagttcctgttatgtgcctaagggtatggagagatgaaagggttagtagggaattatatttgaggataggctgtctctatgaaaataaaagcaattaccaattttaatttaaaaaacaatacaatatacatagataaacacttataaacaataataaaatataaacccataaacacccatgaacaacaaaatacacacccataagtaagtggatgggtggatggatgaatggatggatggatggatgaatgggtgtgtggacagagactgatagacacttaataaattaagattaatgttgtggttaatggtgtttcaatattatgttgtctaaaagtatgttaacttttttaaaaaattaaggttgacagatttgcaatggaattagaacaaagccgaaatttgagcaataccatagtgcacattgacatggatgctttctatgcagctgta

SEQ ID NO: 1316 - DNA, 908 bp, Homo sapiens
aataccattgtctggtggaatcctgtagtcccttagatagtgtaattttgtatttaatgtaaacattttgtgcactagactgacttacattttactttttaaaacaatattttaattctgaatgaacatttgcataataggagaatgatctaaattgcaaacttccattttgaagagttgtagttcttttaaatctttttgtaactgggaagaagaatggaattatgtttgttataatccaaggaaagttggttagcattctttcctgttactttttgatcccaaaagaaattctttagtagatcaagaccaggaatgaatgtgtggatttttttaaataaaaaattgagagagattgtaactagcaattcagagccagatttatgttcagaaatgtttgatgccagccgttttagttacaaataactttttcttgactgtacagttgtgttcttatggtaccattctgaaagtgatgtaagagaccatgtaaaatgattggaatgcctcagcatctgaacaatgcacatagccaattattaaaattacccagtactaacctgtcttggcttaggaactatggaattaactgtgggtagcatttctacacatatcattacagaacaagcataaagacaagcttgtttttttccttttctgtggatttgttttttcttattaccatatcttttgttactgaaaactggtggtcatctgtactaatagataagagaagtgtgtttgacaccaatacctaatcttagattatccctgctattttaaaacaccgtccttcacctgcatgctcagacatgtgggttctttcaaacatactggacttcctccttaggttttagttgtgttagttaatagttgaatgttgaaggagaggatgccaagggatatta

SEQ ID NO: 1317 - DNA, 959 bp, Homo sapiens
ttcagtgttggtcatgattttctgttttgatagaatagacacttaagaagtgtcagagttgatttgcctttaaataatttttctctttttttttcaccctacattctagaacttgtcacaaacaccagtgcttagagaactactaaaagaagtgaaaatgtctggaacaattgtaaaaattgaaccacctgatttggcattaacagtatgttctttaaacttttctagtctgtaactttcctctctgaatgtgtgttttctaaattattttaaataactgacactcatttccactgtttttgtttgttttgttttactttaggctactaacttaaacagtttcaggctaatagaagttataaggaggcattacatctgtttgctgtgtgtgtgctctgtttttctatgctcgagtgttaagcttccttcttgggaatgtgtatatgtttgagaagccttaggcttacattattatttttaacatctttaaggtgacttaagagctgtgtaaccaaataaatattaccttatccatttttattatttacattttgctttggctctttcaattcttaggtagtaagtgttccagataatctaaaactaaaatagtagagctgaattctgcataagacagtctgtgaccaaacagtttctatctcttttgatgtacattttaaacttttaaatggggcagttctgtcaggaacattggtagtatatgttaactaattagattttagtaaagtcagtgattccagaatttgactgaagaaagtaatttcttttcccatattcaggaaccattagaaataaaccttgagcctccaggccctcttactttagccatgagccagtttcttaatgagatgcaagagaccaaaaagggggttgtgacaccgaaagaactcttttctcaggtctgtaaaaagtgagtatccacttcgattgtgctttca

SEQ ID NO: 1318 - DNA, 845 bp, Homo sapiens
attggaaactaaggctcggaaagtgcaaacagcttgttcaggaatcagagacagaaagtgatgggaccagaatttcaaccccacctgtttcactctggatccaaagtcaagcttttggtaaaatatattggaccaaagagagaaagagagatagaacatcttttacaaataaaatggaagacttccatgcaagtgcatatagttagtaaagcttcctgaaaacatcaattcacatcacatattacatgtagaatattccagtcaatatttaagaaactaaataacattgtgttaaataaggagaaatgcctttaggcaaaagcaaattaagtacacctgctggatctgtagggaagatacaataaagcagtaaatgtctgtgaaaaatatgaaacagaaatctaagcttgcatgttttagattaagaaaatattagtgtagttttttatctaccaaatattttactaagagttaaagtaatactttataaagatgcttctcaatgtatacattttatgaacttgacacagtagggaacttctactgtgactagttggtgattgtatggagattagctgaaaaatttctaatacagtcatgcactgcataatatttaggtcaatgagaaactgcatatctgatggtggttcaatgggattatttataataccaagtttttactataccttttctatgtttagatacacaaatacttaccattgcattattatacaattgcctacaatattcaatacagtaacatgctgtacaagttggtagcctaggagcaatggtctgtactgcagagcctagttgtgtagaaggctacaccacctaggtttgtg

SEQ ID NO: 1319 - DNA, 1091 bp, Homo sapiens
atagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttaggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgc

SEQ ID NO: 1320 - DNA, 1053 bp, Homo sapiens
ttctcgtagtatgctttgtggtgataaagtttttgttttcttgctatgctcagtaatatttcttatggaattcattttttaaaactatttactacacaaaacatttaaataaaaatcctgtttttagagttgcaactcagtgtgtcattaaaatgtgtcttattttagttcagtctctcaataagagttagaaaaatggagcagagaaataagagcatacagaaaaattttatttcttgctaatcttcttttatttgagattttttgatgatgtatttataacatgtcctgtttatttttttaatttaaattttttttttttttttttttttgagacggagttttactctgtcacccaggctggagtgcagtgatgccatcttgccttactgcaacctcaacctcctgggttcaagtgattctcctgtctcagcctcccaagtagctgggattacagacacccaccaccatgcccagctaacttttgtatttttagtagagatgggattttaccatgttggccaggctggttttgaacccctgacctcatgtgatcagcccgctttggcctcccaaagtgctgtaattacagtcgtgagccactgtgcccggccctgcttattttcagtttggattttctgctgtcgatttttagctttaactttttttctttcttctttttttcttgctttccatgatttctttattcatgaaatgatttaaaaaggaagtaattgacattaagtattaaacaatgccctttataagaaaaatacttttagaaataagattaagggcatcgaatatattctttaataatgatgaatttattatttgaatatttttcttgaaattttaaaaaaggcacattgctgaattaatattttacatggaagaacttagagcacatgtgaggaaatacggacctgtaatgcagaggtattacgtgcagtacctttctggctttgatgctgttgtcctcaatgaactcgtgcaggtaaaaactatctcatactatttcccttttgttccttccttcccacctttgatagt

SEQ ID NO: 1321 - DNA, 926 bp, Homo sapiens
tctttcacattctccaccagtcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtatttatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttggggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaact

SEQ ID NO: 1322 - DNA, 1072 bp, Homo sapiens
aaaggcagataacagaaaagggcagttttatttctgtgacgttacatatacctaacactggtttcatacaacttgctccacaatgccttttaagtactaaacatattcagaggtcagggctagaagataacaaaatctatttaagagttagagctgagaagatttcagaagctttataaaggcatgccaggaaatgtctacaatatttcacagcttggaggaagcaggcaaaaagaaaatcaaaacaaagcttccaaatctttactttgcacggaggggaaacctatctcctgtgattgtagttgtattttgttgtataaattgacataagaatattcctgttgaatcgtgattttatccatggcagtgttttttcatgagttattttccttgtgtgtttgttgcagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgagttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatca

SEQ ID NO: 1323 - DNA, 1095 bp, Homo sapiens
gctgggagggtaaataccaaatcttggtatatcagaactgagcatgtcccttgaaggttaagaaatagttaatgggcaaatagagcatggcaatattttgtagagcagcaagtagtaggccttgaatagatgtcgctcaaaaagtaatatgtaagctgaacacaaaaatgtaacaaatgaatttagatacatatttgaatattaaattcaggttgtttgggagatgcacctagtctttgatggttaaacctttccctccatagaagagacagagacagaatggcttgctggactaatgtcccaattcaatagagtcttatctatgaaggttaaaaacaagaagagacatattatacagtagatatttattgtgtggctcatacacatggtgctcttctgattatggattttagagataataacagtgaacaagacatagtttctttcctcgagtagattaaagtcatacattgacttttaatggtgactggcattcttaatacatgattattatatattaggtaccatgtcagattaattataatactttactacttttaatttaacccttgaactatccctattgagtcagatatatttccttccattttctacttgtatctttcaagtttagcatatgctgatacatatgaagctctctccaggttttattgaaagaagaaattaataaatttattaatgtcactgaattaggcaactcactttcccaagattatgcaagtggtacaggtggaactcaaagccaagtttaactagttgttcaggagaatgttttctaccctccactaacccactactctgcagatggagataatatgatgaatggaacatagcaacatcttagttgattccggccaagtgttctctgttttatctactatgttagacagtttcttgccttgctgaaaacacatgacttctttttttcaggctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatgtgag

SEQ ID NO: 1324 - DNA, 932 bp, Homo sapiens
gaaatcatagtctgttgggggtgtgagacagatgaagagatattttagtaaaacgtagtacaattgtttactataattctagatgtgattggaatttgatctggaaaggtttcagggaggtgctaggacatgagcgaagccttatgttggtgggtaagattttacaccgatacattccgtatgaaagtggggtaaagccttgggctgagctgacttagctctgcaatggtgatggttcacattttcattgtgggaaggaaacaaaattagtaatttaaaagaccttttccaaacatgcttatcttaaaggaaggatctaaggaaaatatcaatacattttttaagcagatttttaaaataataaaggaagctagaaaatccagtgtcaataatctacctgtaggtaactgagagcatgttttctgtgctcagagaaaatgaaactactcaagaaatgtatatttgatataatggtataagtatataaaatgtatgccacaagctaacactaggtaaatttcaaagctacctttgctagatttaactggaaagcagaagaaataaatgataccagtatgtgaatattttaaagttgctgcttcaatatactagtcaaagtctgccagagctatttaccatctcaggacaatttgttcacttcacttagaaattagaaatgtgctctggccaatacatctaaatttattttgtggtagtcattttgcttaatggaagtgttttccagatgttgcctaagtctagtcgtctgggcccttttccaataaatgaggaaagtttgatttcataggttgtcactgttgattttgtctaacctttggactaattggttcatcccactgtatttgcactgatatataagactcccaggacgtgggataaactcatctatcctttacgggtaagtgtcaaag

SEQ ID NO: 1325 - DNA, 928 bp, Homo sapiens
tagaagtcaaaatgtgggggaaaaatggctgataatgattctaagagactcaaagatacattctgactttagagatgttaacatgaaaaaaagcatctcaaattaatgactctttggtacttgtaattgatagcttcttaaaatggaggaggactctagtaagagaagctatagtatctgtttataagtcagtatgctttagagcaatctgactttttcattataaaaatgtaggttttggactaggcattctggtgctaaaacagctgctgaggccagcgatcaccctgttctttgttcagttcctcacgttactcatataattaccgtgtgatcgtgtggtgctctgctgcttgttggtcagagcctgagtaaggctgaataaggctggatcatgaaccattctttaaagcagtggcctttgtattgcagtctagttgacatacatgcatacatacaggtgtgtgtgcacgtgtaactgaagaacagctttcacaaaataatatttagcacactgtggaattttctctgatacagcctcttctctttcatgataaaaataaattcgctgattatcacaccactttggaccttttaaaaataacacttaagaagttggaatagccagggatcagaaacttagaaatggaccttatttgttattgtaacttatagcaagtcattgtgtctcttattgggttcttttagccataataattgtgctagttcttttcttgctctgagtgcctgaacctgttgctaagtgaggaagaaaaatccatatgtaagtataaataaacaaatgtctttaatctttttgcaggtcatcatcagatttgaaatatttaaagtggatacaaaactatttcagcaatgcagacaattaagtgtgttgttgtgggcgatggtgctgttggtaaaacatgtc

SEQ ID NO: 1326 - DNA, 969 bp, Homo sapiens
gcagaggacaaacaaacacctctggcagcatttgttagaactatgatgcagtgcttgggttatcatcaatatgggttcttggctattccattttgtaaaaatgtgtcattacagaaagagtagtggtcttgggaatatgaagactcaggttcaagcctagttctgtcatgacctagctgtatgatcttggtgaagtcacttatcctctatttttttattttttttttttatttttctttttttggtttctttgactgcaagagagaagtgtggtagagagtctttgggtgtacctcttcccctgcttctcacccagttctctaaattgtgagtccatgattgcttggccgtctccaaaaaagaagtactttgcttaaccttttaggctatatttttaagggtaatgatcatgtgtttacagtgagttgtaaaaatgctgtcattgccagtgttcagtcataaaatttggtgaaaatctatggttttaaatagcccaaacaatgggagttaacaaattgggcactaacattttaactttttctcgtgtttcaatatgtggaatttcttgcttagaagctggctctttccaagtatattgtttcatacaaacttggagtttcttgtttgattttctatttgacctttgattgctgctgttttcctactaagtgtttggccaaaagtgagagggccagtacagataaagcaaatagtgtttcatggggttaataattaataaactgaactgtcatcagaaaacccgcggatccagttcattataatgtcatgatgacaacattttgtgagagaagtctgtataaaaagcaattgctcttttgtttccaaaacaggtattacaagtggataaataatgtgcactgctctgagcccaaaggtacgcagtggacctggcctctctgatatgcatcagtatagccaatggctagccagcagacatgaagctaattt

SEQ ID NO: 1327 - DNA, 900 bp, Homo sapiens
ttgtttttagctttgcctttggaatttaaaatgttcaaaatgatttgtctggatgagaatcgattttcataacttttgctttgatacactaaacagtttgagtttctagatgatgcccattttaattcatacgaggaaatatcttctagtatagtttctgcttgattaattctatgtttgtctcttagggacatctattaattttataatgctgcctttttttcagacttctgtttcagaatattcgctttcatcaatgtaatccttggctatagtaggaatgaaataataaaagcagtagcttctgtctgccctccttggttatgcagtccttacagaacatctccccatctcccatccccccaccccagctcagtgaaactctccacactttggttgtggaaattggcagggttaggtggctactcactcccaatccacatccacaataaatcactttttattatcttatcaaaatctgtagaatgcctctttattctattttgttgctgcggaggtttgttttctctttctaattattttattttctaggttttttgagggaatttcaagaggggagattttttattcaggctcatcttaacgtcatgtctggaactcaagctactgaattatatattctttaatacatatagacctacgtcaatgagtttaaactgcaaggaaagggttaaatttcttcctcaagtgtggtcaaaatctgtagagaaaagaggaacagcttctcttaaagaaagttagctgggtaggtatacagtcattgccgaggaaggcttgcacagggtgaaagctttgcttctctgctgctgtaacagggactagcacagacacacggatgagtggggtcatttccagatattaggtcacagcagaagcagc

SEQ ID NO: 1328 - DNA, 1006 bp, Homo sapiens
taaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatg

SEQ ID NO: 1329 - DNA, 1065 bp, Homo sapiens
gcaaaaccaaaaacagcaaaaactgtaagacataaagaatagagtggagccgactgagagattaaaataaactagaatatttttattaacaggcaatttgaaataatttgtgcacttcagaatattctacaataatatattatttccaattttaatatctttaagaaaattactatattatatgtaagtacatgtgcatgtgtttgaggtaggatatttaactcaataaaggttattttcttttattcgggtcaggcaaagcttctaaggggatgtgaaagggatatctctttctcttagctgagaggaagagtgagttctaagttaaatataatcaaggaatttccctgtctttgctatttgagattgtgaccacaacaggcggttggctgaaagggaaactgaagggcggggagggagggaaatagatgaaaaaacaaaacaaaacaaaacttccctaagcagctctacaaaacattttagccccagaaatagtcacagaaatcctcaaatcaaaccagtatccagatacaaggaagtgttatgtagctggagcagggtggacactcatcagctcagttcagttacaaaagtccaggctgctgaaattaaactctgatgccattcatgccagcatccaatcacgacagagatcagaagttcagagatgcctccagctccaaattgccaacaacaagtgtggctactatacgtcaaggactctgaagccgtgagagagggggaagaacaacagtagagaggatgcccagctggtaagaatcgagtgtttatgaagttttagtcaattgatgaatctcattggctaaaatcaagaaacgctccgcctctttgcaaatatgtatgaaggagagaagtgcctaaacttctatgtctgatagcatttgaccctattgcttttagcctcccggctttatatctatatatacacaggtatatgtgtatattttatataattgttctccgttcgttgatatcaaagacagttgaaggaaatgaattttgaaacttcacggtgtgccaccctacagtactgccctgaccctt

SEQ ID NO: 1330 - DNA, 1042 bp, Homo sapiens
tttggaggtttaagagcttgctgagtttaagaaaacaaaccaaataatttgaagtccagctacctatttgataacctcattttttattccttctgtgttttcaaaagaaaaatcctttgtctctaagaaacggaaatgactcccataaggtcaaaatacagtctgtaatattttcattgtctacctttatgtcttgaattattcatccttcatttatcactagtggatgctctcagaactttatgctaatctagatttgtgcaaatttagcaaatcccagaaaagcaaaaagacattcaaggagaaatctctaatgactgtaagttctgattcttagtggctgcaggggataatttcttctcttcccaggattgttactctgaaagtgaaccaagagagtcagaatttctaggataaggcaggtccatgtgagataaacttccatctgtaagggaggtaggagtgagctggggatctacctggaatgcgcacaatttctggatacacgaattaagccagaaggcattaattctctggtatctgttcaccagtggagactgctacatcttatttcccaattagtttccattccagttgttcgtataaacctctattatataacatcgtggtcttattaaataaataataaacaagaataaaaagagtaccaaagtgtaacccatgctaaaaaaaatcctgttgtaaattcactcaaaaagcaaataatcttttcctttgtgaaattggttcctaatatattgggtctgcatgttgattattttatgtggagttttcttacaatgaaacacatctactctaccactcactgttttctccttacactttgtagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatggg

SEQ ID NO: 1331 - DNA, 785 bp, Homo sapiens
caggtggaggacaaagagacagtgtaactacgtgctctgctgtgagtgaactgattaacagatgcacagggaccaaccactggaagaatttgaaacaagtaacacgactggtcactgatcatgaagcatatctgttatttacatcgtgatttgtagactgaagaactagcagagaagtttgtacttcctgtaattactcagagttatactgtgctacctaaaattttaacctaggtttaaacaacaccagtttccttaccagtttcctttccttcctggtaaggaaactggtatttaaactaaatctaggtcactgaaatttgtgccatgggaaccgtgcacattgaggacctgcctacaccctacatgtttatattggtccaggcaggcttaatgctgactactgagaaataggctatctgaatttatatcaaatagtgaatcttaaagcacccaagatgaaaaattcgtgcacattgaggtgcttttaaaatctttgtcatttgacaatcaagcttaaaatgtatcttagagtaaccgaattttagaaataaagacctttaaaggccccatagtttgataccacagattatccagcatgtttataatgaattatttctcctccttcaatttcagtttgctcatactttgtgacttgcggtcacagtggcattcagctccacacttggtagaaccacaggcacgacaagcatagaaacatcctaaacaatcttcatcgaggcatcgaggtccatcccaataaaaatcaggagaccctggctatc

SEQ ID NO: 1332 - DNA, 1009 bp, Homo sapiens
agacttggttctgctgattcctgaatcatcctgcaaacccatcctccccctcctcaccttccatgtttaacacccagctctgtctggatcacttgcctgcttacagagagcaggccctctagagcctcttcaaccaccctttcaggctcatcgtccactatccctcactaatctcagtttccatccccaggactttttttctctaccaagaatgccctctctcccaacataattatctgaatcccacctacctttcaaagtccaactcaaatagtatcccctccttaaaaggatgttctgccctgctaaacatgcttcttcctcctgaatgtgcctcctgaactcttctcctgattaaacatacacagctaccttgaattgtggtaattggctgcctctttattgctttcctactgaattataaacccttgcctttgaatattttgtttttaatcctatatagttttatgcactgttggcaacaaaaatatatttccttaataaatcaataaaaaaaggtctaaaaaagcaacaaatttaaaagttccacgacttattttttcaagtttaatctgtaacaagcagattttgacttaatctcacagctgggtttttaagaagtcaaatttcattggtatgccccagataacaccctcactccttccttttctctttccctctcagactctctgcagaatgagagcctcatctcaaattgtctctgcccatacaaacacagaacttttgatagttttattgtttatacttatagacctgaccaagcaagctcctcaagatagggttgttaaagggctacagccaacctgattctctacatctgaaacaataattacagagctcttctggaataatcaaatcataaaactctacctcgtaggatggaacagaaacattggctcagctaaagagtgggtgttttccttagattgtggaatcatggctgatggttaggaccttaaatatatcgaggtggctaattgatgtataa

SEQ ID NO: 1333 - DNA, 922 bp, Homo sapiens
actgggtcatgacaccctctaaaaagataccagttctcattagtgaacacacttgtctatttcctgtatcctgctgaaatttattttcagtgttgtacaattattacaacttggcctacctttctcctctttttaggaaaatctctgaaggaaatggaaacaccgttgtcagcacttggaatacaagatggttgccgggtcatgttaattgggaaaaaggtaaattgctttttccatcagaaatcctcagaatcaaatgactgaagtcttttatacatgtttctgtttagaagaccaaactggggacccagattctgcattgataaaacacctctctaaacaaatacaatctttattggttttacaggattaccagttttgttgttctcataccctcctgctcctgttggttagaacttttgctctaggaattaggagcggttgtgctgccttaataatatgttttttgttttggtggtggaatcttggtctggttaaaatggtgcctgggacaggtctcattcacttggagtagaatttgcaagagtcttttgttaaaataaacttgtagatattaagaataatcactctgttccagttcaggagcctctctccctttaaccaaccttttaactaaaatctcccacaagggaaaaccttcgactggaaaggaaggttcagactaaagaactgaggggaaaaaaagacagatgaggtcagcaacccttaaggtgatgagagagggctgtggccagccctgcattgtgacacagcagaattatgagcatatgaagttcccttattgtgagttaggtggctgagtagagagagggcagataaacaaagtgaaggcaaaaaaaatctaatccagacttggaactgccaggagactggaactcaggacttgccacaaagagaagtg

SEQ ID NO: 1334 - DNA, 1011 bp, Homo sapiens
gcctagctctattctgggcactaatggtgttcacagactcagtgactacgagttctggttgttacttcacatttcagttcacctacagaagggtagatttcagaatctgatcagaccttagagaggacttagctcagtaccttgtttgtttctacttagtgacaagtgtgaagtccagatgttggacagctaacttgaagttaagacaggcactccaggtctgtgattttcagtccggtgttcctccagtgcacctcaggtcttcctgtgggatttacgacattgctgacagagtcgcatggtcacctgttaccctgtatattattagtacagaaatgacttattttctttctggaaacaccactctcattcttttttctattcctgctaactcaaaataatagtagctgcttttggaagatactgacattttgctgattcaccagcctggctcctgccggggagaagactgacacaaaaaacgctgctcgacatcggcatatttgggaaaggcaagggcacagatgttccaagttgttaagttctggtctttaaaaagggaaaaaacacatccccctataataactttgacagattgccatttccctcctgttttctgagagctaaactgttttttttttcctcttgtatgccaacctgcacccaactgccctaatgatattttttaaaatctgatgtttaattatgtcttacatcaaatttaaagtgcatttgaaattttttaaattaccttaattttaattagaggcagcaaataggggtaaatgtcatcctcctcaaagtacgatttttcttgaaagtgatttcaggaaagggcaggtcctcttgacttgcatctaccatatcctctgttggtcgtaatgttgctctccctgcaacattgcactctgctgcttgtcttatctgtgatctataatagaaatttttcttcaggaaacggttgttaacaatttactgttgtacagctgtaactgcccaaaacaccttagc

SEQ ID NO: 1335 - DNA, 871 bp, Homo sapiens
aaccatccaaatttcctcatcctaagcttcatctccagcaagcctcagtcaaggagacccacaccacaaggctatgacataattcttggttgcctgccaaaatagagaaaaaaggatgaaaaggaagagtttttattgcaaaaagacagcttagggaattttttcttaacttagtgagatggaatcctgagacaaagatttgttagagataacttgtgtaggggtattaaactcaacagagataaagggagatgggtgagtaataagaaaaataaattaacccttggtgttttcttcaggcaatgctgaaaacacacacacacacacacacacacacacacacacacacacacacacacaaaaaaaaaaaaaaaaaaaaaaaaaaaaaaaaaaaaccttatgcccaccacatcatcatttgtatcttaagtaaatgcttggggaaaggggttgagccaggaaggaagaacaggtgttgtacatcgaaccaagcctaaatatttggtatggaacagttgaagatttaagattgtaactccagaacttctgatcactttttttgtattgttaagggtagcaactgagattagataactcacttgctgaaggaagcacattcttggctctgtgcgacattcactgtgccatgagctgctagtgcttactgatacccatgtgctctttggcatttcccagtctcccttgcacttgagctgaccatgtgactatttctgaccaatggactgagagtagaagtaatgtggtcacttctgagggaggtagttaagtatcaagtgtgactcccctcaactcttcgactccttcctgcacccctgcagctggaagaggaggcttggagatggtagaaaca

SEQ ID NO: 1336 - DNA, 823 bp, Homo sapiens
tttttgacaagtaaatgtggggggccggtggggagataactatctccttcacattgaatataagcttcatgaactatcaagataatttttctctatcttattttaatgagttactttaagcttgtctttcccattgcacccatggcatcctaattattttttcttaggaaacagcagcccacgaataattttattttagcaaaaatgaaagattataggaaaacctgtgtgtgttttgtagttgtcccctggtatctgcgggaaattggttccagtccccccatggatacccaaatcctccgatattcaagggcctgataaaaaaatggcgtagtgggctgcgtgaggtggctcacacctgtcattccagtgctttgggaggccatggcaggtggatcacttgagctcaggagtttgagaccagcctgggcaacatggcaaatccccgtatctataaaaaatacaaaaaattacctgggggcagtggtgtgcacctgtagtcccagctactcaggaggctgaggcaggagaagtgcttgagcctgagaggcagaggttacagtgacctgagattgcaccattacaccccatactgggtgacaggagtgaaaccctgtctcaaaaaaattatttaaaaagcatagtatttgcatataacctacatacatcctcccatatgctttaagtcatttctagattacttataatacctaatacaatgtaaatgctatatacatagttgttatactgcattttttttaagttgtattttttattgtaatgctgtttgttttgttttgagacggagtttcactcttgttgc

SEQ ID NO: 1337 - DNA, 1067 bp, Homo sapiens
acatggctaaagagaatcctcccatgaattctccttgccaaataaccgtgaaaggactcagtaatttgggaaacacatgtttcttcaatgcagttatgcaggtacattgtcatttttttccctttaaaaaagctgtccttttcctcatagaatctgctacttacattattgagttttttccacctgagtaatttatttctatgtatccaaagaaaactttttttttttttttttttttttttgagacagggtctcactctgtcactcggctggagtgcagtggcacgatcgtggctcactgcagcctctacctcttgggctcaagcagtcctcctaccttagcctccagagtagctgggactacaggcatgcgccaccactcccagctagtttttgtatcttttgtagagacagggtttcgccatgttgcctaggctagtcttgaactcctgggcttaagccgtccaccccctttggccacccaaagtgtttggattacaggcgtgagccaccatgcctggccaaagaaaacttaaggaaagttttattgcatgacagtaagagagtttggtgagcactcgggtgcagtgggtttgaaagaaatattgctgcttctttcatggagcttgcacttgggtggaggaaacacaggataacctcatatagaagcaaatacgtacctacaggtagtggtaagtggttgtgagagagtcatggtggaggattggggatagctacttctgattgggtggtgggagaatgccccactgaggtgatgaataagctcagaactgaagtagttatgacccaaatagagtagggagagaagcatctgtaacttttcattttccaagtatagagttttcagtgttggtcatgattttctgttttgatagaatagacacttaagaagtgtcagagttgatttgcctttaaataatttttctctttttttttcaccctacattctagaacttgtcacaaacaccagtgcttagagaactactaaaagaagtgaaaatgtctggaacaattgtaaaaattgaaccacctgatttggcattaac

SEQ ID NO: 1338 - DNA, 974 bp, Homo sapiens
gttgtcacagaaacttgcagcacaaggagtgaaactcctctggggaaagggaagctgaggcttggaggatgggtgggatcccgtcaggtgaaagggaggcaagaagagctctctgtcctcctgggtttctggtaatatcacctacaatgcttttttccccaaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaa

SEQ ID NO: 1339 - DNA, 903 bp, Homo sapiens
aatgttcctcaaaagaaagccatccaggatgggtgggtggctcacagctgtaatcccagcagtttgggaggccaacgtgagtgaattgcttgagtgcagaatatcaaaaacagcctaggaaacatagggagaccttgtctttacaaacataaaaatattatccagccgtggtagcatgtgcttgtgttcccagctacttgggaggcagagctgagaggatcatctgagcctagggaggtggaggctgctgtgagccctgttagtgccactgcactccagcctgtgtgacagaataaaattctgtatcagaaaaaaaaatctgaaaaggaaggacattaaataggaaaagctttaatttttgtgaaaaatgtgttcatttcttgaagtaaaattgtttcacagggacatacatttcccatgactttccctagactgtgaaatgggcccaggagagcagtggttcaaattctctaaaggttgtgttacttttctccatcaagctttctaacgaatgagaaattcttcactatgagtttaattgtacacatactttgtcattcttgtcttattctccaagccccattcccctcctaccctgacttgttcaaagggctggtgaagaaaatttcccaaagatacactctctgttgcagcctacagttcaggaatctgaatcttactctattaaaaaaatgaaaaaataaaaaaagacatgcatatgcatgtgcagtggtttcccaatatgtgtacatgccctgccaaaatgtataaaaggaaggtaaaaagaaaggtggtgcatgctttcagtttcagcttacacaagaagggaggagagaaaagccatggccggtgagtcttttactgtcccaaaaacaggcccctgggaggaaaaagttgtggaag

SEQ ID NO: 1340 - DNA, 1013 bp, Homo sapiens
ccagctgagtgcctgagagttatcattcacctcagtgggggtaggggcggagaagggtgacatatagccagccacatctatatccactggcccttccttgtcctagtcctctgtattcctgagaaggaactattctcaaggacctgagtccaagttcatcttacttagagtacagagaaaagaaccgctaactccttctctctttcccccatcatgtctcctctcctttctagttctcatcactctctactcccccctgccccccttttctccatctccatcacctttgtccagtctctatccccattttcaattccttcctcaaaacaccaagttgcttggtagcatgcagggttggaacatgcctttaacagaaaatctcgtgtctcttgaacctagttatttattccttgagcagagtagatattcaacaaaagaattgttaaattcaattaaataggatatatcttattattaaatatttttttcattttttgtttacttatatgatgggaacttgagtagtttccggaattgtctccacaacacctggccaaggaatctgtgaggaaaagaaagatcaaatggaaaatcaaggtacatgacaccagaagacctacatgttacttcaaactttttcttcctcatgaaccattaaaatagagcataactcttctggcagctgtacatatgttcataaatacatgatattgacccatagcatagcagctctgctcagcttctaacaagtaagaatgaaaagaggacatggtctttaggaacatgaatttctgcccttcccattttccttcagaaggagagattcttctatgacctcattgggggcggaaattttaaccaaaatggtgtcacccctgaacccactgcgacacgccacgtaagtgaccacagaaggagaaaagccctataaaaagagagacgatagcgctacattttgtccatctcatagcaggcacaaactcatccatccccagttgattggaagaaacaac

SEQ ID NO: 1341 - DNA, 1027 bp, Homo sapiens
aaagcacacaaaaagcaaggacttgatcttttttttttttttttgtataacaccaatgtcaattctagcctgtcagggcaaattcagtaattaatagctgttgatgagccagtcattctagattgattttttaaataagcaggctaataaatgagaattgacataaatttagggatgtctcttttcagagcaagtgttaaggtgattttcatagtcttctgtattccctatgcatccagtaggtgtgatggtaaatgatttggctttagcatagagaatgtggcagctgattaaaaaaaaaaaattccagtgcatctatcttaatgagagaacttgagttgtctgaagaaatagagaggtcagaggaggcctagtgggaaaaaagaacaatgagcctggttagaactgacaaaaattcaccctaatgatttgactggctaatgatgactgggcaagttccctgagtccactgacccagatgttctaatttgtaaatgcaaagtgacttatttatcagcctcctggggaaatcttcagagctgtgaacctgctatgttcagtaatcttgctggccccagccccagcctgttctcagatgaaattttagaaactggccactggaactttttgggtaagggctctggaggtggccaagttaccagtagtgggggaatgaggtttacctgcccccagtaatcagcacttgatttaaaacaatcagtgagctgcctcttctttcctaggttgcagttgactgcggttggttcaggctgagttgtttgggaagtacaaattttgcccagcgtgagtcagcactgccctgggtaaactccctgctgtgttgcaatcttgcttaccaaagatacatccccaggcggcaccattcacttcacatgaaagccgctgctcttggttcctgagatgatctcatctgaacatggctccagcgacctcagccacaggaactagagacagcttgctttctgtcgtggcaatgttttgaaactggcaaaatcaggtaacctca

SEQ ID NO: 1342 - DNA, 1076 bp, Homo sapiens
ctctcgtgtaccccatcattttcggtgcagtcaaagctagcgaacatttctgtggcctggtaaatattttctaactattggcaaggctttttaaatttttttttccagtgccattttgctccaggccaggattataatgacccagctttgctttggtttcagatgaattttgcaaatatatgtgtgtggtgggattacactattttcagagaacacagtcatgcgggtaacagggtctgatgcaatatagtgctgcatatgcccaatcaggccgacgaggcttaccctttgcagactgtgccaataagcagtcgaggcttgttgcgatctgcagaaatctacagaattctctgtttccgagaaggcttgttgctagcatatgacatcatagaaagcctttttttttttctgacattttttctgctttgctttagaatatcaaaggcaaagactgttgaacatagttggccacttagctttattattcatagtgctccctcccatgtttttttttttttttttttaacagtgttcaatgttagcgtcaggtgttggctgccttcctgggggaacagattgctgtgaagtaaacacagctggaaactgaccacatattgtttttctttcttttaagaaatcaaagaggcatttatagaaaagctgcagaacatggtactgtccagatttatagatttattcctccaagtctggttaatgattaatgtcacgcctgggtgtccacatagacccacttcccttctcccttcctgaagctgcaatttcctcggaacaatgagcttgcagaggtttgctgcaatccgaacttgaggagggggtggagtctgttcagttctgtttctccttgccgaagtgtggtctttggagctaagtgaagaatgacttctgttaggttttcctctgctggtcttccttgcagcctcgaaaacctcaccagagtcgcctctgctggtctcttactgtgctgctctgtcagagatgggcaagtaagcgaactgcagagtgttgctgtgtgtgcttgtgatttgtattttatttgatgtaaacgtgaaggcaga

SEQ ID NO: 1343 - DNA, 920 bp, Homo sapiens
cggcctcaggatgtatcttaaactcattatttttgatgcttgccctgcagctgagtaaatacctctttaggatatgtgacaattgaactggcttggattttggaacatgtcctggccttggagcctgcttatgttcatacacactggttccttagaaatgtaaatttgtaaagtcaatgtaaaactgaaacttcaaaagtcaattttcattgctgctgttgtgcatttctattatcaaattttatttacagtgatttacgtgagtaaaaaatggattacacgatttcctaacatctcactaagtatgggtttggatcttaagtaatttacatttttcttttccaagttgattgttatactgggctaatgatttccttcaaattccactaataaatcacagattctcagtgctgttattccattgctttattattaaatggcacccttttctagtttttgtttttgcaaaccagtggagtatttaaagtaaaatttcagaatcccttttggagctttcggttgagaccaggctccttggaaccctagtgctttgggagttctgctgctgctgcagtaccaaaagtagcttctttgaatttcatttgggttttgtagggctcccccgaggcccgagaactgggagaagggaaagagctcatcggtttgtttgaaggccggcgggcggtgcaggcagcttttcccagactctcccagctccggcttttcacgcataccagaagagccgcttttttcctccagtgattgaaaccatctggactccaggggggtcacgtgtgtatgagaaaatgacataaagtttcagaccccgttgtgctttgctccagacccagacaactcttggtcggatggtgaggaggtgagggccgtccagtttgggggccaacttctcctccctgctg

SEQ ID NO: 1344 - DNA, 1081 bp, Homo sapiens
tcctgtacctgggtaacgaacattctgggcaaaatatattgtgaaccatgctgatgttctttcgccacaaaacataagtgatagcctctctatcaagagacctagatttcctagtgtctggtcctgggctgttttcccatggccccgctggttctcttcctctattcctagaaaagtatagaaaatggagctctctttgcttgccattgagctcatgtcctgccaacttctacccaagtgacaggtaggtcagtaaagttacaggctgagaaattaaaattatttgccaaacactagttttatgattatctattaacaacagccacaacaaatcaagaaggagtcccagtgtatttcaattagcttctagctcaagtgatacatgagtagtatggctagaataggcattgtagaagtatgaatggagaactgtctcttgttttctgtccatctttattgttattgctggatattaaatgctgtaatttttggcataggtttttttccaaagactggtctcttgggtcaagttttcctgaacttgcctggtattgggcaagttcacacagaaaatatgagtcatttcacaaagtcctgggcttgtctatctacttgaaggaataggaaatggacttcacttggagcatgatggatgaggcttgggcttttactaatgaaataagtttcaatcttaactcagttaaacctttaaagacaggagaaaactatctggggatggattcaggccagtgagatcacgttgcacaaatctccccttaagggatctttactgacctagaattgtttcaaaataagattccaaactgtcgagggagtttgaagccttgaaacttggtgtaggtttgcttaaaacaaaataacgaatatactacatttcccaggaggcttcgcggtgagcctccgcactcggctggttctctttaccgcgaggaaagctgggaaatgtagtgccacaggcaaccctgcacgtgacgcttgcggaggaaggggagagagaggcgcgcgggagggcgtctagggaatcgaggtgccggctgctccttcctcacaatttggtttg

SEQ ID NO: 1345 - DNA, 1057 bp, Homo sapiens
cggtttcccaaaatgtagtcaagctattaatttttagttcatttatcatgttttagcctctaagggccctttcttgttatcttttctacattagcctgttctttgtcttatggatccaatattcgatctctccagcaatattgtaggggttgtcttattttgtttgttggttggttagttttttagtttagttttattttctcaattgtctgtttccttttaagttccttttccctcatggtttgttttggcctctctcttatattggagactttcctaaaatgggtggtcatccaaccatatttaagaatgaggcaccaaagctggacatagtggtgcatgcctgtagttctagctacttgagagactgaggtgggaggatcgcttgagctcaggagttggaggctgcagcaagctatgattgcaccactgcattccagcgacagagcgagatcctgtctctaaaaaaaagtaataaaataaaataatttaaaaataagaatgaggcacttaaaagctaatcagaagctcaggttggggagttttctaaatggtgagtgtggtaggaaacctgaaaggtagcacccagtgatcctcacctcctggtattcatgcctgtgcaacaaaaggattaaccttgccccaagaagtatctggcctttactctcactttctgggaggtaatctctaaactcttggaatgttctttgtttacctgggggccttgggccatgccagatggtctatgctaactatgtgatatatggtaggggctctgaaccatgcattgtcagctcaacctcaggagggggttggacatgaaggccagccacacaggcagtcagccacgtctacatgaccaataaaaattctggacaccaaggcttggaggtgcttccctggctgggaatattgcatgtgtattatcacacattgttactgtgagaagaatagctccactgggagaggacaactagatgctctgcatttaaaactctcctggggcacagcagctgcacatcctggggctcctgacctctttgcgtttgcagtgtag

SEQ ID NO: 1346 - DNA, 909 bp, Homo sapiens
ggtcttggagggttagttgctttgctcacaaagtaaccactaccctctcaccaaaagagttctgaagttatcaggatgttgtgagactgctccctgggagcgagtctggaagagtttgggttgagagtatttgttactctagaggaaaaggtattactagatgtgataactaccttgtgtgtgaggagacgctgggaaagtaaaatatctgcgaattagaatctctacatccatatgcgcttgtaaagaatcaggattccagctgggatattgacagataggggagcactattgacctcagtaagcaaatgatggaaagaaaaagcagtgtctatattaatcttcaccttgtggtcccagtgaagcgtaaccacatggacctgcatgaatgttttctagaaggaagaaaaatgtcagagaagctcattcgctaatcatcatcatcctctgttgtgaataaaacagcaaacaaaactgcgtttttggctcatatctgtaattccaactacttgggaggctgaggcaggaggcctcagcttcaggccaggagtttgagaccagcctgaacaacatagtgggacctcatctctaacaacaacaacaacaaaaaaattagccaggcatgatggtgcacacctgttgtcccaggtactcagggggctgaggcacagagattgcttgagcccaggagttaaaggctgcagtgacctctgatcatgccaccacactccaacctgggtgacggattaagaccccatctctaaaaaacaaacaaacaacagcaaaatgctgttcttggttctaaagagcttatttgctgcagatgatctggtaaacctgaagcaaatatagaaacctatagggcctgacttcctacataaagtaaggagggtaaaaatggaggctaga

SEQ ID NO: 1347 - DNA, 990 bp, Homo sapiens
ccccaagaaaaagaaaagatgctcctgttaaatgaaggctctttaggggtaggtgctaggtatactcttggctagattgattcagctcagaattttgactttttaaagctaagtccttgtagtcacatggttgacttgaaggatgaggtggtgtgtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatctcatttagttgttttagagttggtggcattcagaatagtccctcttgagaaagaattgtaaccagattccctttaaaaatgagttcccctccctttccccccaaaggactcatcctgaagcagaaggtgtggggggaaggagaaatgtaaaggcttttactttgcataaggatgggggactggggaaaaaggtgaagcgaagcccaaggacaccatgctaagggcaaaagtaagagacagtctcagaactgagagaattgtgtcttctgctttttgaagtagactgtcacactcaggcagcctgtcaatgctgaatgttaggacttctgtctccgctggagacacggcctggtgcaagtcagcgtttagtgtttgacagctttctcagcactccctgactccgtttacctttactccgcatcccattctcttactgcctatctgaaggattggatgggcagagtataggtggcggtggttggtcctccccgtatgttgtccatttaattccagagcactgatttttccgaagtgtgctctgccctgggaaaatggacacatgttcctcacaatgggaataactaattacttcttttcttacagaaaaagttggtgattcaaggaaagcacattgcaatgcattatagcaatcccagacctaagtttgaagattggctttgtaacaagg

SEQ ID NO: 1348 - DNA, 1004 bp, Homo sapiens
aatgaaccaagctttctgctgagttacctgaatattacaaagaagcaaaaattattactgtagaggaacaattaccctgcttggaatgcagagattatgtcagcatacaaaattgattgcttgatcaatctggagtagaatagctcatgaagcatagctatacttaataatatagcaaagcagaggggcctgagagggtcttactgcttaatctctgtccatcatgtcttagacctacagacaacttgagttcaatgattatgatgcccctcacctcagggatctgtttccatccagcttccaaagatgggcatacaccagcacaagcatagaaaaataacaaatctgtatattggaccctctgcttagcagtgagaaagcaggtttgaagacaataaagccaggcctgtatgtggagattggcaccatgaccctggattatgttttatgggatatgcctccaagggcaactctgcatttatcccatggcctctggcttccaaattttctaggcacttccctctggggtaaaggaatcaaaattggcttatttcccttgcaaaccatccttggcgactaagtactgccttgtcttctactgagagatggccatatttttggcacctgcctttccttgtgggaggtgtttcctctgtttacatagcaaaggggctgtaggagagacagacggagctggacttacagcagaaccaagtcatgatagcctgtttctattttgttttcagcatttttccgccagttctggccacctcctttcctctggaacatgctgatttcagcaagtccagctctgtcagctctgccccccgagtctattggtttctgatcatctgataatgctttgcctgcactcaggacctgtctttgtccctcctcttaacatacttgcagctaaaactaaatattgctgcttggggacctccttctagccttaaatttcagctcatcaccttcacctgccttggtcatggctctgctattct

SEQ ID NO: 1349 - DNA, 803 bp, Homo sapiens
tctatccaacccctcaatctgaacaagtgatcctacttaaagaaaattagatgcttcaaattttagcaatcctaagtatgaaggttttcttaacacttgaataatataaaacaaaatgtcaaataataataataaacataccaccatgcattccgatgttgctctagagtttcctcagcactttgccctcgtgtctcctgtgacactaaatggaacaggcaggcattcaagtttgagtccaacacagcgttaataatagcgaatgtttacagtgccttgggttatgggtgtcaaagaaggggtcatgcccttgttacttaaatcacaaacaaggcttacatcagctcatggctgcagggtacaaaatgaggtgcaatttaatgtccatctgggcatctgttcctaaggtgctagcactgctgtctgtggttcacaatatatctggggtagcaacacagcaaagaatgggacccaggttgtgcttgggaagtttctactctcagccaagatgtgcacatgaatttaaaattacctaagagggtgtttcagagttgctggccaaagagtggtgtcttctaatctggagagcagctgctgggcacaggcatgcaaacacacatacacagacacacacacacacacacagacgtgctcacggagcctgtgcctgcctctacttgtctgctctgcgcagatggttcctggcttttgggtcacctcatcctgcagcccagtccagttagaacctttcttccacagagactggcaagctgtggggtaagagttttggtaaggctgcctgt

SEQ ID NO: 1350 - DNA, 1063 bp, Homo sapiens
ggcctttctcaggattttgctatgctttgaatgaatgcatgtcgcgacaagcctttgaagtaggtactgttattattcccattttatagataaggaaataggctcctagtggctaaagaattacctaagtttacacaacaaacagcaaaaccaggattcaaacccagtaagtctgactctagagcccactctcttacgcactacacctgcgatactgaactgcaccggcttatgctgaagtcaattattaaagatttttgcgggggtgatactaggagaaatttgagttgaaattccccaacctgataacttttctccaagttttcctgagaacacagctcaagcgcctcttcacagtctcctaggcacaacgatttggtttctcccaagtctctctcatccgcctcttctcctaacaatccagagataatgaactcttttccagcaaattctcctgcttctatccgaaacactcagcctctcctcaacccctctggaaaaaccttccctaatttctcaactctgagggattataacaggcagtacttttccccagttggcagcactactaaaattacttgttttcaatagtctcccctttatcctggctttcccgggtttcatcacgcgcagccaacctcggtagggaaatattatacccaatgacatctgttgagagaccatattcactaatgtttattacagtataataataattgttctattttatcgttagttatttttgttaatctcttactgtgcctaatttataaattaaactttatcataggtacgtaggtataggaaaaaaccagccaggaggccccgcacttcggtgttttctactagctctgcctacctccgtctgcgccgtctccctgactagtttgacccttcgagggccgccgtagtgcgtcgcctccgttgccggggaaacgacccgggacctgggagggagcaaagacgtttcccgccggcgggagctgtggctgtgattgagagaggggttagaggcgggtcccagcgctgccgcaccatggcggaccagctttatctggaaaat

SEQ ID NO: 1351 - DNA, 980 bp, Homo sapiens
gacacacacacttacacacacacacggcaggaggatctcttgagcccaggagtttgagaccagcctgggcaacacagtgagagagagagacacatgcgcacacacacacacacacacacccctgggcaacatagagagagacacacacacacacacatacacacacacacacacacacacacacacacagtttgagaccagcctgagcaacatagtgagaggcatgcacgctgggagcagtggtagtatgtgcctataatcccagctaggtgggaggattgcctgagcccaggagtttgaggctgcagtgagatatgaccataccattgtgtactccagcctgggcaacagcatgaggccttgtctctaaaaagaagaaaaaaagagataaatgtatacatacaaaattgggttttttctcccatggggatgggagggatgaaataatcttccctccataggacagaattagtttgcaagtcttatggaccagagtcatttgtactatataatgaacttttcttaaaacttattttgaaagcctaaccaagtgtctcaggaagcatgagaatatgtgaggttagaagctgcatgccgttatggtgatgtttcccaaattctgccgctccagtggcgccctggggcatccttccccattgggtggatgtagccactgaggctgaagtgattgaatcagtccaaagccgcaaaacttgcaagcagcagagcatggctgctagtccatctttccgatagtctattcttctccagttccttcattcagtgtttcctgagtgcccactgtgtgcctggccctatgctgtaactacagattcagagatgaacaaaataccagatagaacaagttccctgagggcaggaatttttgtggccttcagcaccttggtgaatgctgacacatagtagttatttaaatgattgtagaataaatgaagacacaggcgatctctattcacatg

SEQ ID NO: 1352 - DNA, 1014 bp, Homo sapiens
ttctcacttgtgatgatctgggagagtgagagtgaggagagtctaagaagagttcaggctaattattttcccactaatctggcataggagaggctcacagagattaaattcattatggtaaatacaaagagtaatactgctttacactcgggtctgtagactgagattcacactcaccacaattattcctgttaacagtctgccacatacctttcattttaagcaactgaaaaattgtaccaacttttctctttaaatttgctttaaaagcaaattcagaaaattggtagagggtcaagaaattacacagtccaactccattatttgataaattgtataaaaagcaaactaaggcaagaatcaactgacttccaaagttcacgaagagagcactctggaagttgataaaccaccaaaccatataaattccaccacctctttatctgtaattaaaaatcaaaggttgacttttttttttttaactactcactgtatttttagaaagatggggcagaaccactgtagaactcctaaaccccacagaacaaacagtacattctggaatgatacgccggccaatccggctggcagccgattgacctgacccaggcgagggttgctgcaccgagtatttagtttggccccctactgaatgaagacactttgttaaattctccaatgagagacgcttagaggtaggggcgtggaagggggccggggaatttgaggccagataacgggaagtgtgagccgattggccggacttctcactccacggcccagccgtttacggatcgcggaggccatccatcaaaagaattacaccaatcagcggcgaaaatgcccccttctcgcgagaaagccccgccctccaatatattcctcgttagggcaggcgcggccccttcggctccgagctgaccctgatcagggccgagttgtctcggcggcgctgccgaggcctccacccaggacagtccccctccccgggcctctctcctcttgcctacgagt

SEQ ID NO: 1353 - DNA, 952 bp, Homo sapiens
agtcctgatttcgtcctgtcaaccccagattttcttttttctttttcttttctttttttttttttttttgagacagtctcactctgtagcccgggctagagtggtgcagtggcacaatctcggctcatttcaacctctgtctcccgggtccaagtgattctcctgcctcagcctcccaagtagctgggattacagacgtccgtagagtcagggtttcaccatgttggccaggcttgtcttgaactcctgacctcatgattcacccgcctcgtcctcccaaagtgctgggattacaggcgtgagccaccacccccagcccaaccccaaattttttataatgtcattaggtataaaaacttcagaagcctccaatcctgagccctagctaattcattgtgccagtgacatgtgtagagaagaagcctggtggggtatgatttgattaacactgaactttgttctttcttccagatttcctcgtcctgtgactgtggagcccatggaccagttagatgatgaagagggacttccagagaagctggttataaaaaaccagcaatttcacaagtatgcagtcttgatagatttccctattaggtgtttccttcttaagaaagcttataaagggatatgtaaaagaggcaggtctttgctgcacatgttcactggcagccattatcttggtcctcacaaggaatgcaattcttagctggggtaattctggacaaagttagtaacctaggaaccttgcctatagggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagaca

SEQ ID NO: 1354 - DNA, 1015 bp, Homo sapiens
tgagcaacatggtgaaactctgtctctgcaaaaaaataaaaaaaagtagccaagtgtggtggcattcacttgtagtcccagctacttgataggctacttgagccggagaggtagaggctacagtaagctgtgatcacaccactgcattccagcctgggtgatagcaagatcctgtctcaaaaaaaaaaaaaaaaagatgaaggctgggcgcggtacctcacgtctgtaatcccagcactttgggaagccgaggtgggcagatcccctgaggtcaggagtttgagaccagcctggccaacatggcgaaaccccatctttaccgaaagtacaaaaattagccgggcgtggtggcgcctgtaatcccagctattcaggaggctgaggcaggagaaccgcttgaacctgggaggcggaggttgcagcgagccgagattgcccactgtactccagcctgggcgacaagagtgaaactccatctcaaaaaaaaaaaaagatggaaaaaaacattaaatattaaatttatgaacgtatgacatggacaaacatgtttcaattgacggcagtcaggtttggtgctgtccgaggtttcaggtatcctcccgggttcttcaaacatattccccagggataagggatctactgtatacaggaaggggcacccctcctcccttgcagtcttctggaaactgcagagggagtctgttaggcagatgataacaaaaaccagctggtggagttcaagaaatggggcctacggggccccagccccagcaccacaggacataaaaggaagaatttggagctgagaaacaagtgactgcaacacttgaagtcaaatcaaagaaaatttatctcctttcttcaggcttccagctggtctttttaccctttgctgatgataaaaggaagatgccctttactgaaaaaatcatggcaactccagagcaggtgggcaagatgaaggctatcgttgagaagcttcgcttcacatacaggtgagtcaatctcaggcttt

SEQ ID NO: 1355 - DNA, 961 bp, Homo sapiens
cccctccagtgcatatcagtatcatggagggacattactatgatccacgtgagttttttcttactgttggggtacttttcttggcagggtgaagtgaagtaagataccaggctcctggctcctgaatttctcttctgacctcttatagtggttatcaaacattgtctggttgctgttttcttcgcatggaatattgagaacatcttttaaagggcttggggaacaaggagacttgtccatgtgaagagtaagggtttatgagagtcccaatgtgatatcttacagtgcagttccagggaccaatctatacccatggtgacagccctgccccgctgcctccacagggcatgcttgtgcagccaggaatgaaccttccccacccaggtaagctttgtgtctctgcttatatgcttccagtacctgaggatatatgttgggagtgccacaaaacccatcctcctgagctttgtgctgctagcctgggagtctggccatcctggctgcttgggcaacaagttcctcttgtgtccatcctgaggacttccattctgagcctgattatactgagcagtccagccgggccatcctgtgaaaatgatgttactttatttttcagtttttttcttctccttatccaggtttacatccccaccagacaccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacaggtgagatggctaatgatcatgtttttctagatacacattctttaattcagacaggaatgtggtatggggagaatgctaaaggaatttgagagaacattttcagtgcca

SEQ ID NO: 1356 - DNA, 988 bp, Homo sapiens
accctgtcaacaacaaactgtcactttgtcacttttaatgtctcctgcttcacaggacacagctagcctccaagagatcagggaggcatgcccagagggtgctgcttctctcttttgaagctcaagtgccacagacctcagaggcacataaatgtcccccacactgagcagaggactttgcagtgcctgatcagggcagaaaaaggaggcatgcacctgggggaggatcacatacgagtgaaacctgtccccgctgaagcactaggtttggagaaatctactgggcatttacacacctttcccacttctgcttatgacttgtagccaaactcaagagtaccacccacttccaggaatagtgtaccaaggtaacagaaacattctagattcatacaattggggttagattaggatcatctgaaaatgaaggttgtgtatgtcaattgccttctaacaggatgggtggagagatgtacttaatgaatgattttggggaagggctagaagtgaagcacatggcctctctgccctcactcattgaaggctgtcttctgaagccccgtggagctcagtgcctgtcacatggttgcccacatttgttgaactgaactgcattttcatctatgggcttcaaaggctgtgtgtactctgggatctctgggaatctgtcagggaaggtgtctttgtcatgtttgtggatggggctccctttgggggtttcccagggctttacactcatgctccgagggtacgtttgtagtcattctcatcagtggaaatgcccacctgccggcagaagttatttggaaccaagcaagagcactgtccctggctgtggtgttgtttctctagtcagttcccctttctgtatttgagttctaccgtcagtcctggcattatttctctctctacaaggagccttaggaggtacggggagctcgcaaatactccttttggtttattcttaccaccttgcttctgtgttcct

SEQ ID NO: 1357 - DNA, 928 bp, Homo sapiens
agggagagggagctatgtaccctttttttgagaaagtacatctggttaagtatgtatttttcattgaaaactaaagttaaatcaggactgatggcattttccgactgcatttggtaaaaaataaatgccaaaaatattagattgaaaatgccaagataaaacttccttaccttctgtattgtaaaagtttcaagaataatttaaagatttttgcacaacacagaaagtgcaagttatcgtctatagttaataattaaataaaacagtttattaatggtaggtaataaaggtgcttagtaaaacagatggttctccagttccccaggctcaatgagcaggcaaagatccttttaggcaaaagacattttcacatctaacagtaacatctctgatggtcaggcaggtcaaacaatcacttggcgggaaatagataaatacagactaaattcgcacaatctgtttctgtttagtttataaactgcgatccagagtgtcagctttcgtgccttgtgggacttgaagtccagaaggaagaagtgatcagggctgccgagggatggaagcgtgcagcccctgcaggtctgagacctacgaactacaactcccggcaagcatcggaaggccgcgtcgtaattgcgggcaaccaatcgtaccagagcagggcaagcccccgccctctggctcggtggaaggcctccgccaatggcagagctcccatcgcagagcctgcgggttaggttgtgaggcccgggccgggggcggggaggagccaagggggcgagcaagctcggtggctgggtgggttggggcgttccgcgcgcccttcattgaagcggcggtggccgggctgggcgccggtagtggaaagcgacggcgcggctggaaaatgccagtccattcccgaggggataagaaggagaccaaccat

SEQ ID NO: 1358 - DNA, 935 bp, Homo sapiens
caaaaacaataaccagaccacccatccccatttagaatttctttttgtgctaagtttcaaaattcaaaataagcattcacttgttttctacaaactgcattctatagtcgatctcaaaccttgattgagatacatttccattatagtatactctttctagagcactgatctcaaaatgtggtgcccagccaagtagcgttggactttcaaattcaaggatcccaagctagaccagcagaacaggaattctgggagtggagcccggcaatttgtgttttagcaagcccccaggctgattctgatgcatcttaaggttggagaagcatggatattgtcagttgtaatagttgttgttcgtgatcacgtagtaactgttagatgaaaactagggtttaaaagtgttacgcttgtctaatagtgacaagttctcattacccatctctttctgaaataggctgcaggcaaatgcgttttcattttaaataaccgtgttgttgttccagtcaaggttgcattttacaaggaataaggaagataaagctgcctcctcctatcctaatctcgctcctcgctcagtatggagtcgtccggtttacctacaaagccctgccctagactggcggcaaattcaacgcccagaggcaggaacaggtgtcggccaatcagaagccggaacaggtgtcggccaatcagaagccaggcttgaaccgctcgcccatgtcccgccggcggaagagactctccgcggccacgccccgagccctcgaatgcgagccaatcgttgctcggcgcctgaaggggcagtacccaagcgagccatttaacatggcggaggatgtttcctcagcggccccgagcccgcggggctgtgcggatggtagggatgccgaccctactgaggagcagatggcagaaacagagagaaacgacgagga

SEQ ID NO: 1359 - DNA, 975 bp, Homo sapiens
ttttgttttatgtccaccccttgtgccccttgctctgcgaagccctacctgtgccgggagcttcgaataggaagaggacctcagggccaggcatccagggactgaggggctacagcagaaacagacccagaggcacccttggctaggaagagcaggatgaaggtgtaataattttgggagtggtctaagaagactttccttttaaagagtggaaagcaatgaaactgaggcttcaaggctgcaaaaatttcgtcctggatcagagaagggcactacaggtggagggaactatctgtgcaaagggttgggcccttcaagagttggagcacagaggtttaggagaaaaagtggtgacagatgagcccagggctatctgcttagacctgtgatctaatatgggtgccaacagccacatggcaatgtggctatttaaatttaaattagttaaaattcaataaagtaaaaaatacagctcctgtgccaggtgcagtggctcacgcctgtaatccccgcactttgggaggccaagacagggagatcacctgaggtcaggagttcaagaccagcctagccaacatggtgaaacccagtctctactaaaaatccaaacaaaacgaaactaaactaaaaattagctgggcgtggtggcaggtgcctgtaatcccagctacgggggaggctgaggcaggataattgcttgaacccaggaggcggaggttgtagtgagcaagatcgccccattgcactccagcctgggtgacaagagcgaaactcaaaaaaaaaaaaaattcagctcctgaatcacactagttatgtttcaaatactcaatagccacatggggctagtagcaatggtattggagagtatgtacaaggcatgcctctatcatcacagaatgttcttttggccactgtgaagcctcaggaaggggctcggattgctcaaggacccatgggagagaggaggctttgact

SEQ ID NO: 1360 - DNA, 1032 bp, Homo sapiens
aaaattcaagcagtcattggcatctcgttgtttactaacatgaatgcaagacacaggtttggaacttttaaattttgttcacagaggagtaaatcggttgttattataatgtacctaaccttgtattcttacctttactaccagtctgtaaattagggatgtctgaatgtgtctaaaatggaatcccaagatgggcagccaggatctttgctttgtggacgaatctaatgtgtttagaacacggcatagcacatagtaggtgcttaacaaatactggttcaatgcctccgtgtgctcattatcttacttagtggtaacctattgatctctgaagtgactttaggaagtgaattagggctttgggaagtgaatttggatgttgcatactgattaatgcattcatacgaacacatcctaacttttaaaatattaatttctttccaacgccctcttttatttcccgaggccatcctctgctccccactcgcaatccctcgccttcactcctcatagttaatgagacaccccctcggaggagagaacgcaatgtcagggccccagttctcacagcgccctgggctctttgaatgagagacatcaaagaaaacacagaacaaaaatgaataaaaatgagctcgctggtaaggctagaagccccacagtgtggagacttcatccccgagaggagtgtgtttctcactgcagcagttgagtcaccagcaagacttgcctgaggtgagctccgcacatccgcgttgggacttgcagacacgccttcttctcacacaaaccttacccagccccgccgccgcggcggactccgagggtggtgccaccagccctgccactcgcagtcctgacgggcaggggctgcggaccgcccggccttggacccatccggagccacaggttggaggagataagtagctgtccccgtgctcatcgccctgtggagcagatcctgtctccttgctgacggtggagcccgggagttccagggcttgggaaggggaaggaaacctctctgaaatc

SEQ ID NO: 1361 - DNA, 919 bp, Homo sapiens
gaacttggtctctggagtccattagagtatcatacgtcgcattcagcaatgatttatgagcatctgctgctacatgacaatcctgttccaggcagcacagacacacggaggtgccccctgcccctatgtggcagcctggtggagagacaactttagacaaggaaacacacaagctcagagataataagatgttacaatgcatgccatgatgtgaaaaacctgggcaccatgagagagaagacgagggaagaccctgatggggtcaggaggccaggagggcttctctgagggtgtgacatttaagctgagccctgaggctggaggaaggaagagccctgtaggcggagagaacagctgtgccaaggccctgaggggggaaccgaaagccaggcagtgcaagggcagaccagtaggggaggaagaggggagtagagtgttatgacctgggaaatgtgagcaggtagaggctacattaagaagtttgctctttgaccaataaaagccctggaaagattttaatcagagcaggcctgcccttcagaaagtgactcttgaggtccaggcacagccctgtgtggaagatagtgtgtgaggctgaaacccagagtgtgtcatcatctggaaacaaccctgcaaaggtgagaggtttgtcatagttacacaactttaactaatgcaccttcctccccgcaaactctaagctggttgtgaaacatgacgatggagcattttgcatatgttacaaaattattgttaatgctcattcatttttggacaaagaccagcatcagtcactggaaacacctgtttgggtcacgaggcttgtcttctgccaggagtggagactttcccacagacttcttgtttcttcttgctgcttttgggtgactcagcctatgacacttttgctcctcctgaa

SEQ ID NO: 1362 - DNA, 998 bp, Homo sapiens
cttagcgcgaagagcagagttagggagaacataaagttctcctgcaggagctgcgatgtgggctactcagctgcattttgaaactgtgatttaggatgttcctccttccttcctctctttctttgtttattcttccattttttggggttttgtttgttttttaggagatggggtcttgctctgtcacccaggctggagtgcagtggtgcagtcatggctcactgcggcctcaaactctgggctcaagctatctgcccacctcagcccactgagtagatgggactagaggtgcatgccagcatgcccagccaatttttgtattttttgtagagacagggttttgccacgttgcctggggtggtcttgaactcctgaactcaggcgatcctcctgcctcagcctcccaaagtgctaggattacaggcgtgagccaccgtgcctggcctgttctttttttttttttttttttttttttttccttaaatggatctaatgtgcagaggattgggtcagcgctagggaggcttaaccgaggagtgacaaggatgacgatagcttaaaagagcttggcagtgggaagcactgtggttggttaccagcaggtgcaggtcacctaaggccgcagagcagaggcagaacaccctgtgggccatccccagcacgaggaggcacccagctctctttgtggcgccagctcccaggggcctggtgggcctccttagttttacgtttaccacatttccccaggaagcctgagggatgatgtggtctgaatgaactttcaaattcagtgttaagtaagtggagggtacagatagatacaaggggaaataaaggaaagttgagaacaaggtcgatttcactgaagcagcgtcttcaatgcttcctctgcagcatccattcaaaggagaccttccattctctgacaatttctttctctcgatgctgggaatttcttctctggatggatccatctaactatggcggaatcaaaggaa

SEQ ID NO: 1363 - DNA, 1095 bp, Homo sapiens
ttgtaaacgtaccacctcctcgttttcttttctcatcagatgttattttactccgtgttctaggtcattgataaaaatggggatggtggtgggtcggggtggagggatagaattctatggcatgttttgttgaattgaattgaatttgctgtcttgaaactggcagttgctctcctgacttttttcaccagctctaatttcagttaatggcttatcttacattcccatgtattctgtgtggtacctgaagttacttgcttttcttctgttctggaagaaaaaataattcacagtaaaatttaacgtactttaaaactggtctcctggtctcaagcaatcgtcccgcctcagcctcccaaagtgctgggattacaggcgtgagccaccgtgcctggccggtgttactggtcttattttatttaaggggcatcaggtcaccttgctatatgaatggcgggctgatttttctcatcagcctatctctctgtggtggaattgtgggattgtgttgcttagtgtgggagtcacaaggtggtgttcctgtgtagcaggggttccatagaggcggcagagggaggcaacaggatcagaggggtacagtctgcctttctgttttgggcctcgccagctcatcatttctttgtgatgtctttactaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctac

SEQ ID NO: 1364 - DNA, 973 bp, Homo sapiens
tatttgaaagcggtattgcaaggatatagaacagcttgaatgttaagcactttcaaatactaagtgaggtgatcacttttgtaattcaaatggaaatagaataaatgtcaatgaattaatgatctgtatcaggaggcagcataaagaatttgaattggagggttttgggtaactggtaaaatggtggttatctttttttaaaagaaaaaccctctttggggattcctttgtacagatgatctcttaatttgccatctttaatcctcacattattaaaggctacattgattagaaggaaatacagcttccttgtaggtttttagctttttggcttgtttttggggagatggttgctgctatttggagaaagggagaaaggcagaaattttaaccttagtctgataccttttctacaagctggccaccaggtcctttttaggtttttctgaaacctgaccaagtttaattgtcatggcataaaaacttggtattgaaggagttaaagggtctcccacacccctttgcatgaatcgttcttttgtgtacacagctgcagtggcagcacgggtcggaaaggaaatggttagaggaagagctggttttcagacaaggcgagtctgcgaggggggctgcagggtggcctggggttttacatgccagatgtaggcctgccccggtgcctgcctggagctgctggcgtggtcacgccgcgaccctgtgcgaattgaggcgaggtgatgagttagcgggttgccatggcaacaggctggccacgtgaccagggtgctgctgccggcgctctgacgtcagctgccagagggcggggccgcaggagggcggggcgcgagcgagagctgggagaaggcagtgagcgagcaggcggcaggcacggtccgtgcggagcaggcgagcgagcgggaagacgcagccaccttcctcaccagccagcccacagcggtttgttccccttctc

SEQ ID NO: 1365 - DNA, 900 bp, Homo sapiens
ggaactatctgtgcaaagggttgggcccttcaagagttggagcacagaggtttaggagaaaaagtggtgacagatgagcccagggctatctgcttagacctgtgatctaatatgggtgccaacagccacatggcaatgtggctatttaaatttaaattagttaaaattcaataaagtaaaaaatacagctcctgtgccaggtgcagtggctcacgcctgtaatccccgcactttgggaggccaagacagggagatcacctgaggtcaggagttcaagaccagcctagccaacatggtgaaacccagtctctactaaaaatccaaacaaaacgaaactaaactaaaaattagctgggcgtggtggcaggtgcctgtaatcccagctacgggggaggctgaggcaggataattgcttgaacccaggaggcggaggttgtagtgagcaagatcgccccattgcactccagcctgggtgacaagagcgaaactcaaaaaaaaaaaaaattcagctcctgaatcacactagttatgtttcaaatactcaatagccacatggggctagtagcaatggtattggagagtatgtacaaggcatgcctctatcatcacagaatgttcttttggccactgtgaagcctcaggaaggggctcggattgctcaaggacccatgggagagaggaggctttgactgggctgcctgcctgtgaggtctctggactagaggtgagggaacggtccccagaagtgtgaggtggtgtgactcacctcctgccagcgtaaagtggactctgtccccatggacaggaacaaatcgggcaaggcttcttcagccctgagttgggttatctgctcagtgtgaccagagccaggggatgagaaacatggagtgagtgggactg

SEQ ID NO: 1366 - DNA, 1247 bp, Homo sapiens
tcacttcgatccattgagtgtttatgtttgcaaagcctttatttttatttatttttatttttttgagacagagtctcactctgtcacccaggctggagtgcagtggcgtgatctcggctcactgcaacctctgcctcccgggttcaaatgattctcctgcctcagcctcctgagtagctgggatttcaggcacccaccaccacgcacggctaatttttgtatatttagtagagatggggttttcgccatattgaccaagctggtctcgaactcttgaccttgtgatctgcccacctcggcctcccaaagttctgggattagaggtgtgagccaccgtgcccggacttttttttttttttttttttttttgagacagggtctcactctgtcacccagaatggagtgcagtggtgtgatctaagctcaccgcaacctctgcctcccaggctcaagcgattctcctgcctcagcctcccagatagctgggattacaggcacacaccaccacgcctggctcatttttctatttttagtagagacggggcttcaccatgttggccatgctggtctcaaactcctgacctcaagtgatccacctgcctcggcctcccaaagtgctgggattacaggcgtgagccacggcacccaggctacttttttcttttttcttttcttttctttttttttttttttttcagagacagggtctcactctattgcccaggctgtcctccaacccctgtcctcaagcaatcctcccgcctcagcctcccaaaacactgggattataggcatgagccactgtgcccctttacttttattgtcactaatcctcaccactaccctataaaacaagaatcattatcgtcattacacagagaagagaaacgggctcacagaagtcaagtgatctgtctaagctcaagcaagctgatatggggtggagttgggaccacaacccacatctgcctgctttctgtgccctctgtgcttgatctcatgtcatgggccatccattttgccaaagctttcgaaacatgccttctcccctccttttaggccttttctggaagtcaggctggcttgcagctctcaccccaagctcttttccccagctggggctgaaggctggggaggagcttcatgggggctggaaataaatgaagggagggctgggcgggacagggcagtatttccaggaggctgtgagggggaggtaaggagtttgttattgttttgggtttggg

SEQ ID NO: 1367 - DNA, 976 bp, Homo sapiens
aagaagaggcaagaaaagccactttattatttattaaactcccgcatagagtgcagtattattactgtgtgccagaccctgcttcaaacacattccatggactataaaattgcatctctgagcagctcctagagctggtagtaacaacttacatttactgggtgattaccatgtgccaggtattgtgctaaacacgttgtagatattaactcacttaatcctcgtaacaatcccatgaagtaggtactgctactatcccggctttacatctgaagtacagagaggttaagtaacttgccccatgtcatccagcaagaactaaatttgaacccagagcttagccactgatgcctcttgagagaaggagtcagacttaagttgagtctttaaaggtggttgaccaggcatttgtcagagttaagaaagagaggtaggacatccttttccaggcagagggcattgtgtgcacacacgtatagaagcaggcagcccaccctcatgctttccaggaagcaaatgtggctcaggtgtaaagtgcccggttgatgaagggagttagcggagggagtataaggatgtactgtctgcccccttaggacacctgcagaggattaaggtggctgtttctccctggaggtggagtgggtgggtcactgcacaggagcctatagttgttggtcttttaaactcttattggtgtaaccagccacggaactctgaggcaaggggttgggggtgggaagggaaacagagaaaaggcaagtgaaacagaaggggaggtgcagtttcagaacccagccagcctctctcttgctgcctagcctcctgccggcctcatcttcgcccagccaaccccgcctggagccctatggccaactgcgagttcagcccggtgtccggggacaaaccctgctgccggctctctaggagagcccaactctgtcttggcgtcagtatcctggtcctgatcctcgtc

SEQ ID NO: 1368 - DNA, 1145 bp, Homo sapiens
tccccgtaccaaaaatctgtgttacgttctccagagaaacagaaccaagaggcccactgagcaagcgagattgattgattgattttaaagaattggctcatgcaattgtgggggttggcaagttgggaattcaggtacgagttgatgttgtagttttgagtccaaaggctggaaactcagtcagaactttctgtgttgcagtctggaggcagaattcctttttccttgagaaacctgtctttgctcttaaggccttcaactgatttggatgaggcccacccgcattattgagggtaatctgctttatttaggctgagacatgagaatggcatgaacccgggaggcggagcttgcagtgagctgaaatcgcgccactgcattccagcctgggcgacagggcgagactccgtctcaaaaaaaaaaaaaaaaaaaagaaaaaaattttttttgagacgaactctcggcctgtcgcccaggctgtagtgcagtggtgcaatctcagctcagtgcagcctttaccttctgggttcaagagattctcccatctcagcctcccaagtagcttagactacaggcgtgtgccaccatgcctggctacttttttttgtatttttcgcagagatggggtttcaccatgttggccaggctggcctcgaactcctgacctcaagtgatccacccacctcagcctcccaaagtgctggaattacaggcgtgagccaccgtgctcagccaaattttttttaattaaaaaaaagaattcttccttacccatggactcaggtcacattctctctctctctctctcacacacacatttattgcccacatggcttcattaaaatttaagttccagaaggatgaggcctttaattcgcgcactacacaggtgctcaacacacagtattttccttcagttgtagagaaatgaacagtggaggacccccgccgctgggtcgcacgagctaacagatcggcggtcgctggctctccgctcttccagccacccacatcacggcgcctagaggcgggacatcctgtgtggacaacagggagcttccggattgagccggaagtccccccagagcggatgccgcggcgggcctgtgggagcggggtcatcttctctctgctgctgtagctgc

SEQ ID NO: 1369 - DNA, 982 bp, Homo sapiens
ttgaggaagaaaaagaccaggtgaaaaagcttctaggaccatctgttattctgcataccagttccttgtttccttcacagcacatcacagttcctggaagtcttacatatttatatttacttttatctgttctcctcgcaaatataagctccaagtaatggcaaggatctcttatatgtcgatgtcagtgtccctggcccttagaacagtgcctaaccatacaaagctgatgttcactctatctgctgaatgaataaataattgttgcgctcactaatgataacaactcctaactttattacctggctttctattggaatcctgacagctccatgaggtagctaaggataataatctacagatttaaaaaaatgaagcgaagagtgtgagaatagtcatcaggtgggcttctaacaggaaaaggtctcagggcctacggcaaaattcggagggggggttacggaaaggacagggtggattaggccatggtgacttggagagaggaggcacgactggccatttttcctgagtctggaaaaagcagcctagtacaagaagctccttcgagcgacctccttaaaatacacttacctggtctacgtcgtccgccatgtttcaaaccctgcgccctttcccgcctctcgcgagaacacaagagcaacgtcaatctccggaaacgtgaggatacaatacaccggaaatagagagaaacctgttgtgctctttcctgcttcccgcagttttttagtggccacgggtatggggtggagcttcctttaggggcgtgactaggcctccaacgaaggggcgtggccaagcgcaccgcctcggggcggggccggcgttctagcgcatcgcggccgggtgcgtcactcgcgaagtggaatttgcccagacaagcaacatggctcggaaacgcgcggccggcggggagccgcggggacgcgaactgcgcagccagaaatccaaggccaagagcaag

SEQ ID NO: 1370 - DNA, 1054 bp, Homo sapiens
ccatgcttctgggttatcaaaagactgtgtccagagcatgtgcttgtcaggaacattaattagggtatttgcatgcaagagttgtcatgcaagggagagggcaggaaagctctgaggtgtttccactgtagtgtacaccacaatgtcaccaaccctctggatgggctgataaatctagccttaccacaatgccctgggagtgggcttggggcctgccacctccaggagctcctgttcaaagggcatataagtccctatcaatgccaaagacttgcctcgcaagagcagctatagggactgggcaggaatacagatagggatccttcactacattgttggatgcttcacacctttcccagccacctgcacgaccagctgagtggtacagccctgaagcctatgtgaaaacaggataacttgatggttcagagccattatttccatatgggcttaggcaaggtacttaaactctcagtgtctcagtttcctcacctatagaaaggtaataaaagcagtacctatccccttagggttcgtgtgagaattaaataagctaatatatatacctggtgcatgataagttttatatacgtgttggctatgatcttagggcagctgtgagagagctgagccctagaaccataaaaccctcctaagcaccatctccactcatggcctggcaggtcgtggagcaggaaatcctgtgggaaaagggaaggctttgactgtaggagtgggttgattgtgggttcctggaaggtgaggactccttccctaacatcctcaatgcccagcaacacctaatctggctgcggcaggtgctcaggaaacgctagtcaaggagaaaggcactagctttcgctctgccccctgccccaccccaggggcgggactgtagaggcgcctataagggaagttgttcagtcaactcggaaaaagggtaacaacccggaaagtagactcaccgtcttggtctagagactgacccctgcacagacagaccccttcccctctctgcgaaaggaccaagccccagaagtcactccatctccta

SEQ ID NO: 1371 - DNA, 949 bp, Homo sapiens
caggaaggaaaacttctgtttttgatccttatgaaatacaatttccattaaaacttttttttttgctattaaaaaaggtaccggataattgaaaccagattggatttgagcctgtgttgatggaagtacacatgggatgtgggctgaagtgttcaatctaatttttctttccatcagctaatttttaaagtattaagcaagtagattctgacactaacagggaagatttaaattctcttgagagactggaggtgttaaataattttctggtagtgcacattttacatcttaaatcttcctcactctcccacctcatctcaatgtacctgaagctctgggaatgttcttttgtacttctcaggaacagccagacctctggcttcatctcctctcccctccacatccctttcctgctccaattacttcccagcgccacttggatgttgttgtcatcggggaactttggaaacagccagatttttttggagtctgtaagcagaaaacagactgcttgctgctcatatctggcacccagctttgtccagaaaacgaggagttaaaaagaagtctgggctgtgaagggctgtgacaactgtcctagggggagctctagcgagccctggcgggcagtgactcatgctgctctgtcactgggatcagcactggcccctggcaggcaggcggcagccaggtggggttccagccagagcacgcacgcacggagccgggagcatgcagcctgcactgcgggggatgtgatgctcggctctaactcgcctggctggcccgccacggacgcctcagcttgcaaccatggtaacgtttctggcgggggacacccccgggagcccaccgcgatgggcagcctcctggtgactgatggacgagtgtccacctcccagaccgagagcgcttagtaggtcggaggaagtggagaggatgtaacacg

SEQ ID NO: 1372 - DNA, 977 bp, Homo sapiens
attccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaa

SEQ ID NO: 1373 - DNA, 1036 bp, Homo sapiens
actgaacacctgtgatgcacctgtcagcactgcaagcctggacatccccacttacagcaaaggggataggcccagagaggttaagtgtgtgtcccaaattgcacagcaagtgaactgagattctaacccacgaaccactgattccaaaacctaagctcagaccacccgtttctatggcctctgaaggtgaatctcactggtacccaaatgtagctttctagaattggggtccactgtgtgtcacagagggagaccccagtccctgcctttccttttctgctccattgcagcccaggtcatgccaatgggagcaggcttgtctgagcgttttctagggggcgatgcattcatttcctggtgaaggagcagtgagggaagttaggatttgtagctgccgtaacaaaatagcacaaacaggtggcttaaaaccaacagaaatttattctttcatggttctgggatctagaaatccaaaatcgaggtgtccgcaaagtgggttctttctgcagacgccaggggagagggtttcatgcccctctctgagttctggcggctgtcggcactgcctggcattctctggctgatagaagctccgagttctggcggctgtcggcactgcctggcattctctggctgatagaagtgtcactctctgctctgttgtcggcacacggcgttctccctgggtgtctgtgtctctgggtccaaatttccatcttcttataaggacacgagtcatcttggattgagggcccatcctaacccggaatgacctcatcataacttgattacatctgcaaaaacaccctattgctaataaggtcacattcacaggttctgggtggacatgaactttgggggccactgttcaacccagtatagctggtgttttatctcaggaggaggttctgagatatggaggggtattgttctcttgtccttcctaaccgctcccatccctcccccttgcaggtgtggggtgcacactgaaaatgccacgctccttcctggtgaagagcaagaaggctcacaccta

SEQ ID NO: 1374 - DNA, 1057 bp, Homo sapiens
aagggcttaacaggtatcccaaacactaaatgactatctaacaaaactagtcacaacataatcaaagagatgtgtaattcgcaaaaaactgcgaagtcactgccctcatccacgactagtggatactcaaccacttcagtttcccgcgacagtccatgatcttcctccagcagcaatgaacaatccctgcacagtgaacaaaaaaagttgatatgtgaaaaaagttcaaatatgtgaaagagtgggcttgtattgaggtctgactccgtattgcacccatggttccgaaggtggccagccctctgtccacctgactcaaaacggggtcacacgccagcctctcccttatcttttggcattagaggctgggaggccaggaagcggggccttaatcatctccaggttaagcatagcgagctccaaaaagccctcagagtcctgcccttctgaagactctaaggcccgccctcaaggaccctcaccgccccccacctgccactcggcaccccaagggagccgctccagctgcatccgctcctcccggcacccccatctaaaaatgtgttcgcgcccgcactttcagcactcccagatgacaaaacgctgtgtttgtgtataagtgaaagccactcgcgccagtcacttccagtttacaaagccttctctctggaggttatccctacccgctttacctttagggtcttggcgggaacaagttcccgctgccagtgccgtgtcgaatcggcggatgctgttcaaagagagagactttaaaaataatttttaaaaatacattgcccttttaagtcctacggatttattgtattttatttgtgttcgaaagtccgctaattcccaatgtggagggttggggatgtttcccttagcgcctctgggacgctgtccctaaggccttattccatgttgaatctgacgctctcaatgtccaggctcggctgcggcgtggggaccgaaaaggggcggggtgggtcggacggcagtttaattacgtccccgggaactgcgccgatttggacttttggcacttggacctatg

SEQ ID NO: 1375 - DNA, 1092 bp, Homo sapiens
ctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgaccacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccctgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgtgtgcaaaatccgcttcctgagcgtagggtgctgagctggcgctagggctcggttgtgaaatacagcgtagtcagcccttg

SEQ ID NO: 1376 - DNA, 910 bp, Homo sapiens
tttgcaaacatctatggagccttaccatactcacattattttgcgaggtgctggtacgaatacagaaatggatataataaaggcaaccttccagtgtgtgcactgtggtggagaaaataaataaaacctttgccttgttgaaggcatcccattatttaaagaggtaacattttccccacaactattttgtgtggggtcccacaaaaaaaccgatagatagcagacctatcttctgatatctatctactatctatctatcatctatctatctatctatttatctatcatccatttgtttatctatctcagaaagcagaggtagggtacgaggaagagatgggacattacaatgcaaagtcctcccctccagccaagtttttcaaactccttgtccatacaacatccatgaccctaagttcagctctttacacatttcttttccccgtgaggctgagctgcttgagggcaggtcacgtctttccactacccttcttgccggcacctagggcttcctgatggagaccctacaggtaatccacgtgagcttatgctccgcggcagacacgcccaggcgggctttactcacatcaatagcttagtacgcacactccctctagccaatgagcgaatacgtactcctttctccacctcccgcagggcggccaccgccccctcagtccctctttctcccgtcacctccccaggttgccccgccctgctccgccccctcgccgccgcgtgctcgaggagcgagtcgcgcgctactgacgtcaccagcacgcgccccgtccgctgcagtccgccggcgagggagttacgcacgtcctgattctcctggagtctccagcccgcccagtggccgcagtcacccaggtccagaggcggcggtatcacaggctctccgacatgt

SEQ ID NO: 1377 - DNA, 1063 bp, Homo sapiens
tgcaaagcctttctacatccttccactatatggaacccccaaaccacaactgtggcacttttattttaattatttttattatttatttatttatgtatttatctcttgaggtggcctcgctctgtcactcaggctggagtgcagtggagcaatcacggttcaaggcgcctcgatctccgatccccggggctcaagcgatcctccctcctcagcctccggagctggagttacaggtgtgcgatgcctcgcctggctattttttttcctttttgggtagagacggggtctcgctatgttgcccaggctggtctccaactcctaggctccagcgatcctcccgcctcggcctcccaatgtgctgcgaatacagactccagccaccgcacacagcctacttttatttctttgaaaaatgaattcgagggtaaagggggcggggttgaggcagatgccagaatctgttcgcttcaaccaagcagccaggctgcctgtccagaaagccggcactcagtttcctcaggaaaacgaagctaaggctcccattcccctcgctaacaacgtcagaacagaggacagtttttagatttcagggatcttaaatagattggcagttcctggagaataaacatcctttgcttttctcctgcacacttttgcctcaggccaccccttcccgcttccaaagcccatctcttccaagctttccgcacgagaaaacaagtgagcccttctcattggccagattccctgtcaatctctccgctatgacgccgagtggtgccttttgaagcctctctagtcccgcctccctaacctgattggtttattcaaacaaaccccggccaactcagccgttcataggtggatataaaaggcaagctacgattggttcttctggacggagacggtgagagcgagtcagggattggctggtctgcttcgggcgggctaaaggaaggttcaagtggagctctcctaaccgacgcgcgtctgtggagaagcggcttggtcgggggtggtctcgtggggtcctgcctgtttagtcgctttcagggttcttgag

SEQ ID NO: 1378 - DNA, 1093 bp, Homo sapiens
actacactgtttttgcccatgcttcctcacttgcccctcacacagatagccccatgagataaaacagagtaggcttatcataggcatctgacagatgtgcccaccgcctcttgtatttccttcttaacattcatcacatcacaaagactttctccctccagacttgtaagctcctagtgacacggaccgattcttgttcaccacaggatccctattgtgttgcatgaacaagaagtagagtatctccaaagagttgtctaaggtgacaataaacacggccaatgaaaagaaaccactttttgttgaacatctatgtaccaaaccaagtcagtaaggtaggtaccattctgcggataagtaccgtatacttaagttcagagaggtgaaattactcgctcaaagtcacgcagaataaacgtcactctgaaccctgcatctcagtcccacctgctgcagtagagacgccatctcttcctgcaatggggtcaacggcttggagactacaggtggccgctgcaggcacaacgcgcccaacaagcgccatggggatccgttgcttgagggtgcggctgcaagagccaggctgcgagagcttagactgccggcccagagcctctcgaaccgccgccaaccccccgccacccctaacagcgtccgccttacgggcgccgccatctttcgttctcccacaatgcaccgcggctcccagggatccctcagccgcgggagcggcaaactaggggaaagctcagtcccggaactgctagaacgaaccattcgcatatggagggggtgacccaccatctcagaacattaaaaaagggaaagaatcccctggtgaactacagtgaaagtcttattgagcatttaaatggaaataaaaatattcagtggacctaatgaagagtagatgactttcccttctgtcccctccccgacaggcactcatggtaccggcgccggcgcagctgtgactgtcgctgcagacggaaactgactggggtcaattcaagtcatgcaggctgtgagaaacgcggggtcgcggttcctgcggtcctggacttggccccagacagccgggtaacaaatgact

SEQ ID NO: 1379 - DNA, 1059 bp, Homo sapiens
gaaacgtgtagttctgggtttgggtgaagacctccacttttgtagtaggttcataaatcaaatcagagcaaatagttggtgtcttaaaaactgtatttatctgggtcttctaagtaaacggtttgaggagtggtggaggcagaaattaagatttactgagtacttagggtcaagtaaggtgcactggatcgtgttaatcgttaactcgtggaaaccgcccagagtgtgtacgctttctttcttttctttccttttctttttttttgagacggagtttcactcttgtcgcccaggctggcgtgtaatggcatggtcctggctcactgcaactccgcctccagggttcaagcgattcacctgcctcagcctccagagtagctgggattacaggtgcccaccaccacgcccggctaatttttgtatttttagtaaagacgggggtttcaccatgttggccaggatggtctcgaactcctgacctcgggtgattcgccgcctcggcctcccaaagtgctaggattacaggcgtgagtcaccgcgcccggcctggagtgtgtattatcccaattttatggggagtaattgtgctcactcggctcaccaccaagtcgccagagcgcgcctccgcaaggaagccctccaggcacttctactttcccggacccgcctcccgctccagccggttacacgcgccgttagcagcgtgggcggagttggttctgccttcgcggaaccaactggtccagcttctggtgtctcccctcgctcaattaaaagccagctcctctcctttcggcttccccacggtgcctttcgggatttgtagtcagacgcgcttcagccggctctaaggagagcaaaggcaagactccaattcccagcatcccccgcgcccggagagtgcagcgtctattctcatcctcttcacttttccactcctccccttacctcccttctcttctgaattctccattctgggctcttgcctgtgaaatctttctttgctttccccatcttttcctcgcattttttcaccatctttccctcaatctccaggag

SEQ ID NO: 1380 - DNA, 1097 bp, Homo sapiens
aacctagctttttcccgagtttgcaaaccagcccgcgaggcaagaggcgctcggtgctgcaggtcactaggagtttctagtccctacaccctctcgagcccaacagctgcatagcgaacaaacagacgctcaggagatgtaaaatgcattagtctctgcagaggtgggaggtggcggccgaattaaaggcttccccgggttgcctgcaccgggacagggagtggggttccgggtagagatgaggactggaaccctggaatggaggcgggggtgcctgtgaactaatggctaggaaaggcactgaggtttttgcattaacctgggttttgcatttccctcccgcatgggaaaaaaaaaatcgagtttttcctaagaaccgttttatggagccggtcgaggggataggataatcgactgcacgaatctcgcagattccgcttgaggagattctctctaggtcactagtgccctggagacgaaccctgggattaggaaggcactggataacactgcaccccaagatgcctcggttcttccccgtctcctcattggttggaactcgcccccaaatttacagcccctttttctaacccacccccagctgcgtggccctcctttgtaggggtgtgaggattgagaagccaaacagagcccacctcgggctgaaaagagctgaaccccctactctgcgccgtaccacggtctaggccttccagtgccagagcacctccaaagcgtccgagactgggtacagtcgtccaggcgtgacgggggcgcggggagccagtgactcctctgggaggggaagggattagggccagaatctctcaaaggtgcaaaaatccagtcaagagagggttttcgggtataccacggaggattaaaactttcaagacaaatgcagtctttgcctaacagcaatggtaaagcatttactgagctcttactacatgttccgctagagcttgtcatgcgtgatttaatgttcataactttaagaggtgggaggagtattttaaatcgaatcagtgctttgggaagttaagtaacttaaaccagatatcccatacaggccaaaagtctccaagtccctgcta

SEQ ID NO: 1381 - DNA, 1013 bp, Homo sapiens
ttgaccttcagaagacaagcctccaggggaggggaatttctattttttggcatgtggataatgaacacaggggagggcaatccctgctccgggctccatgtctttttccagcttgtcaaaataggacgtccacaccctcctttgcccccaagtccccccactaattggcatcaatcgaggaagtctgagcgactgcatgtttaggtaaaagaggaaaggggtggggtggggcgcagtggctcacgcctgtaatcccagcactttgggaggccgaggcgggcagatcacaaggtcaggagttcgagactggcctgaacaacatggagaaacaccgtctctactaaaaatataaaaattagccgggcatggtggtgcatgcctgtaatcccagctactcaggaggctgaggcaggagaatcgcttgaacccaggagacggaggttgcagtgagccaagattgcgccactgcactccagcctgggtgacagagcaagactccatctcaaaaaaaaaaaaaaaaaaaaaatagaggaaaggagtgaacccctgagtggccagctgggtgcctcaacggggtgtctccaaaggcagcttgtgcttgtttgtgaccagggtgacaaaggacttcactgtcctgtagcacagatgaggttccaccctcaggtgggtggaaacagcccaggccattagtgcaaatcccctgcctggcccagggccacgttcagcccactgtctgtttgctttgggacccacccaaggtcacattttagcttttgagaaatgtgaaagtggaaaacattgcaaaacaaaaagcccctggaaaactgtgcacacacccatcccctcagcctgatgctccagcttggctgctaggagatcaatgcagctctgccttcctgctccctgtgcagaggtgccggctcctgcttcctggttcccagctttccttttgggaactgcctgaggtggtttgacacacagctgttgggcttctcttcccttgaggtctctga

SEQ ID NO: 1382 - DNA, 1098 bp, Homo sapiens
tacaagggatgctgggaaattagcaggggccagagcatgtccagctccatgcctgctcctcattggtgtctgtccttatggagctcacagttattagaaatggggaggacttgtctgggcacggtggttcacacctgtaatcccagcactttgggaggccttggtgggcagatcacttgaggtcaggagttcgagaccagcctggccaaccccagtagagatgggcgaaaccccatctctattaaaaatacaaaaaaaattagccaagtgtggtggtgtgcgcctgtagtcccagctactcaggaggctgaggcgggagaatcggttaaacccaggaggcggaggttgcaatgagctgagatcgggccactgcactccaacctgggcgacagagcagactccgtctcaaaaaataagaaaaaaaaaaaagaaatggggaggacttagccgggcacagtggctcacgcccataatcccagcactctgggaggccaaggctggtgtatcacttgaggccaggagtttgagaccagcctggccaacatggcaaaaccccatctctactaaaaatacaaaaattagccgggtgtgttgatgcgcgcctgtaatcccagctagtcaggaggctgaggcagagaatttcttgaacccaggaggcggaggttgcagtgagccgagattgggccactgcactccagcctgggtgacagagcgagacttcatctcaaaaaaaaaaaaagaaacagggaggatttcattcattcaccaaataaccaaatatgtgctggaccctgaggaccaagctgtcgatgagacagacagtccttgtcttcctggggctcaaccaaccagccattaggcagtgacaggcaagaggggtgggggtgactggtgcctgtcccatcgcctgcctgtgaggggaaggagtggaaaggaccatctcatgggagggacagaggaggggttggtgaaagctgggaccacactagtcctctgacacatcttcttgcacccccagacagccacaaccaaagtcccggagatccgtgatgtaacaaggattgagcgaatcggtgagtgagttgggtcaggaatagg

SEQ ID NO: 1383 - DNA, 1047 bp, Homo sapiens
actcaggacacttgggaagttgagcttccctgggcttcccctcctctcctgtctgcaaggggtcagtgggctgagatttcagcacttaagcaaagcatttgctcttggccccagagaaaccgggctggctgtggtctcaggaaggaaggaggtgtccaggctcaggcctgggcctgggtttcagggagggcccacgtgggtcgccccttgaccctctctttcagcaaggaagtgatcctttctctacatgggcctcaccttggggaggacaatggtgtctttgaagttgtagtaactgaagtagagatcaaaaggcaatgcagatagactgacagatttcgcctgaagaggggaagcccgaccaggtaataaaggagtaagaggaaggatgttaaggacaattttaggaaacagataatgagtgaatattttttctctctctttcccaatttaaactgaagcaggagaaactgaagctagacataatgattaacttcccaagctggtgagcttcctgagctggttagtgagaacagcactaaggccaggttctcctccccagatgtttaagatgagacaggacaatgcctgctcagagacagggcctggctgaattggccctcaggattctctctgctctgaggtttctggaagaaggccagggcagaggtgtggtgatgtagctgctgggaggacagagctccgagtcacgtggcttgggcgggcctccccttcctggtgtccacagaagcccaacgtcactagctggggtgtgtatggctcacacgtaggccaggctgccctaggcttggtgtgcaagggaggggcccctacttacttgtggcctgtcccctcgtgaatgtgtctcatgtccccagtggggtttttcagtgagggtcatggtctccaggatgcacaaggctttgtgccagaattgcttggaattgcctagttctggaaggctggttggccaactctggcctccggcttttcctttgggaatttcccttgaaggtggggttggtagacagatccaggctcaccagt

SEQ ID NO: 1384 - DNA, 1027 bp, Homo sapiens
gcatggtagagccatgaaagaagtggcaggataagagacacagaggctgtcctggagccctgcagcatggactcccacttccctaggctgatcacaccacagcctgcaccacgcagaagctgccggcccaagcattgaaatagttggctaaaggggcactaaaatgtcaactcagaggtgacagtgtgtgatggtggtgcaccattctccagaatgcagtatacactttgaatcaaaagcctttacgctgccggccctggtggctcaggcctataatcccaccactttgggaggctgaggcgggcagatcacttgaggtcaggagttggagaccagcctggccaatgtggtgaaaccctgtctcctctaaaaatacaaaaaattagccaggcatgcagtgagccaagatcgtgccattgtactctaacctgggtgacagactgagactccatctcaaaagaaaaaaaaaaaaagctttatacggtctgaccccccccagtaggaagaacacatgggtctggaaaccaaacggcataagtggccttatcattgctcccgaagacccagcagtggaccttgtgtttcctagtcctgcaactctgggctctgcagggctggaggtcctgatccccaaggaatcacacttttgccaagggacacaaaagtctcagtggattatgagttgcacctgcaacctaggcacctccggctttttgtatgaccctgatcagcagatcaggtgcacctcagctcctcaagtcactccttgtgccatttgtgatgccaactggactagtgtatcctttctggcctaagaaggacatgatgaccagggacacagaccccccagggatgagggctgaccaccccaccaggtaagcccccaagaccagcaaagatggtggctgggcctgcggctctccgggacacagggtgcaggtgaggatgagcatctgctgtggctcagggacagcggcggcagcaggagttgcaggtcttccttttaacctccctctcctcactttcc

SEQ ID NO: 1385 - DNA, 1074 bp, Homo sapiens
aaactgcaaaatcagaaacctgcaatttaatcatgagtctcttaataataacagtcacaagtctcattgttttgatgaacccatagaaggggcccctggaagaaattgcacgtacgtggttttctctgacaccaggagggtttaagacatgtcagggccccttggtttatttctagtgcattcccaggtgaggcagatgctgctggctggggactgccctttggaagccactgcaatatttaaagtgaccataccactaccctagtcacgaagcctatcgcccccctccccggaagcttaagcgtcaagacaacggctctggggttaggcctaggccacctggcggcagcatttgcctagttaagaaggcctgggcttacaaatcaccgtaaaggactaaaactgtttaaagggaaaccaaatgccaaatttagtccaagtgcttgattgaggtgtatatagaaggtgatttggataatactgaagtattttaattttctggactgcaaaacagtggcagaaggaagtgactcaagtggctacaccacggttataaataggtgggaataacctttactggtgcttacgaggaaagaaaaaagtcaatctgaagggaggggcgcgacgcgaacggcaagctagcagagaaccatccgagccggcgtccgccatggtgggcgggggacggctgcggccggaacgcagacatgcgcttccggggtggggcctgccgcccgcaagcacgctcacctccgttgcgcctgcgccgtggcctctccggattctgttaacggtagtggtggcttgttgggatccgttgagtgatgggagagtgtgctctttaacttcggagagagatgcgctctcgtgtagccgtcagggcctgccataaggtctgcaggtgcctgttgtctgggtttgggggtcgagtagatgcggggcagccggagctgttgacggaaaggagtagccccaaaggagggcatgtgaagtcgcacgcggagctcgaggggaacggcgagcacccagaagcccccgggtctggagagggaagcgaggcgctgttagagatct

SEQ ID NO: 1386 - DNA, 911 bp, Homo sapiens
gcatttgtttagcgctttgttctccttgaggcagtaaagtggtggcacctgaccggagcatgtagccacctatgacttcctgagtggggtggtgtggggagggccctgaggagtctgtggtcctaggccttggatttcatcagggctttcctgctccttctggttgcctcagtcccaggcaagatagggtcccagaatcttacagcccagaggccacctgttgcaacttcttttttacagatggagtcatcagaacccactgtgaggaagtgacttctccttgaggtcacccagacactccaaacagagcagagcaaaagcgcctagaacttgaaattttggacctgtctccaacaccctggggatttccaccaggaaggtgagcacccccactgagaattccaggctgctcagaggtgccagggaacacagaccagggaccagctgtggccccctcctccgatgtgcccagggaagtgggggaagccagcggcagcctgcgattctcaaccaggggaactctcactgtgctttctgagagtctgtgacacgggtcattttctctgacttgctctcttgctttttctcactctaaaaaaaaaaaaaaatgactggacactcctaaagccttcagtcaccatccaggggatttttatcgccacaaagggtaattcctgctccatccctgctgtgactcagctgtgacgttgaaccacacaagccagagagaagaagataaagtcatcagagctcctactcaccagagagtgaggcccaggccaggactccacaaggctggtcccctgccctggagcaacttaaacaggccctctggccagcctggaaccctgagatggcctccagctcaggcagcagtcctcgcccggcccctgatgagaatgagtttccct

SEQ ID NO: 1387 - DNA, 938 bp, Homo sapiens
atatgtccatgctctgctccacttctgccccttcactctgcccccacacatcactccagactggccttgtggtcagagcctggaatgcctgggctgctgggggcctgtggactgcactgggccagaacccctgccgccttcaagactggcctgtagccagcaggtaggtgacttttcccaggccggcctatcccacctttcccctccactcactcacctcccttgcctgggtcaattagagaaagcttgtcggccaggcatggtggctcatgcctgtaatctcagcactttgggaggccgaggcgggcggatcatctgagctcaggagtttgagaccagcctggccaacatggcaaaaccccgtctctactaaaaatacaaaaattaaccggatgtggtggtgtgcacctgtaatcccagctactcgggaggctgaggcagaagaatcgcttgaacccaggagggggaggttacagtgagcggagatcgtgctactgcattgcagcctgggcgagagagcgagtctccatctcatataaaaaaaagaaaaagaaagaaagaaagcttgtctgttggcctgccctgcagggtggagttcagagggaaggtcaggagcctagtgacagctcaaaaaaaaaaaaacccaaataccaatgttggccccttttgcctttcattcatgtgttttctatacactaaactcacatattgggtttgcagatcactccaagcttggctggagctgtggtggtaaggagggtaatagagaagcttccccaccctcaaccccaccccttccttcctggagttcccagccctgactttagatccctcccacactggaccttcaaaaccctcagggcagagagcagccctacactccctacaccacacccatactcagcccctgcaggcaaggagagaacaggtcaggttcc

SEQ ID NO: 1388 - DNA, 1031 bp, Homo sapiens
ccctgtgacctgtgagttctgtttcttctgaggtggccccagggctgcttagcaggcaacaaagggtgacgacattgtgggaagcccattgattggggtccctaagggtgctggggccctcgctcacaacggcagcagaatcaaggagcagagaaggcttgcggccccagtgaggtggagggtggcggtcacagccctccacaggtcatatagttcccagtcagcccacgaggcaggggtgggtggtgcagacaccctcctgtgtcctgtctgactgaagttccagaacagcccaggaaattaaagatgcttatcccgtttcacagaggatctcacaggtgatcgatctctggtcatgcagccaggttcaagtgccctcagtgttgtaactcagttaacatgcgcccgggcaggcgaagtcagggttggccaggtggcatgccagcaggtctcggggcagcagcgtggtcccctcaacgctcgggccccctgcctcagctgcccccaagtcaggattctgttgggtggagacgctctacggtgtccatgagccccatggttagatgctggtggaagcttgtctgtcagcctgctcctgggacagccataagcatggtgtggccaggggaacccagaaatggagagggctgcagatccatttcacagaggatataatcattaaaaagcagggcttttatttcatgtgactttctttcattctcctagtaatttcattttattatatttcgccaaagtgttggttgatgttagaccagaaatacagggcgtaagaatcgcaggctgcagcaggggtgccacaagggggtagcaacgtcccacccagctgaatagttgtccctggacaggccagcaggcagcagagttgcagtggattttcccttccttgccatttcctgtcggccatttcctttcccttcctttgccatttcctttcctttccctgttgttctaaattcggcattactagtgcatgcgtgcatccggggaaaaggaacaaggtgggagaagag

SEQ ID NO: 1389 - DNA, 982 bp, Homo sapiens
aaggcatgttttacagagaagcgatcacaacgaggaaacgaggtttgcaaaaataagtaatttcagaagagaaggaaaccagcagattagttttgtctgcgtccgtcacgtctgagtaaactaagaaatctgaaggtagatgtgggagtggtgtttataatttcccttacgtaagcacggctagaacggaggcgacgggcactggaatttagaactcagcatttgaaaacactttgtttccgtgccataaaagagcgccaaaatggggctacaacggctaaagaatttccaaaaagttccttgtgcaaaataaaggagtcgggggcgcagtgatcggaggctttccgtcctttttcatcccccgttatccaggcggggtccctccctccagctacggacttgggagcccatgattgcgaacccgcacaccttttccagcctccctacgaagcagacaggcttgtcgatgaattgagctagcatgccggcgttgatgcgcgacctgggcaagtccatcatgtccaccatgattatggtccaagactgcggctggcgggaaacccacggacgactgaaactgtgcgccccgcgggtgtctatggggcagatttctcggcaccaatcagcgaagactagcgctccagcttcgccaattaaatgcgcggaaacctaaatcgcaatcgcgctgtctctgaaaggggtggagaaggggctggatgagtccggaagtggagattggctgcttagtgacgcgcggcgtcccggaagttgacagatacagggcgagaggcagtggaggcgggacttggataggggcggaacctgagactacctttctgcgatcacaggattcccggcggtgacttgaccccggaagtggggtgtgaagctccggtgctggtgcggcgggggactgcggggccagcctcaggtacctcgtctcgcgggaggcgccgcaaccttactgtttccccattcttcc

SEQ ID NO: 1390 - DNA, 910 bp, Homo sapiens
cggtgctgttcttaacaattcaaagcagttccacatccattgggccagaataaacatttcctggctgcagttgcggggactggtcaagagagagaaacaggctaacgaagggtttataacaacaaaaaaatgtgaccctccagtctgaattctgaagtataatcccgcccagaccccagcagtaatagtggaaaagtgcaccacctgcgaaagaaccaaggaaacctgatgctagtgaactcggattaatcacttcctatttctgggtgttagttttttatgtataaaatatgagtaactatgcccaccttgcgagtttagggtgaacaccaaatgaaccaaaggatgtgactgtgcttcttgaaaagcactgccccaatatttgtcattcggagagacacccaagtggcctcggtggtgatggtaggggagcgagctcctgccactggcctcactgcgacttttctccacccttccagtccagtcccaatccccgtaaaatacgatgagtgtggtgggacacagcgccgagaatgcagggcctgggaacagaggcgggagggctcacctgaacacactgctggtagcgcttgaagaggtcggtgcacgggtccccggagctgtcccccttgagaaatttctcggcgaaccagcgattgaagcactggtcgtactcgcgcttcatgtccgtgcatgcctcccccacactgttcatggcgacagtggtggcggcggcgacgacggcgcactctgatgtcatcactctcaggcgcgtcgctcggcgttacgcgcgggcgcactgcgggggccaaggaaggaagaaatgtggtcgcggttggtgtggctgggccttcgggcccctctgggcgggcgccagggcttcacctccaaggcggatcctcaggtaaag

SEQ ID NO: 1391 - DNA, 1078 bp, Homo sapiens
ggtctcttgggtcaagttttcctgaacttgcctggtattgggcaagttcacacagaaaatatgagtcatttcacaaagtcctgggcttgtctatctacttgaaggaataggaaatggacttcacttggagcatgatggatgaggcttgggcttttactaatgaaataagtttcaatcttaactcagttaaacctttaaagacaggagaaaactatctggggatggattcaggccagtgagatcacgttgcacaaatctccccttaagggatctttactgacctagaattgtttcaaaataagattccaaactgtcgagggagtttgaagccttgaaacttggtgtaggtttgcttaaaacaaaataacgaatatactacatttcccaggaggcttcgcggtgagcctccgcactcggctggttctctttaccgcgaggaaagctgggaaatgtagtgccacaggcaaccctgcacgtgacgcttgcggaggaaggggagagagaggcgcgcgggagggcgtctagggaatcgaggtgccggctgctccttcctcacaatttggtttgtgctgcaaggggagggtccccatcatctggccccagtggtgtaaggagctgactgggattcagtcactgacttggagccgctcgggggaagtcccggtgggtgaggttccgcggcgcctggtccagtttctcggcagtcaggccaggagggggtggggaaggtgcgaacagccgggggctcggagctcgcgccctgcgccccacccaggttgcggccgcccggggaggaagcgcgtataggttgagtgcaaagtttccttttttgctttctcgtcagagcagcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagc

SEQ ID NO: 1392 - DNA, 831 bp, Homo sapiens
tagaatgtgtgctcagttacggccataaaagtatcatagacagggaggtatgctggctgcccacgttgggcctgatgcaggcaccatgaggatcaaggtgcagaacattgatttctgttggctcacactgatcccattagtaatttgaagccatctgacgctagtggtatattttatttatttatttattttttagagacgggtcccgctatgctgcccaggctggtctcgaaatcctgggctcagcgatctgctcgcctcggcctcccaaagtgctagggttacaggcgtgacccaccgcgccgtgaagtattagttttaaagcaattgttttagtggtcgctaacagggtacatgctactgtgtatactgattccctcacttttccttgttcacaagttgttccttgttctagagttcaaaaactatcagtgagtggggacaacacgccgacggcttcctttcatccgccacagcgggctctggttccctccctggcgcctgcgcccacgatggtcgcgcgcgcgacacgcccgccctttccgcctgctcgccccgtgcatgacccgccccgcggcggagacgcgctcgctgcgtcatcagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacggtaagacgcaggagggagcggactaggtgacagggccgttcctgtgagcctcgcgggcgcctggcgatgcccccttttcctgcttgtttgctg

SEQ ID NO: 1393 - DNA, 945 bp, Homo sapiens
agagacaacgggtgcataaagagaaagtacaccaatttagggttatgtcctaaaaatgtataaagacacaaaaaggccttgacatcttagaaaacaggaaaagtaaaagagcaaatagaaaccagctaacagtagcaagtgaaaagcacatggccaacccccacccaccgcatttacaaacaacaggaaaatttctacaaatcagtttctatggtttcactcagttcgcgatcttaaatccccaaaccaaagcctaagcgcgctccgtgtaaaagcggagggggtttacgcaccgacaccgggtggccacctggttcccgcttgcccgctcgccggaagtcggcccaccgggaccggcgcgggaccagcgcggcaccgcccctcactgccccgccctacgacggcttccctgccccattggtccgcgcggccctgggtctccgcggcgagaatctagtctgattccctcccgccctgggcgctgcctgactgctccccagccgagacacccaagccttagcacgtttataatgtgacagtggtacggggtgccacgcagtgtttccaggagcgccgggggggagcgccaaaatgctaaacccattcttagccaattgtgcgccgctcacgagtcagagctgagcagctaccgcggaaaaatctcgtgacacgcctgactcctgatgagactaaaatgcaccgggctttgaatgccggtcgcttaggacatccggcctattgctaaaaaaaaaaatgaggctggttatagaacgcactggggaagacacagggcaacagcgagttcctcctctcacatgccagtgggggcgggggctgaaaaattctctcccggatgcatatccctgtcgaaactgaacttggcgccacctgagagcgcctgaaagccgtgtgttaaacaccgggttgcccttcttgctcttcttc

SEQ ID NO: 1394 - DNA, 907 bp, Homo sapiens
aatccggaagaaacagttgaacaaatcattttgacgccttttataaaccacacaagcttattccaaacccgttactggcctaactgatttaagtccctttcccatctgatcctcagagattctaagggacttagcctatccatgactcttcgtcctgcttctcacctcccatgattgccctaacgatgtgaaagtgctttcaaacaaagatgcccaagaaagaaggtaggcaaatgtgcaagcattagtttgtagtacgctattactgtatttcaccttgcactctctagtttccttcgtgctccctcaatatccaactcttaataaattcatggctcccggtgagcattcatcaattctcattccacgcctttagcccttcccgttcccgcccaactctcgctccctcccctggccaaatctctaacctgcaaggctaattccgaattccaaatcggaagcaagagggcggggccccgtgagaggcgatggattgctccagtccgttcccgacgcactgtgcgcatgcgctggtcctccgcggaccgttcgtgctgcccgcctagaaagggtgaagtggttgtttccgtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctggtaagtgcaggctctaatctggccccgttaattctggggcctcttgagagtggggctgtcttatctctatctccaaaaatgtgcaggtga

SEQ ID NO: 1395 - DNA, 1061 bp, Homo sapiens
ctctccgatcttttccaccttttggaagttctccatgaagcgccagcgagtcgggtcagcccggccctggagcgggggcctgggaaccctgcagaaggcggaccctggctctcgggggccgaggagggggaaacagggcccagtaccgtggccccgggtcgggatggaacgcagtatacctctcgctcttgtcaatttggccaacttgaaacaatgttgccgcctcccaccgagttcccgaccgccaccagaggccccgcccctgcttcccgcgtttccctggctccgcccccaggcctttctattggtcaacgtcagagccggggggcgagcccagcgctcctccccgcaaatgatcccgccccaggcaagtttggttcttgggggctagacaagtttcttccccggtggggcggctgaacactcttcccaagtacctgctttgggtccaagtttcctacctatgtctctagtctgtagggatttcttgatttctaactcactattttcaccaatcctggggaaaatatgtatcgacctaaggttaaattccacctggcccaggagcctcctttggaaaccaggaagccgggaatctcgttgcaaaggaatcctgggcctcagaggagtcgttgcctctgcctcatagcataccccgacactgtctctgttttgggatgcagggttctgtttctgtctttttgagaagttcctggtttaattcactctcccatgataaactgttgtgtctggtatgtgttacgcagctgcctttcagttagctcttgcccgggagtgcatcaagatgagagtgacccagtgaaaccagaaactgtcattgagtagcaggatgggaaagcaatgtctagggaccaggatccctttgtcagtttttcctttttcctctcctccggcccctcccaggccttctctgagggagaagaggaagggctatgcaaatgagcacccttttcttatataggggcctatcccagtccccccagtgcctttggttgctggagggaagaacacaatggatctggtgctaaaaagatgccttc

SEQ ID NO: 1396 - DNA, 896 bp, Homo sapiens
aactcctgagctcaagcaatctgcccgccttggcctttcaaagtgtgggattacaggcatgagccaccacacccagcccttctcctcttgttataagggcacccatccctggactagggcccaccctaatgacctcaacttgattacgttggcagagacttattcccaaatgaggtcctacttacaggtactgggggtcaagacttcagcattcttttgcggggggccacaatcagtgacaccctgactcgcaagcctcaatcacctgttccagtgagaaacaggactgagatcagaaggaatgaggcagagctgccctcgattggttctcctctcctcctcacctgcccaccccggcctctgcgcccgtcactgtcctctccagctgttcttccttccgggcaaggagactcagcagaagggtatgagtggcctggccctgtggggagccgcagacaggcctgtgggtgctttggataactactgcgcctgtcaactctccttggtagtctagggttcaaagcccaggtccattctagaagtctgcttccaagtgctaaggaagcttcaatagttactgggaaaaccacaggggtcaaaggtccgtcgagttatttcccggatccgagtctgacgtcttttccccgccgcttgcggtggttgtgaccgaaccttgagttttggaacaggtcacatggctttgaaatcacggtcaattcacctggtgctgctttgacttcaggctcttccttctgcccagctccgtcccacccagcagcccgcagagaaaggaggcagctggcaccacactgggctttggagacactgcggggactgtggaccccaccctgctgcacggagctcctgcaaaagcaaacctgagaaccttggtgagt

SEQ ID NO: 1397 - DNA, 968 bp, Homo sapiens
gccgaacatgtctcttctacacaattcgggcacaagcctggagccgggacatagcagaggaccaccggcgcctcctccagctctgtcccaggtgggtggggcctgaggagggaagatgggtaagggaacaggacactgtgagaagtaggagggatgctcctgtgggagtccggaagggaaagctgcagccaggacatgagggggaaggtgaacgtaggtgagaagtttgtgttaattgggaaaagttgggtcagggaccgaacaggggtgattgggagctgatctgcacttgaatggaggcctctgggaaatcggtgccattaatcctccgccatgcactgtttgttcccagactgaacagggttttgcgccacgagcagaattttgctgaccgcttcctccctgatgatgaggccgcccaggcactgggcaagacctgctgggaggccctggtcagccccctggtgcagaacatcacctctcccggtaaccatgctgacacctggccccactaaccagttccttgtccttattcccagggatcacctgagttaatgctcttggttcttttggttcctgtctttatccctgaaggcctgtcacctcagtgttcctctctccttcctgccccaggcactgctccctgagactctggtatttgaatctttcccactaccccatccccaccctgttaacatttcccctgactccagctgaaacaaaccttggtgaggggaggactagggccccactacccctcaagcctttttgtacaattgatctttctccctcctctgccctgagctgtctgttctcccatctcccatggagacctgttcctgacctgtcttctttcagatgcggaaggcgtgagtgccctgggatggctgctggatcagtacttagaacagagagagacctctcggaaccccttgagtcgagcagcgtcctttgcttctcgagttcgt

SEQ ID NO: 1398 - DNA, 1036 bp, Homo sapiens
tccatctcagaagaaaagaacgctgatacatgttatggatatctcacattcactcattgatttaacgaatgttcactgaacatttactctgtaccacggctcatctgattctcacaacctctctcagcattatccgcatttttagatgagaaggctgaggctcagatttatttgcataaggtcccacggatagcaagtgacatagctgaaaattcactggttctgactctggagggtgtcgggcaagagtcaggggttgcgggtctccagagggctggtccaagtggggctcacctgaacttggtgtggctgggagccgcgttctgttcaactttctgcttggccgcagcgtcttggagctgtcgagcgcctgtgcagatggtcccggccggcgttctggccacgaccctgctgggaagaaaagctcggtgagggccacggcctaacggtcactggggcccgggtggctcaagggacacgagtaggagcatagtcctggaggtggcggtgggctcgagggggcagtcatttgttacccggctgtctggggccaagtccaggaccgcaggaaccgcgaccccgcgtttctcacagcctgcatgacttgaattgaccccagtcagtttccgtctgcagcgacagtcacagctgcgccggcgccggtaccatgagtgcctgtcggggaggggacagaagggaaagtcatctactcttcattaggtccactgaatatttttatttccatttaaatgctcaataagactttcactgtagttcaccaggggattctttcccttttttaatgttctgagatggtgggtcaccccctccatatgcgaatggttcgttctagcagttccgggactgagctttcccctagtttgccgctcccgcggctgagggatccctgggagccgcggtgcattgtgggagaacgaaagatggcggcgcccgtaaggcggacgctgttaggggtggcggggggttggcggcggttcgagaggctctgggccggcagtctaagctctcgcagcct

SEQ ID NO: 1399 - DNA, 919 bp, Homo sapiens
ggaagaatggggaaacagtaaggttgcggcgcctcccgcgagacgaggtacctgaggctggccccgcagtcccccgccgcaccagcaccggagcttcacaccccacttccggggtcaagtcaccgccgggaatcctgtgatcgcagaaaggtagtctcaggttccgcccctatccaagtcccgcctccactgcctctcgccctgtatctgtcaacttccgggacgccgcgcgtcactaagcagccaatctccacttccggactcatccagccccttctccacccctttcagagacagcgcgattgcgatttaggtttccgcgcatttaattggcgaagctggagcgctagtcttcgctgattggtgccgagaaatctgccccatagacacccgcggggcgcacagtttcagtcgtccgtgggtttcccgccagccgcagtcttggaccataatcatggtggacatgatggacttgcccaggtcgcgcatcaacgccggcatgctagctcaattcatcgacaagcctgtctgcttcgtagggaggctggaaaaggtgtgcgggttcgcaatcatgggctcccaagtccgtagctggagggagggaccccgcctggataacgggggatgaaaaaggacggaaagcctccgatcactgcgcccccgactcctttattttgcacaaggaactttttggaaattctttagccgttgtagccccattttggcgctcttttatggcacggaaacaaagtgttttcaaatgctgagttctaaattccagtgcccgtcgcctccgttctagccgtgcttacgtaagggaaattataaacaccactcccacatctaccttcagatttcttagtttactcagacgtgacggacgcagacaaaactaatctgctggtttccttctcttctg

SEQ ID NO: 1400 - DNA, 939 bp, Homo sapiens
aggcacatttgtggactaggtgtgagtgtaagctgggttcgatggtcttttggccaacatagtgaacccctgtgtctactaaaaatacaaaaattagccaggcgtggtggtgcaggcctgtagtcccagctacatgggaggctgaggtgggagtatcgcttgaacctgggagacggaagttgcagtgagccgggatcacaccaccgctcaccaatctgagccacagagagactgtctcaaaaaataaaccacaaggaagggaggtagggggagggggagggagggaggaaagagaaagagagaaaggaaggaaagagaaagcaggaaggacggaaagaagacgaaagaacgaaagaaaacgaaagaaaaaaggaaagaagagagaaggagagaacagaaggggcaggtgcccctgggaaggggagaagatcaagacgcgcctggaaagcggactctgaacctcaagaccctgttcacagccaagcgcgcgaccccgggaggcgtcaactccccaagtgcctccctcaactcatttcccccaagtttcggtgcctgtcctggcgcggacaggacccagaaacaaaccacagcccggggcgcagccgccagggcgaaggttagttccggtcccttcccctcccctccccacttggacgcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcctggacacataaatcagcacgcggccggagaaccccgcaatctctgcgcccacaaaatacaccgacgatgcccgatctactttaagggctgaaacccacgggcctgagagactataagagcgttccctaccgc

SEQ ID NO: 1401 - DNA, 904 bp, Homo sapiens
agatccagttttccatttttgggggtcatggtgagacatgaaacccaggtttaaaacatacataaacactcatgcacacaaatacacactccaaccattttcaagcagagatttatagagtttttaacggacataacctttttggagcctcgtatcagcccagcgccttaaatacggctgtttcttttgcagaatgagttcagattaggcgaggatatccatcaccatttttcagaccagctcgcagcctgggggcagtggttcaagcacaggctttggagccgaaatgactgcgcctgaagtactcttcttccacttccccgctgtgtgaccctgggcacgttacctagctcctctgagcctcactcttctcccccataacatagggcctataccaaagttcaagggctattgtcagtattcaggctactaactgaaggaatcaaaatctgaacctgggttcccccgactccaaaacccgtgctatattcaccacaaatgcgatcaacacacaaggcaccaggtcggacccaggcacatacgtggcgagaccgcagggagcagcgctcgctctgcgtcctcccttcctcccatatcccaggtctcacctgctccgggccccgaaggtctcaggatgctgtggctgcacgcggacgccagccgccctaaggtgaccgtcagggaagatgctgccatggccgcagcctcggccggaaacggaaacgacgcgaaccgcgtgcgtaacgcacgggcccggcggggaacaccggtccgctgtaacaccggcccggcgcagaagcgggacgtcggcttctaggggcccaggccggcggcggcgatggcctcggcagctgtggagagcttcgtgaccaagcaactggacctgctggagcttgagagagac

SEQ ID NO: 1402 - DNA, 947 bp, Homo sapiens
tctcccttacactactccccacatatcaacgtttcattggtcacttcattaacataagtttggactagtttaaagtagtgaggggtaactttttacttcgaacactgaaggctgctaactttccactttagcaatttagctagtcaggttttatcatctgttctggaacaagtagatgcacttacctattgtgaggtcgtggacaggctggaaccgcttatctgtaaactgcaggaggagacatgacttccccacacctgaaagagaaagcacactcccggaatcacgcagccctggaacaccttccagagtatggacttcccggaccagagaaggggggctcccgagccccgcccccggccgccccgaaccgccccgcccgtctcgaatcgcccagcccacaaagtgagccccgcccccgccacccaatttgggagcttcgaatgcccgcccgagccttgaaggcgaaccacctgagggttacctgtgtctccgatgatgatatacttgaagagataagcataagtcatggtgtcgcgtcctctgggttccgggtccgcccgacttctatagccacttacctccgacctctctagccactcaatctaccgatcttcttcttctcccccttccccccgctcccccgcccctccggctcctctagcccagatcacgtctctattgcactccccggaatcatccttaggtcgggagtaccctacgccacctccagggacgcttctagcacttctacatgcccttatccctccaaactccagggggcgatagcccagcgcctgactctctgcagccccacggcgctccttccaatcagcagagagaacacacgtccttgcggaagtgacggcagttccgagtccagtgggggcggtgggagcgatgagggtctgagacggtgggagcggttgtgtgaagatggaggtagg

SEQ ID NO: 1403 - DNA, 910 bp, Homo sapiens
ccctctctctgctgtcttgcttaaagtttcctttctttttcttttcttttttttttgagacagggcctcgttctgtcaactaggctggagttcagcagtgccattagggttcactgcagtctctccctcctgggcgcgagtgatcctcctgcctcagcctcctgagtaactgggactagagatgcatgccaccatgtctggctaatttattttctatttttattttttgtagaggtaggagtctcactgtgttgcccaggctgctctcaaactcctggcctcaagtgattctcctgccttggcctctcaaaacactgggattgcaggcgtcagccaccaggctggcctcttcctttcctgtgtttgctcctgttctcctgtcctcgacttctgtgaaagggtgtgtgtgatttggcccggatctgctgcaggtctcttctgacgccgctttcgtgtctcagagcctgaatgttcagagctttgctcaccgtgaagtgtggttcttgttagctgtgtccatttggtgcccgggagggaagggcgcccggcccctgaggggttctccggggaaggatgacctcgtccccctggtcctgccccctcagccccctgcttcccctgtgcaggggacttggtgacaggtaccacttcctgcagctgggctggggttgcaccagcacttccttctcgggcagggttgaggtcaagggcgactctgatgcaaggttctgagaggcctgtggggctgtggattcctaagcagcctcagctttgggttttgcaccttaggtcttggtaaggggacccgcccgcccttagatgggggatgtccagagctggaggatgaggagggcacccgcccctggtgtggggcagcagggagggccttggagaatgaggagggcacctg

SEQ ID NO: 1404 - DNA, 1077 bp, Homo sapiens
agtccccttccatctttatctcgagtattttaacaaactagcaagtgcatcagtttgagttcgttttaattgaaacatttaactatcagaacggctgacagatactacaggacactaggccccgaataatcttattaatagatccagacccccaagcggtctgaagctcgcaataataaagaggatttaagattaaccaagaaacggccgttagagaccctttccggtcataggcaccggccggcaaaatccgcggaggcgagagggggaggggatacgcggcggcggaggaggagctgaggaaggaactaggcccgtccctggcggacaaccgggcctacgagtagctaaacggcaggggggacccaaacaggggagaagggtgaacatcttaactcggttctgaaacagggagtcttgggttacctcggaaaaggcgaagttcctcgagggaaaaggaagggagcggctgggggggcggttggggggggcccggaaaatggatcccaggcccaggcggggccctagcggggcctgagccggggaacgactgcgtctccgaagaaaggtgccaaagaaggctaggtgagggcctaacggtccgttgggagcagaagaatctgggaggcgtttacctggaaagctcctgttgaatttcccggaatttactgaccacgaaagacctaaaaatctgctcgatgttggtcgccatggcgtccgctccgttctctcaactcctcctcgctagtcctccaggctcccagcatgcctcgggaggaggcgcacgggccaattcggtctctcgccttcctgattggctccaaagggaatgcccggtccggcccgctccaccgagggaccaatcagtgagcacggccctgctctcctctgctgtttctgagcggctggggtagaggtgctgacgtttgcgccgcgcacgactatgtccgccatgttagtgtctgacgcaggcgccattacaggagccgtctctcttgaggcgaccgtgtccgcataagttgtcagtccccagcagtgtttgggagccttaacaggcttgctaagtgcctgagatta

SEQ ID NO: 1405 - DNA, 904 bp, Homo sapiens
agtggttgttggctcagagaaagcaattgaagcctcatgctgatagcaagagatgtatcagatacaggaggatgcctcaatcagcattctcagctgcagtcaagaaaaatgaattgtggcctatgtaaacagaaaaggttggcgggcatggccagtgcatggcccaatcacaccactagcctgggctggtggtgacagttctgttgccatctccatcactggacaccatgccagtccttctcatgtcagaactacatactgctgccatccaacaccaagatgtgtgctttccatttgctgtgaggccttgagccagggccggggctgcgagggtagctggggtggagggaacactcagcacctagaaaacgagtgcttggcgttctgcttggtgggaagctgggaatggcacccaccgagactcataagggacaagagttggaaaacagggaagaatgaatgataggaggccagaaaaaacagtcgagctttgggagttgaggcaggcttattgaaaaggagcatttcactccttttggcgagatttctcagagctggggcactggctcatcagcctagggctgtaggcggaggtttgcctggggcaagcggcgggatctgcgggcaagggggccattgtgttgctcctgccagcagtcccagctcccatttttctccctgctcagtccgacacccacccgtccgactttcttaggcaaccctagaaggctcctggaatccacttccgctctccacggcctggggcttgccccacctcccggcatgccccgggctgccctgcaggacgccccccgcgcagtgcatggtggggtagccagccggccacctttgggccatggcagccgaaggtgctgtgtgcggcttcgtctatctggagggcact

SEQ ID NO: 1406 - DNA, 926 bp, Homo sapiens
acgcgtgtgggtggggcccgtcccacacccctagatggggagccagcgttgaccctggtcgggccgactgtgaggtgacactgtactgttatttcacatcctgagagtcttttctcagactgtaagctcttgggaaacaagagctgagtccacactcccttcgtatctccctgctgccagcagagagctgggctctgggccggagctccacaggggcaggggctctgcctgtccctcatgcagcgccctcggcgcccaggacgagtgagcaatggacgcagatatggcccgccctgacccacactgtctttcttgcccctcaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgatt

SEQ ID NO: 1407 - DNA, 944 bp, Homo sapiens
tggccagaagtctaaagaggatgtccatggcccattgaagaatttcccacccctgaagttgagctcacctgaggattcacctcatccaacggggacaggcttgaacagtggagagggaggacagagctgccacctctgcagcccctcgccagtcccaacctggatggcttttgcctcgattgacttcgtaaaatgccatttgtagggcttggctctggggatggcacagacagacacacacacgcacacatacacgttgccacacacagacacctacaccccatgcagggatgccagatgacagaacagaaaaggcctccctttcatccagcagccttctgactccagaggagagtctccgagccacgacctgctgtttccctggcaactcaggcctcaaaataaacaggattctgctcagacgggccagaagtccattcggctcacacatttgccccaagacaaaccacgttaaaataacacccagggtagctgctgccaccgtcttctgtctctacctccctcctggctggccaatggctctgtgttcctgggcctgctgctggctgtccagagtaggggttgcttagagctgtgtgcatccctgcgggtggtgtgggagtgggcggttgtctaaaggcaggtcccctctactgataaacaaggaccggagatagacctagaggctgacattcttggctcccccagcctacaccccccccacctcgatttcccacagagccctagggacgggtagccagctctgtggcatggtatctggaggcaggccagcaacctgatgtgcatgccacggcccgtccctctccccactcagagctgcagtagcctggaggttcagagagccgggctactctgagaagaagacaccaagtggattctgcttcccctgggacagcactgagcgagtgtggagagaggtacag

SEQ ID NO: 1408 - DNA, 970 bp, Homo sapiens
tctgggctcttacacacacacacacgggtgtgatggtgttgtctccacaccactgcggcctcacacctgacgttcaaggggctcagacaagagcgtctatgaggttctctccagctgtcagtttagggcgggctgagccgtagttgcatcatctttcaagctgtgcgacttagtgcagttgtgaaggtcagaggtaggaagcatggtccttgctacagatggtgaccatgctcacccaagtccattcaacacaaactcagtgagtgcctgtgatgggccaggctgtgtcctgtgttcttgggagacttcagccagtgaagtgcacaggtgcccggcgtgtggggaggagaggtctacggaagcaaacctcacaggaggtgaggaggagggggtggaggcggctggttgtgtccagtctgttgatcgaggcagggcccatccagtcagtggggagccacacagatgtggggagagtgctccaggcagaaccggcaggctgagctgaggctgagagcatgaggtggggttggcagcactcaggaggctgccaacacagaggccccgtggcctcagcagggtgagttgtggaagaggcctgagtgacgcgggccttggatgagtccgtggagagctgacagggctgctggccgctgtgctgggtgtggaccgaagggcgctgagggtgaaggcagagatgaggcgttgagggggaggttgagcctttacagccatccacagagcgatggcagcactggcgggctgtgggcagagcctggacagttctttggtttttctgttgtttctaatgcttgcttaatgttggtctctttcagtgtctttggtgcaacactaacaaggcttgtctggactacccagttacaagcgtcttgccaccggcttccctttgtaaattgagctctgcacgctggggagtttgttggggtaagtcattgttttcatttgctgcttg

SEQ ID NO: 1409 - DNA, 916 bp, Homo sapiens
gcggcaaatagcactttttcaaagacaccatccctcaacactcctgacggcccttccctgcttcctttttctacttgaagtttcgctttgtattgttactgtgttctcctggtgtgtggtctgccacagaccagagtgtcagtcccatgaaggcaggatttgtatccattttgctcacagctgtatcctcatgcctacaactgcaccagtgcctggcacaggggagactctgtggtaattgctgaatgagtggatataagaataaatggggccaggcgtggtggctcacgcctgtaatcccagcactttgagaggccgaggcgggtggatcacgaggtcaagagatcgacaccatcctggccaacatggtgaaaccctgtttctactaaaaatacaaaaattagccgggcatggtggcaggcgcttgtagttccagctactcaggaggctgaggcaaggagaatcgcttgaacccgggaggcagaggttgcagtgagccgagatcgcgccactgcactccagcctgggcgacagagcgagactccgcctcaaaatatatatatgtatagtccatctcccctggtggttgtgaggatgaattgggtttgtatttgcaggcttcctgagctggcgacatcgtctggtgcaaaggtgggctttttgcgcggcgcctgtgcttccgccttctgccgctcgggggcagcaggcgtccggcggattcgcccgcgcggccgggccgggaaaggagcgggggcaagtccgcaggaggaagctgatgaaatcctggccaactcgcagtgagctcatcccgcccgggcgcctccggaagccacggggccgcccggcctccgcctggcccgagcgataaagctctcgtgccgaaccagggcgggaagtccttcctgaagtctgccct

SEQ ID NO: 1410 - DNA, 1099 bp, Homo sapiens
tgagagaagagaaagggtgatggtaagagctaattcttgggtagtcagggtgtggtttttggatatattaaggccattatctcctcttttcccaggggtaggtaagtaaagccgcctggtgaaggtgaagcagggagactgtaatggaggggaaaaaatgcaggagtagcccccagcctccccagaggggccagtgaggttcaactgccattctttggaaagaggagagaattctaaggtgagggtggggcagtgaagagggctcttcattcagaaaggcgattctcgccggttcccacataactccactccatggagagtcttggacctcatctcagagacctcctttctctccccgagtctgtagtcgcacatttgggggcacgatccggctcagtttgggaagaaagttttccatggattccacaccaccctatactctccccagggagtataagtatactcttcaccttctactggcccccaacccacctctccacttctaaagaagtccctccctgctctcttccggtccctggacggctacccgcccgtggggggttgggggggacaatcaaggaggtccccagttaggagtcccgggtacagaggccactcacgtgtccaggcggattttcttaagcgccaccacctctcccgtcaacttgtttctggctttgtacacaactccgtacgtgccctctccgatcttttccaccttttggaagttctccatgaagcgccagcgagtcgggtcagcccggccctggagcgggggcctgggaaccctgcagaaggcggaccctggctctcgggggccgaggagggggaaacagggcccagtaccgtggccccgggtcgggatggaacgcagtatacctctcgctcttgtcaatttggccaacttgaaacaatgttgccgcctcccaccgagttcccgaccgccaccagaggccccgcccctgcttcccgcgtttccctggctccgcccccaggcctttctattggtcaacgtcagagccggggggcgagcccagcgctcctccccgcaaatgatcccgccccaggcaagtttggttcttgggggctagacaagttt

SEQ ID NO: 1411 - DNA, 1078 bp, Homo sapiens
ccccacctcctactctcacctatccaaagacaattaggtgaatcccttagtagatatctttccagacggttttccatatagattcccatatctggccaggcgcggtggctcacacctgtaatcctagcgcttggggaggctgaggcggatggaccacctgaggtcaggagttcgagaccagcctgaccaacatggagaaacctcgtctctacgaaaaatacaaaattagccgggcacagtggtgcaagcctgtaatcccagctactcaggaggccgaggcaggagaattgcttgaacctaggaggcagacattgtgctgagccgagccaagatcatgccattgcactaaactccgccttaaaaaaaaaaaaaaagattcccacatctttactagtttgcagaaataagatcctagcatatgcagtgtgtaggaaccaccttggtttagccacgtctctgtgactgggggccactgtggtgacccccagctccccggacagagtcaagagctcaccagcctgcaaaggttttcacggcccccagccagactcgggggcttcctcttgccctgctacttcctgggagctctgagggcaggaaatggcgccactcagctcctggcctaacagcttggggaccacaaatgcaaaggaaaccaccctcccctcccacctcctcctctgcacccttgagttctcaggctcacattcccaccacccacctctgagcccagccctccctagcatcaccacttccatcccattcctcagccaagagccaggaatcctgattccagatcccacgcttccctgcctccctcaggtgagccccagacccccaggcaccccgctggcccctgaaggagcaggtgatggtgctgtcttcgcccagcagctgtgggagcaggcgggtggggcaggatggaggggtgggtggggtgggtggagccagggcccacttcctttccccttggggccctgtccttcccagtcttgccccagcctcgggaggtggtggagtgacctggccccagtgctgcgtccttatcagccgagccggtaagagggtgagacttggt

SEQ ID NO: 1412 - DNA, 900 bp, Homo sapiens
atctagtctgattccctcccgccctgggcgctgcctgactgctccccagccgagacacccaagccttagcacgtttataatgtgacagtggtacggggtgccacgcagtgtttccaggagcgccgggggggagcgccaaaatgctaaacccattcttagccaattgtgcgccgctcacgagtcagagctgagcagctaccgcggaaaaatctcgtgacacgcctgactcctgatgagactaaaatgcaccgggctttgaatgccggtcgcttaggacatccggcctattgctaaaaaaaaaaatgaggctggttatagaacgcactggggaagacacagggcaacagcgagttcctcctctcacatgccagtgggggcgggggctgaaaaattctctcccggatgcatatccctgtcgaaactgaacttggcgccacctgagagcgcctgaaagccgtgtgttaaacaccgggttgcccttcttgctcttcttcctcttcgcctttaatctcaggcacttagcaagcctgttaaggctcccaaacactgctggggactgacaacttatgcggacacggtcgcctcaagagagacggctcctgtaatggcgcctgcgtcagacactaacatggcggacatagtcgtgcgcggcgcaaacgtcagcacctctaccccagccgctcagaaacagcagaggagagcagggccgtgctcactgattggtccctcggtggagcgggccggaccgggcattccctttggagccaatcaggaaggcgagagaccgaattggcccgtgcgcctcctcccgaggcatgctgggagcctggaggactagcgaggaggagttgagagaacggagcggacgccatggcgaccaacatcgagcagatttttagg

SEQ ID NO: 1413 - DNA, 1083 bp, Homo sapiens
agtaagtctccctcccgaaacacagaaaaaagctgctattgaaagggcatctcgaatcaccgtctctgacaccgtgtgcgtcattgctctagttctgacttctatcagcgggctagggaaagagacggacgcccctttccccgatagaagagcccaggtacctgaagatgcaatgtacacatggcgtggaaatggaagaaaaagaagacaccgagagttaggagaaatgtggagagaggtgactcatggacagagccaaacctggcagggagaggacagaaaaaaggcaaaagaggcaaccagagacagacagaacactgaagacacaagggtgtaaagggcagagacaaaaggacaatagagacgggccaagattgagaggcgtccagaattttcgggttgggtagggccagagaaaagggccagtattgaagccggctccgaacgtaagcccagccagggctcctgtcattctgggtcctcaagaacatctgggaattctccaactgccgtcggcctggcctgagagtcacctgcacatttttggagatagagataagacagccccactctcaagaggccccagaattaacggggccagattagagcctgcacttaccaggccacagcggcccgacgtagtcgccacatcccgccggcggggaggtcacgcaggcgccgagacggccacgcgggagcccccgtgtgagccccagcccggctcccggtccaggaatgacccaggaagtggccctcagcagcaagggcacagagccgcggccgaggccctcccaatggcgcatggacttccgcaagagcctgacaggcacccgtactcagtccgtcacggaaacaaccacttcaccctttctaggcgggcagcacgaacggtccgcggaggaccagcgcatgcgcacagtgcgtcgggaacggactggagcaatccatcgcctctcacggggccccgccctcttgcttccgatttggaattcggaattagccttgcaggttagagatttggccaggggagggagcgagagttgggcgggaacgggaagggctaaaggcgtggaatgagaattg

SEQ ID NO: 1414 - DNA, 1017 bp, Homo sapiens
aacgatttaagcttgtctcccctagtactggccagtggttcttccccgttacccatccttaagtgcttctattggctgccaacacggaggggttagcggggtgaaagaaccggcgcctccgcagtgtggccaggttgggctaaaaaacgtcttagaagtaatcggatcaatctctcttcttacaggtggagaaagtggagaaagtagagtgacgcagctaagggagtaaatcgaccctcagccaacaagtggcaaaagcctgaagaaagtgatcaagatcactgatgaccccgctgcccatctccaagggggcgggtatcacaaccccgacgccacaccacgtatcattccgcaaaactcccgcgcctcccacgcagaactggcaagagggaaggcgagacagcagtgaacagctggtacgcagcacccacagcaccgcggcagcagctagtgccgactcccgcctagctcttttgactctgttcgcgggaagaatggggaaacagtaaggttgcggcgcctcccgcgagacgaggtacctgaggctggccccgcagtcccccgccgcaccagcaccggagcttcacaccccacttccggggtcaagtcaccgccgggaatcctgtgatcgcagaaaggtagtctcaggttccgcccctatccaagtcccgcctccactgcctctcgccctgtatctgtcaacttccgggacgccgcgcgtcactaagcagccaatctccacttccggactcatccagccccttctccacccctttcagagacagcgcgattgcgatttaggtttccgcgcatttaattggcgaagctggagcgctagtcttcgctgattggtgccgagaaatctgccccatagacacccgcggggcgcacagtttcagtcgtccgtgggtttcccgccagccgcagtcttggaccataatcatggtggacatgatggacttgcccaggtcgcgcatcaacgccggcatgctagctcaattcatcgacaagcctgtc

SEQ ID NO: 1415 - DNA, 961 bp, Homo sapiens
gtcttggataggacccatcttcctgagcccccacaagcccccggcacactctgctcattggggcatgaggctcaggcagcaggctcaggtaggacgtggtacgctctgctcagtgggtcggaggtaaggttcattcataccccagtcttgaaccagctcttaaggactgtggaggtgaaagccaggtctgacctagtagcattgggcacgctgaggctccgaacatctggagcctctccctggcatcccccctgggaagccatgcccagcctgtgatgagggcggcaccttccctccgccatccccgagtgcttggacttgaagcatccaggcctttgggggccttattgacttttgcttattgaaggctgcctctggcatttccgtgtggccccctgcatcccactgaaccacgggggtgaggcctggactgaacattcaactccctgggccctgctgcagcgtgcagtgggtgtgtctggggagggtggcttgtctgcatcttgctgtggcatgggaggaaaggcgcctgtggcagtgacgtgccctctcctctgttacgggataaagacagagtctggatcagggtgtcaccccaggatcaccagccacagggatgggggaccacgcaggctggtgcatgcgttggcacagtccttccagaggtccttcagctgcatctgccaaaaagcctgtaatgccctttgacctcataggtccactttagcgtaagcaaatgagaccggccccagaaatgtggtcagctagaggcggagggaggccagagcctgccacccagctgaccaccagtactggtggctccattatgacatatctgcaggcggaacccagaggcccttagaatggccccctgatgcttggttactgacaggatgcagctttgggacaggggagatgaccaagcattgtgcaaaatatcccgttgtataaagcacttggt

SEQ ID NO: 1416 - DNA, 1004 bp, Homo sapiens
catcccaagttcactcccattagccacgggatcatctatttaacagctgccctgagggccaagtcagtggtcagagtgtcctcaggtgaccctccccaatgtccacaccccagacctcgagggacttggagaacagcttctaggggatgaagaatggggcttggaagggtggggttacttggtgagcaataaagtattctcatagaaggggctaatagaaacagcgaggagaacatggctgtgaagaaagaaacacatagggggtgttaattaggaggaggggattcctggggtggggatggagtaagagcgctattctttgcataggagggttattgtgatcccggtaaggaagttacaggaggagaacagacattactgtgggatgaaaagattagtataacggtcactctgaaaaggaagagagttattgtgagatgaggaggccccgcccccgccccccacccccaattctctagtcttcctctttctcctcacctgagatcagggcgggagggattaggtttaagctatatccccgggcccccagcacctgccgggtctctgcacaactccgggtgacctttgcctcgctcccgggtccgggaccaggaccgggacacagaggcagcagcagaagcaggagaggtcgcagcgcggacataactgcagccaccccaggacggcaaagtgggtcctaaggaggaaagcagagcctcccaaactcgggaatccggtactcggccgcgggaccgctccgcgggccagagaaagagcgctgctccggaaaactgaataccgagcacgatagctggaccaggcggcatctgccgagacaatgggagcggggagccggacagggggcggggcccgaggcggggccccgccaataatggctcggagccggcttcaggggcgggggcaaggaagaaattaagccaatgtagcgcggaagctcggcaggggggcgggacccggctggcactcaggaggttggtgaaata

SEQ ID NO: 1417 - DNA, 1081 bp, Homo sapiens
gacaggctagggagaaaaccactggtagccgcgggcaccccacgccctgggagtgaggcggcaagggacaagtctcccgccccctagacttgcctcgcaaatacttgcgggtcgagggcgcgaaggcagcaggatgcagcgatagacttggactaggtggtccaggctctacttccaagtgggccattgacaggcggggcggccctcagcacaaaatcaccaggctggatgctccagggtttcccaacattactcgctcagaagaatcatctggggagctccttaatgagaaagattcccaagcccctcttccagagagtgaagtcactgggattgggctgggcccagccaggtgttactaataataagacaagtttggaaaaccctgcgagtgtagatgatctcctggtatgctctttataagaaccgattttcatattaaaataggtttcttttaactcagtgaaaccgggcgcgttttcctggcccacaaccaagccactgaaggccccagaacacttcactctcaaaaggtcacgtgaggctggcgcggtagctcacgcctgtaatcccagcaccttgtgaggccgaggccgcggactgcttgagcttaggtgttcgagaccagcctggccaacatggcgaaactcggtctctactaaaaatacaaaaactagcggggcgtggtggtgcccgcctgtaatcccagctactccggaggctgaggcgggaggatcgcttgagcctgggaggtggaggttgcagtgaaccgagatcgcgccattgcactctagcctgtgaaacggagcaagactctgtatccaaaaaaaaaaaaaaaaagtcacgtgagccggggtcaccggaggcgtcccccaaccgactgggcttcggaaaaccaaggggcgcacgccgccccgccccgccccgccccgcgactacaagtcccatcgcgccccgcgctcgcgcacactacgccagaacaagatggccgacgcggcggccacagctggggccggtggctccggaacggtaagggcaggaagcgcgggctcggagccgagagagtttgggtatcctgcaa

SEQ ID NO: 1418 - DNA, 996 bp, Homo sapiens
aaacaacccttaaaaggtctcgggggagagcggtaaagaaacacacggtctgcggaaaaggagaaggcctgactggcacgtcagggaacccggcggcctccgccgttgtgggcatgcgctgtacatgcctctgcccgggcaaagaggcgtgtccgcgccattgagtgacgcggcccgttaagtcgtagcccttaagtgagcccggctcgactccctccgtaccagttctcaatcatctctttgatagcattagctggccgctggataacttcccccgccgcgatgcggttcaccactgtctcgtccagccgccgaataacccctgccacgaacgacattttggcgccagaagagccaaggaaacgtctagatgctcaacggaagtgccttcagccaatcacctcagtgcctcgtgctcacgttcttccttcagctgtagcttacgccatccagccccacccttcagcggcagctattgattggacagcttgaatgccagtcaaatttctcaactctgtgggttgctgggtctcttcgtccctccctgaagcggctactgcccgctacctagaaggatatgcgcttgcgcgttagagatcgctgtccgctcttcctattggttcgtttttaggagctcggggaatacgaaatatccagccaataggagcagagatgccggaaccgggcttgtgtgcctctgctgaggtgatctggcgcagagcggaggaggtgcttggcgcttctcaggctcctcctctccccttgcggcctttctaacgttggccctgctcttgtggcctcccgcagaatgtggatgacgcccaaaagaagcaagatggaagtcgacgaggctctagttttccggcccgagtggacccagcgttatttggtggtggagcctccggagggcgatggggccctgtgcctggtctgtcgccgcctcatcgtagctacccgcgaacgcgacgtcaggcgccactacgaggctgagcacga

SEQ ID NO: 1419 - DNA, 969 bp, Homo sapiens
agtattcgtgctcagcctcgtagtggcgcctgacgtcgcgttcgcgggtagctacgatgaggcggcgacagaccaggcacagggccccatcgccctccggaggctccaccaccaaataacgctgggtccactcgggccggaaaactagagcctcgtcgacttccatcttgcttcttttgggcgtcatccacattctgcgggaggccacaagagcagggccaacgttagaaaggccgcaaggggagaggaggagcctgagaagcgccaagcacctcctccgctctgcgccagatcacctcagcagaggcacacaagcccggttccggcatctctgctcctattggctggatatttcgtattccccgagctcctaaaaacgaaccaataggaagagcggacagcgatctctaacgcgcaagcgcatatccttctaggtagcgggcagtagccgcttcagggagggacgaagagacccagcaacccacagagttgagaaatttgactggcattcaagctgtccaatcaatagctgccgctgaagggtggggctggatggcgtaagctacagctgaaggaagaacgtgagcacgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactggtacggagggagtcgagccgggctcacttaagggctacgacttaacgggccgcgtcactcaatggcgcggacacgcctctttgcccgggcagaggcatgtacagcgcatgcccacaacggcggaggccgccgggttccctgacgtgccagtcaggccttctccttttccgcagaccgtgtgtttctttac

SEQ ID NO: 1420 - DNA, 920 bp, Homo sapiens
catatttggggccttttgtatgacaatattgcacgtttcctcagaaaaattcacggagattctttaaggttgggggtttaatctattgatattttccttaggtagacaaagacaacctctaagtgcgctcagttaatctttaaccgctacatcatcgtcacccaggcactaagacataactagggcataatgagttttatttccaccaggggcgcctagtaactaccaggttcaacgctcccaggtggccgacatgtgatgtgctctactgtttgggctggggatattagctcaacaaactctggccacaaggatcacgcggatattcttggggatgcctagcgaaatgcgctgtacctaggcctcgaactctcgcctgctctccggtgggcggtctcgaactccagcctgctctccggcagcccacagcaatgcgcctgccaagaccttaggctgcaaaactcgccacggcccagagctcgcctccaagtgcgccccgcacagggcaagctttcggcgaggactcgcgtcccacccatctagccctggccgctgtcccaactcccgcagttcacagaggcggcggcggtgagcgcagccgatgccacatcctcagcggcaagctgaagaaacctgtctcctctctggggcgaccaaacgatacgtcgatgccggaaccgacccgacgccggagccgtcggctccgtccttaccgttgctctccaggtacacgcccccgtcaaaggcggctctgcggccctctcgcgagagagtgcccgtggtacctccttcctctcagttgtctgtctctccccgcccccggagtgattgcgcggcttcctccagagggcgggaaccttggacgtggcggggctgggtcagtcagggcgctgggcccagcctctctgcaggctggcctt

SEQ ID NO: 1421 - DNA, 965 bp, Homo sapiens
tgtccctaaccttattcctcggtccctgcagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgc

SEQ ID NO: 1422 - DNA, 910 bp, Homo sapiens
acagactctggaccctccatttccccagagtgggagctggaggggaaactgagtcccggtgagctgggcgtcagcgtttctgcagccggtcctgcgcacacacccactcacgggcttcaccatccggacctccctgaggtgatcggaggaagggatgggcaggccagtggtgtgtcttcgggggtgttgctgcacctctctgggtgtcagtttccctctctggaaagagggggtttggattaaaggaaggagaaaggcccctttgggcctggcttcccatacctgtgcctccctcccctgaaatgcagcccgctcaataagaccagcccccagtcatggtgccttcagggagtgatcgctcaggaaggcccccaggaggctacacgatgcaacctgggggtgaaagtaggcagaagagcttcgtggaagaagctgcactgtgtgggatggcaggacttagaaaaggtgctctaggcagggcaactgcacgtgcaaaggcctgagagaagagagcctccagcctctaagtgagtcgcggtgtacatggaggagtcggagcgtatcctgagggcactggggagccatggaaggtgtttgagcatgggagaaatgggatctcacttgtgacgtttaaagctccctctggctgtgcatgggggactgtgggaggccaggaagaggctgatcagaatgtcctcacagaggggtgtcaggagctgggggaggcatgatcccgctgggcagagcttggagggactagcttagtctgatgaggatgcagaaatgaccaccgaatgtggggagagggaaggtgtctgaggcttggcttcggtcagctgagaagaaccacgtgggggaggcctgggtttggggagcaggaggcagacatgtgttgctttgcacgtcatct

SEQ ID NO: 1423 - DNA, 1100 bp, Homo sapiens
ggactctatggagtagggccttaaaggcgatgattaggccaggcgcggtggctcacacctgtaatcccagcactttgggaggccgaggcgggtggatcacggtcaggagttcaagaccaacctggccaagatggtgaaaccacgtctctactaaaaatacaaaaaaaataagccgggcctggtggcagtcgcctgtaatcccagctactcgggaggctgaggcagagaattgcttgaacacgggaggcggaggttgcagtgagccgagatcgagccactgcactccagcctaggcaacacagcgagactccgtctcaaaaaaaaaaaaacaaaacaaacaaacaaaaaaaaaaacaaaggcagtgattagcagttcgggttttgtttccacttacactagcgagagcatcagtaatgaacaaggggaagagtgaagccactgactcgcgaggtgactgtgggcaagttcctgaatcttgctaacactctttaaccccctggaaaactgttcgctaatcgtcacattaaacggctgcgaacgggccacggtcaaggcttcggggctgcagccgcgagtttacctgtcctccaggaccgattccatgggctccaccccgtctgtgtccacggcgcgtagccggtcggcgaaggcgatagctttctccagtcgcgccactgcctcgcggctgccgaagtccacaagcgctagacgctccaggtgctcgatcaccgcagccgtgatccggccactgccctggaggagggatgaggcggggagtgtgggtcaccggcgctccgaagtgcctcccggcttgctccgccacccgcctagatggccctggcctttacctgaggatccgccttggaggtgaagccctggcgcccgcccagaggggcccgaaggcccagccacaccaaccgcgaccacatttcttccttccttggcccccgcagtgcgcccgcgcgtaacgccgagcgacgcgcctgagagtgatgacatcagagtgcgccgtcgtcgccgccgccaccactgtcgccatgaacagtgtgggggaggcatgcacggacatgaagcgcgagtacgaccagtgcttcaatcg

SEQ ID NO: 1424 - DNA, 1061 bp, Homo sapiens
cttaggtgaggcaggtctttgaaggatttgttcttaatcatatgcgagatgctcaaaaggctggatgcctgcttttgtgggtgaagagcaagaagagaaaacaggttgtacacatacagatgcagatggagagacagagaaaaaaaaggaagaaggcagagaaatgcaccaattcttgagctgtattatctctggaccttgggattgtgggaggctttattttactactgattttgcctacactgttttctcaatttctagttttctacaaagatgatgtgttagctttttcacgcattaagattaaaatttaaaacagaccacacaataaatatttcttttaaaaggagaaatatgccctggggaagctccccacgcagctgagagcctggctggttgcatttcggcttcttaggtgccaagcctactagtgccccggggtcccagccagcggctcgcgtttcctcccccttgcgccgccagtctggttgccatggagacaaaccttgctgcgcagagactgccgagccgcaggcagcggagctggaacccggcgagccagcctctgcaacaggctgggggcggaaggaggagccaggcgaagcggcgcctcagctgagaggaccggcggaccctgcagaggccccctgcccctctggctccgcccccacccgggtcgctagaaatacagccgtagccccgcccaccgcccactgcgctctgacccagacccggctgacccacctacccgcgatcctgcccatggctgacgggctctttcggcgcagaccctggggtctcgagcagattcgcccggaccccgagtccgaaggcctgtttgacaagcctcccccggaagaccctcccgctgcccgcgggcccaggtcggcgtcggccgcgggcaagaaggctggtcggcgcgcgggcgggagggcgcaggggggccgcgccgggcagcccccgaaggccgcatcgcgccccccgcccaagaaggaggcgcctccactggacgagggctgctatctcgaccattttccgcacctctccatcttcatctacgc

SEQ ID NO: 1425 - DNA, 1014 bp, Homo sapiens
ttcctattggtcgagagaagtggagccgggggctgattggcttaaactcttaacagctacaaccggccttcgcctcagccccgccccagcatactctccgggtcctcgctggcggtgggcgggccagggaggacaagcactggaggtgtgcccgtagccggacttgcttcagctgtcgatagtcgaggccgttaacccttgcggtctcggtcctgtccactccaaggccgcctcgattgacgacgattagccttctcccagctgcgcttccctcctcccagctgcgcttccctcctccccacgccttcacgggaaggcactcgtcttgcgccagggggtcttccgcccagtgccaccaacgcttgcgcgctcaccgtggataggcgctggggccgcggcctggcgcacgccatccacgaggagcctctggccagtgcaaagccagaaaacgggcattgggggcagcttcccacgctcgtcccgttgacactgactatgtaactgtgacactggacaccttgacctctcagcctcctttctgtcatcagtaaaatggccttaataggaccaacgcaatagggttgtgaggattaaatgagatcgctcacgtaaagtgctttggcaccagcctatcccacactttgcgtcccacacttttgcctttattgcattccttggtctggcgtccggggatggaggagggtggaattaagttagtaggtgatgcgggccgagcaaagaccctccgtgctctaagaagcacgaccgaaatgcggcgacccctctttaatgaacgcccctcactagagagtccccgaagcccagcctcaggtccttctagccgcaccgagtcggtggtaacgaaccatagagtagcggaagtggtccgttctcttcctctcccggcccaagcttctgggtatttctattgcgcgaggcattgtgggttgctgggcggcccggtctcggagaagaggggagagtggcgggccgctgaataagcttccaaaatga

SEQ ID NO: 1426 - DNA, 990 bp, Homo sapiens
gaattctggggaaggaactctgtggaaagactgaaaaggatgctgaaggtggacggccagatatgaaatcatggagggggctccgggaaaaacaggagggttaagggagattatgaggttcgaagacgggatcctggtggaaaagccttctgtgacagaaagacccgaggagacaacgagggcggggaatggggaccgagagagccaagaatggcaccctggcggaagaattctgtggagaaacctggagggagggggtatctacaaggtgggggcgggagacccctaaaatcagcgatctgacttactttctccgctggacttgtactgctttaaacacatcttcacgtttcagcaccacgaagtcgccgtcgcggatgcggtggtctccgggatgctgtggttgtgggcccggctgctcccctgagccctccatgacgctcagccggtcgccgtgctccacggcgtcccgcccctcctcctcggttgtcgccaccgccagcctcacttcccacaacctggcgcactaggagccctccgaccggcaccgcccccacgtgttgcacgccgcttccgctttccggcccagacctcaagaccgcttccggaagcctctcggcttccgtctggccaaactccttgattggctgcactccgccccgcccctctcgtcttgccgcttctttgagcggaagttggatcactgaagcgccaaaaaagaatttaggggaagacctgattttcgcttgaggcatttttgcggcgctgtgcgctacagacaccttctggaagctgcggtggggaaactgagtttcccgagccgttgagacagatggggttcagcaccgcgcggggacgacaggaaagctgcggctgaagagaactgcggacttggcaggagtcgcctgaggagctaagatcccggagactcttagccccgtggtgcttctctacgggagggagggagggagaatccggccggacagatct

SEQ ID NO: 1427 - DNA, 1046 bp, Homo sapiens
tctgcccacctttgagagttttaaacacaagcctgagccgactcttcctggcataaagcacctcagttcctcccagaggctgaggacagaggctggtgaggccacctcgtccctgccccatctctccccagtcccactccctgcagcttccacctccctgaccctgctcccacctgcctctgggcctctgggcctctgggcctctgcacagcctctcctgtagctagagcccccttctcaccaccctcccccactcaaccaaatgaccctgtttctccttcagctctcagccggtcagctcctccaggatgccctcctcactctctgcaaagtcctctattctctcaccagacacttatcctggagttgccctctgacttgctgagccccccagctgtaatcccctgacactgggggtgcttggtcagccctagcagggggtctcaaaaaatgcttgttgatggcctgattgtcctcagtctaactgactgttgactgatggaacgtcttgccgcctgactttccttctctggcagccacagtatggggtaagctgcagtgaggttcttgcagagaggatggggcaagaagcccagcagaagggagagcatgaaccccccaacccgagactcacccctttccttttgaattaggaatcaaaaaataaccagggccttggggtgatgggcccttggtgcccaggtcctgacatctacgtgggcagctgagctgaactctcccctgcctcagaccagtcctcctttcctcctcccctcttctctctcctcctctttgtcccctcccttccagcccctctggccctgccccagagcagcagaacacccagctgacagctggacatgccagtccccaccagcccttccccagagggtcaggtgacccttccctccccaggccacggcagcccggccctcccgggcagacctcccgcaccagggctctggtgaacagcaaatgctccacgctgggacgggccattgcctgatgcctgtacatggtgggcactgagagacaagattcctggg

SEQ ID NO: 1428 - DNA, 976 bp, Homo sapiens
acaaataaagctggcctttctccgattccctgattgcagccattcagggagcagccccttgcccacgcatccattagtcgaggcggtggctgcgtgtgcagtgctacagggttcagcgcctgcctcggctccggaatcaggctgtttccttctagacctcccatgggggattcaagccggcgtccgggtcaaagaacagggacaaagtcctcctgccacgggggaccatctgcaggcaaagtgaagaatgaggagcttcggcaaaatgccgactaaggcctccttaggttttgccccactccaagatggaaggcctgaggcttcacactgcccccgaagttcctttcccattggctatctgggaattgagttttccaataatgcggacgctgattggtcaatccaggacggttgctcaagccattggcgcagccgccattggagggcggctctcaaaagttttcagacacaaattaggttcgagggaggaaacggagaggaaagggaaaacttgagacggaggcgggactaaggaaacggcagcttgcattggtttattagaggccaaggggcggctcttgaacgttccttcctcttgattagtcctatttaggaaaagagggcgggtactgaggaaaagcggcagaagcgcctgcttccattggtcagtcctggcaggaggcggagcacccgcggcagctgattggtgcgggaggcaaggtgggcggggctctgagccggaggttttgttgtgagggtcggttgtcaagcagcggccaatcaaggcaggggatggaggcaagtgggggtcgcgcctggagcggagcctcggcctccggagccgcagctgcaggtggagtgggcaaggggacgaggtggcgaggggacggtgggccctgggctgggccgagccaggcggggctggctgggcttgcgggcagagagctctgagcgtggggaggctagagcccgtact

SEQ ID NO: 1429 - DNA, 951 bp, Homo sapiens
tggattcgatgggactgtagtttctggaatccgactgcaaagctgaccgctggtagagcccagcttctaacttaggaaaggcactagctctctacaaagccgccactccccaactacaccctgtagggaccagccaatcccaaagcccgagcgggcgtcatcaccaattgcaaggcgggagacagagccttggctggcaccgggcctcctccccggacccgcagaggcctggcagcgccgcgtttgaggagggttcgtgtcaggaagtcaaggctggatgatcgcttaagcccaggagttaaagaccggcccggacaacaaagcgagaccccgtctctccagaaaaagaaaaaaagagagagagagagagaaattagccgggcgtggtggcgtacgcttgtagtcccatctacttaggaggctgaggtgggaggatcgcttgagcccaggaggtggaggctgcactgagctatgatcgccccactgccctccagagtgagcgacagagccagaccctgttgctaaaaaaaaaaaaaaaatccataaagccggggaccatctttgctccagggaggtcagctgacccgggctggcactggccctggcgcagttcccgcccctcccgggagcgctggcaccgccccttggcaccaccccctccccgcgcccccgccttccaggaaggggcggggtctccgagacgggtggggccggagctccaagctggtttgaacaagccctgggcatgtttggcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaac

SEQ ID NO: 1430 - DNA, 1074 bp, Homo sapiens
ctcaactcctcctcgctagtcctccaggctcccagcatgcctcgggaggaggcgcacgggccaattcggtctctcgccttcctgattggctccaaagggaatgcccggtccggcccgctccaccgagggaccaatcagtgagcacggccctgctctcctctgctgtttctgagcggctggggtagaggtgctgacgtttgcgccgcgcacgactatgtccgccatgttagtgtctgacgcaggcgccattacaggagccgtctctcttgaggcgaccgtgtccgcataagttgtcagtccccagcagtgtttgggagccttaacaggcttgctaagtgcctgagattaaaggcgaagaggaagaagagcaagaagggcaacccggtgtttaacacacggctttcaggcgctctcaggtggcgccaagttcagtttcgacagggatatgcatccgggagagaatttttcagcccccgcccccactggcatgtgagaggaggaactcgctgttgccctgtgtcttccccagtgcgttctataaccagcctcatttttttttttagcaataggccggatgtcctaagcgaccggcattcaaagcccggtgcattttagtctcatcaggagtcaggcgtgtcacgagatttttccgcggtagctgctcagctctgactcgtgagcggcgcacaattggctaagaatgggtttagcattttggcgctcccccccggcgctcctggaaacactgcgtggcaccccgtaccactgtcacattataaacgtgctaaggcttgggtgtctcggctggggagcagtcaggcagcgcccagggcgggagggaatcagactagattctcgccgcggagacccagggccgcgcggaccaatggggcagggaagccgtcgtagggcggggcagtgaggggcggtgccgcgctggtcccgcgccggtcccggtgggccgacttccggcgagcgggcaagcgggaaccaggtggccacccggtgtcggtgcgtaaaccccctccgcttttacacggagcgcgcttaggctttggtttggggatttaagat

SEQ ID NO: 1431 - DNA, 1053 bp, Homo sapiens
tttgtcatggcttagttttgcctgcctggaaaatggggaagttaggccaggcgggaactctgcaaggatgcagaggaagttaagagggaaagttgctttgagaggaggacactgggaggggttgggagtggctcctgagggcggtgataggcaggcaggcctgacttgtccacagctcaccggaggccaccttggcagcacctgtaggaagggcatgtctggcctccacaccagccccctccctcttcaccatttccccttcaatagcaccactctcatcatctatgggggacagtgctttcttctctccctgcctcctccatcaaaatcttttctcaggggagggtctgaaaaggccttcactcccccgtaaataacgaatggtgcttacagggctgggctcccacgtgcatgcacattaacaccaaaggtgctgtagtgaatggaatttggggcactgaggggaaggagtggaggtgttggtaggaacttgttgctggtgggggatgggcgccgtagatatcctttacaccactggctactccccctatctcctctggggtgaccctgagtatcctctgtgggacaccggcatcctgtgaggcgccctccttgcccacattgacgctgcgctggctcgagggtcacattcacggtctggcagaggaagcaggggtgaccgccgcagtcctcctcctgctccccttgccgagtcacgtgtcacgaagagcaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccggtgagttctctc

SEQ ID NO: 1432 - DNA, 959 bp, Homo sapiens
agaaagtcgcggggataagttagggggagcagggagtcagcttggagcgatggcttttgaccctgacattctgacaacactccccaaaccccgctctctctcctctcccgtcagtcgcctctccgcccggcttcccgtccctgcttcaacccggtcggccgcgttctctcgccagccttcttagctatcaggttcctacctccatcttcacacaaccgctcccaccgtctcagaccctcatcgctcccaccgcccccactggactcggaactgccgtcacttccgcaaggacgtgtgttctctctgctgattggaaggagcgccgtggggctgcagagagtcaggcgctgggctatcgccccctggagtttggagggataagggcatgtagaagtgctagaagcgtccctggaggtggcgtagggtactcccgacctaaggatgattccggggagtgcaatagagacgtgatctgggctagaggagccggaggggcgggggagcggggggaagggggagaagaagaagatcggtagattgagtggctagagaggtcggaggtaagtggctatagaagtcgggcggacccggaacccagaggacgcgacaccatgacttatgcttatctcttcaagtatatcatcatcggagacacaggtaaccctcaggtggttcgccttcaaggctcgggcgggcattcgaagctcccaaattgggtggcgggggcggggctcactttgtgggctgggcgattcgagacgggcggggcggttcggggcggccgggggcggggctcgggagccccccttctctggtccgggaagtccatactctggaaggtgttccagggctgcgtgattccgggagtgtgctttctctttcaggtgtggggaagtcatgtctcctcctgcagtttacagataagcggttccagcctgtccacgacctcacaataggta

SEQ ID NO: 1433 - DNA, 1069 bp, Homo sapiens
gttttaggcacctgagagggattagcatgtagaggctttctggatggtaatataacctctcattatccttgatggcctctgggtcactgatctgaccattgggatgtatcccactatccagggagggtctgtagtaagtattgcaccccaccatcttccttacatctttacacttttcattcacaatatccccttccttgtgaatttctaccggggagcaatgtattcttgacattttccaggccttgatgtcagctttatgctcagcagcagaggtatttcagtgtcaagaaacatcggagttccagtctaaattcatcactaactgtgactgcgggcaagtcgctttacctctcttaatcttagcctcagcctctgaaaaatgaggataataattctggtgattttacagagctgatgtgaagattaatgcgcgttaacggtttaatagagagcccggcacggtgtaagtggtcaataaatacgagctattattatgagcaacgctgtgtcctcagagcctccccaccaggacgtcagggagcggtgcagcaggagcggcgcagagtgcctcccgggaatccttccccgcgcggccgcggcgccgcacagccgccgccattcgggctccagccccgtccgcgcgtctcccggcgtgggtgcgggaccagggcgctgcggggcgcgcagggtgagtctgtggaatagtagtggaggacggcgccgcgctaggcgggggtcccagggagtcggctgcaggggtgtctgctgggagggctggaccgcggggctcaccgaggtccgagggccgcccgcagggtgaggcccccaagaagctgcggcaagtgccgcgcccgccgagctcgctcccgcgcccgccccaagatggcgcccctccccctccccttgcgcgcgcctccgccgctcggggcgcggccccgcggcccgcgcgctcctgggcgggggatgttgtgatggagaagccgcggcggagcccgaaccccgcagcctgagccacctccgtcatctgggcccggggcctcaccgcgcaggtaggaggtgtccctgc

SEQ ID NO: 1434 - DNA, 964 bp, Homo sapiens
aggcatcttccaggtctgtagtgtggatcaaatgagaccatctattatgttcgctcttggcattattaaagctgttgggggaaattctagtgatgcctggccagtagagtgagccgtttccagaaattgacccaacgtacacaatgccacacagcgtgcagactcttcccagtacagagtgggagccaagatgagggctgcgagggccaggtttcttgacaggtgtcaaaatttcataaaaaggccagtcattccggttctcattggtggctatgggtacagaacccggaacaatcctggagagtgggattacaagcaccgttttgagtttgcagaaggagagtgtttatatagcttctctggaaaaggaagccatgactccgggcggtcggagaaggtctgccgggagtacacctgccctctgcctgaagcgtccccaagtgtcccgggcccgcgtcgttgccggatgcacaatgctgacacccttcccgggggcttccagtgtattctgcctcctcttgtgttcccgttgccacccttagctccctgactcttccagccaccttcccctcctccctcttccctgaggtgcctcctcgggcgattccagagcgcccatcttcccagtccgggcaaaacccggagaggtggaatccctcgcccggagcgccccggcggccactgggcatgctccgttgtcaggcaagttcggggctgcaggcagcttgcgcgccgcgcggattccagctgcggtcgcgcgtactcctcctcccaagtagggagcgggcgcatgatggcggccgcggcggcagcggctgcggggagctccagcagcggcggcggcggcggcggcagcggcagcagcagcagcagcagcgacacgtccagcaccggcgaggaggagaggatgcggcgcctcttccagacgtgcgacggcgacggggacggatacatcagcaggtac

SEQ ID NO: 1435 - DNA, 1002 bp, Homo sapiens
aatcccagactcaacagcacatttcctgacgggaagggcttctctgtctgggagaggcctccacttcattctcataagccaaatctgatcctggctttgggtaaacctgctctcaatttaagagcaggtttcctttagacaagtagattaggggtcgcctcttcctcgcctcgggataagggcaaacaagacgccaggcttgggcgttgggaggacggcgacagcgacgctgggaacaggggtagaatccacgccgtccagcggcccccaggcctgtcagctcctcacccgcccacccacccgcccgcctgcattcttcggtctaaacttaccaggtggaagctacaactctagacaggaagtaactaactgggttggatccggtcgagttccgctgcgcttcttagagccgctgctgggaagaggccgaaacccagtggccgcagcagtagccaccgcctctgttactagggggtctcgcctccatcgctggctgcgaggagtctgagggcacgtgaccggaagtagcaaggcgggccctgggcacgtgactcaagagcgcggccgccatgacaccttccgctagttccctccctcccccacgggttcccgcctgtttcgtttcctctctccggtctcgagcggcgaagggtcctgggatcctggctggcccaaccatttggcctagagctcctccggttccagtcggcgccgtgtctccagcccgcaacggccctgcggtcgcaggccgtagagagcgtaatcgcgaccgcggcctgagggggagggaccacgcggaaggaggggcgtgactcgtcacgtgatgaggaagtgccgttagtagcgttgtttccagtctgcggctctcctggatgacgtcagcaaggaaggggaggaacgcgaggggagactgaagttcacgttccgctcttagtgcgcggtgagttccccggcgctaagccgggagacaagatccgatctactgagagctgcgaggtactg

SEQ ID NO: 1436 - DNA, 900 bp, Homo sapiens
acctgtagcacaagacttcccagatttaaaaatccatcctcctgcgaggagaggggagcgatcagcgtagcagattctctaaatactcattgtatttggctctggtctgtgtggcgtgaagaagggggcacgagtgaggttcgagttagcatggtaaccattctttctcagctctgtgactgaggggctgcgggagggggttatagtggtgctgggcatggcctcggggagaagctggataatgccctctgcagataacccgtaggctgcgccacagcagcgccaaggaaagaaagcatctctgctccaggtctcggcggaagagatgcgggaactacggggctctgattctgaggtcctggatttggaaggcgtctgcacacaaagaaataacaaagttaagttcccgcggctcgaccagcagagtacgaaacggggcctcccttcccagctcgggtggaaacgcctccaccctgtcaccccgcccatagcaggtcttttatccgctggagccgcctggacagtcctcgcggggcacgcccgaggctccccggaggaactacaagtcccatgaagtcccggggcgcgggcggtgatgacgaagccctcgccgattggccgcacggggcggggcgcgcaggccttctccgagaggaggggcggggcgtggggcggggcgagcagcggcggattggcgggcacgccccctcgcccgcggccccctccccgcctctctccaccgcctcctctggctccccggtcagagggccggagcgagaagatggcgaagacgtacgattatctcttcaagctcctgctgatcggcgactcgggggtaggcaagacctgcctcctgttccgcttctcagaggacgccttcaacaccaccttcatctccac

SEQ ID NO: 1437 - DNA, 952 bp, Homo sapiens
gagtcagcacactgcatcactctacgtcctggtccgtccgtctgtcttcctgggacacaaataactgccttctccgagttcaaccctgaacatctgtatcctctggacaacggggagcgggaaaaaagctacgcaggagcttggatcgggcgaagctcgcgggaaaccgctctgggtgcgcaggacaaagacgcggggacagcggggagggccggccgcagcctgccgggctgcccccacggcgcggaacgcgcgcagcaacctccaccaggcctccgcgtctggactcccgccctgcctctgggcctcctccgcccaccggcggcgtctcccgcgaagcccgctgggcctcgctctcaccctcctcctcctcctcacgccgggccttgctcttggccttggatttctggctgcgcagttcgcgtccccgcggctccccgccggccgcgcgtttccgagccatgttgcttgtctgggcaaattccacttcgcgagtgacgcacccggccgcgatgcgctagaacgccggccccgccccgaggcggtgcgcttggccacgccccttcgttggaggcctagtcacgcccctaaaggaagctccaccccatacccgtggccactaaaaaactgcgggaagcaggaaagagcacaacaggtttctctctatttccggtgtattgtatcctcacgtttccggagattgacgttgctcttgtgttctcgcgagaggcgggaaagggcgcagggtttgaaacatggcggacgacgtagaccaggtaagtgtattttaaggaggtcgctcgaaggagcttcttgtactaggctgctttttccagactcaggaaaaatggccagtcgtgcctcctctctccaagtcaccatggcctaatccaccctgtcctttccgtaaccccccctccgaattttgccgtaggccctgagaccttttcct

SEQ ID NO: 1438 - DNA, 905 bp, Homo sapiens
ggtggaaaatacaaggtgagtggatagggaagacctcaggatcgaggttcgcttactttcgtgcctggtcctgcagtgaaaacgaacagaggctatggaccacagcctctctggaaaaggctgctggctgggcggggagagtcagcgcacagtcgggagtgtctggtgccacagacaggggactatgctttccccgatcatctcctagcacaccggtccttcccaggcttcctaagagcaggagcgcgcgtgcgcgtgcacacacacacacgcactcgggctcgcgcgtgcgcacagcgctctccgatagcccggccaagcctcccttccccctcgtagggccaggcgtcccagtcgccgaacaggaagagggcggggccaaggaggaaaaaaaaagcctccacccctcgagattttccacccgctaattttcccagtcacccattgggaagcaggatctgggcgacctgaaagcctccccaacagcgaagtaccaaccacggccccctaagcgtacgacccacccacccggtctccccttctctgtctctccacccaggccggtttcccctggaaaaactcgcgagactttgcgagaggccgagcgaaagcctgggaagggaggaatagggagggacatagaagggccccgccctgccttctggggcaaagcggagagtggtcggttctgccccacagtaacgcgaggaaagaaatctcgcgaggctggagttctccgggagcgccggtcggaggcggtcggcggaggtgtctaccccgccggtgatggcgttgaacgccactggcttcccggccttccgtccgctgcctccgtccgattctgcgtctgcttgctgaggaggcggattaggggggcgcggagtctcttcccttgagtgcatagg

SEQ ID NO: 1439 - DNA, 979 bp, Homo sapiens
cgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggtgactatttgctcttcctaggtcgccagtctttgatttcagctagtgaccctgggcgggaagacaccctgttcaccctcctcctgacctccgccccccacctcttcagccaactttatcttggatctctgctctctttatcttttctctagagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccct

SEQ ID NO: 1440 - DNA, 930 bp, Homo sapiens
gaatctgtgtacttgcacatcgccagacctgtattcctgcagcgccctggcccaggacgcctctcctctcccggcctgagattgccacgcttccctggaagcgccccccaggcagctctgttagagcatttacagtaataaccgtttacatttatacagggcctcccacttcaaaaccactgccatccgtatctgatgcgtgccccaccagtgaacgtatgtgtcacacaggcgcagtcagggaggcagggtgtgtcgagcggtttatcccgcaaccccggcgtccccggcagggatgaaagcgcagggcccacgcgaactcggcccgcagctcccggccctagaggacgcactgtccgccggcaggggcgtgcccaagacgccatgctctgggagaggttgggcacctggcaggccgccccgactccggatcagctgtctccgctgcgtacgtcttcctcttccaatgggcttggattgagccttctagcgcatattccaagtcctccaatgtcccacaatgccttgcagccggtttcgccctcggtcctggcaactgtcgcgtaaccacccatgaaagcgtccatgcctcgccgtgcgatagtatctccggaacaaatttgtccctctgcgcgatccggaactccgaggtcgttcctacgcgccgtcgttcgcctcttcacatcggattgggtctcacgcaaggatgaggcggggtttcgccgtggcgcgcatgcgtgcagcaaagaatggaggagtcggaacccgaacggaaggtaggagagaggcgagaccccgcgcgtgtgggagcgggcgtgaagaggggagcaggccgtgcctgactggcgtgtgcttgcagcgggctcgcaccgacgaggtgcctgccggaggaagccgctccgaggcggaagatgaggacgacgaggacta

SEQ ID NO: 1441 - DNA, 1000 bp, Homo sapiens
gtttagtctcatgcgtgggaaacctcgatgactttcaggaagggacctgatcggcgactcctccctgccccagggagcgtgtaaacagcggcacgtggacacagatttgggggacgcacccacttcccttcccactggggccgccccgcgttgggcggcggttggagccgcgagacggtggctagacagggtgacccgactgcattcctggccagtgtgtcagcgccacttcccgccccctctgccaagatttaggatcctactccagaattggggcaccccttctccccaggtgggagaggctttccagagcggagggagggtcaaggggaaggggaaatgtttcccctatccaggatctccagacggtttccttcgcgtgggcgagagagacaccggggtgcagcccctgcgggctccaggactacaattcccacaggacccgaggcaaagagtcgcccgagggcggtcgcggaggctgctgggggttgtagtccaaactaagattttgaactcttgctgggacatcctttgaagatccaacccgcgctttttatcgacggggagattcgggctcagagaccctgggggatactgatcaggaaaggggatagtgcgcctgaaggggtggggcaagggctcaggagtcagtctccagccacagcgaggcaggcgtctcggctcttctgtatctccctggcctggtcgctctcggcttctgggcctcgcccttcctgtctgtgaaatggactctgggtgaatccaaatgggatcgtcttgggctacgtcctgtccctccgggactacaagtcccaaggtgctcgaggcgaccttggctccccctccccaccgggacccgcctccctccagcccaagtcacgtcgtctaacctgttcccagctcctgccccgccccgttctccgctccccaagccggagcccgagctggaggaagcccccaggtgccaggatctgcccggatccgtgagtttcaccctcct

SEQ ID NO: 1442 - DNA, 915 bp, Homo sapiens
tcccagaatgctagtccctattgcaaagaactacttttttatataaagctttttccctcctaattatttgcaatttgccgaaaagggaacaccaaaaaacatttccggatttgccacacacacaaaacaaacaaacaaaaaaaagttagaaaaacttctggtttggcttccagtcttgtctccagggctaactggcgtgccatctgctcgcagcagagcggtaaccatggttcatgtgtcacaccagcgtgcgatgttaagaagtttgccccggcaagtctggacaactccgcttccgcacaggttgctgagggcgggcggggatggcggcagcagcatccagagggtgtagatcgttcttccaaaccccatctgctttcctgtcctctggctgtgcccggggtccccgggcgcggcaagccgcggggacgtgcgcgggtcttctatgcataacaaaagagccctcctcctcctcttccttctcccgccgccccgcgccgccccgcgccgcccccaccttggcttcccgcggccgccggggcccgcgtccccagcaggaattggctcccgggcccgaggtttccaggtacccggaagggggagggggccgaggcggcaacaattgggcgggtgagggcaaaacgcgcggctcggagcgccaagactccgaggggcggtgagcccgggccgtgccgccgcacgattggccggggccgccccgccggccgccgctgattggtggattctcaaattcggtctcaaggcgccagaggaggtgttttagcggggactacgatccaggctggagttgcgctcggccggtctgagcgctggcgctgcccggacgccgcggggtccccgccagcccagggcactcggcgcggggatctgcgcgcctcgctctcccttcccgat

SEQ ID NO: 1443 - DNA, 1041 bp, Homo sapiens
ctgagcccacactctttattcgttatgacggtgctgcaactaccaataagttgtgagggttaaatgggatgagatgtcacagtattatttgcctgttagggaggttttagggcacgcgcctcttctctccaaattggaatcacccaaagagttttagtaaatactgggcccatccagggttaattttcttctaattggtttggggtgctgcttggacagggggacttttaaaattctatactgacccaccaggactgacatgagaactactcgcttagtaactgttagaggaggcgccagctgatcaggacctaaagttcatattctttttcatctccccgttgtcgctgaagcctaccccataaacccctaccgtccctttgcccacagcagagaatttccgggaaaacgggaaaggtatgcaagcatgcccacacacgtgcacacacgggttcccaaaagacctgcgtgtggccgcaggggcctgccccgcccttctcgggccctttcaggtcccggcgcccagcgatcccaccagcacctgggtccggcgcgcggctccctccctctccgcgcccctcggggctccctgccccgcccgcgtgccccacccttcctagctctgccccatcgctgctccctgccccgcccacgggccccatcctacccccacctcgatccgcccctcgctcctccctgccccgcccaccgcgccccgtccctgtccgccccttctggctctcagcacccccaagaccggtgcgcgccccgcccctcctcctcctctcgcgaggcagtcccgacgccggaagtgcctggagcgcgcgacagcggcggggcggggcggcctggaggctgtggcgcgcggccggcagagggaggggagaggccactggggccgtgttagtctgccggtggggactcttgcaggtacaggcgcggtcggggctcctcgtggagagccgggggctcctgccggcctctgactggggtgtcgttgcagggccgtccccatgttgcgttttccgacctgtttcccat

SEQ ID NO: 1444 - DNA, 1067 bp, Homo sapiens
cgcccaaacataactgaaggttttacagacatgtctgtggcaccacagaacacgaacggtcccaatggaaaccccacgcccaatttcctcagggaactgctgtggcggaggcttggtgggtgtctgaggggagcagaacccaaggcgtggggttcgggggtggacggggcggtatgaccaagaactctgcacctcccccacccacccgcctgaaaactctcctgaagtcacctaacaaagtggatggcagtgagtggctctgggtgggatctttctgtcctctggctaccctctgcccaacaagaaggctggggaaggtggggctgagagaaaggtctaggcctagaagacctcggactcctcccaactccaactcctcctccccctcttccgtggtcggctcacctccagcaccccacgtggtggccctaggtacaacggattccggcgggcagagcgccttagatcccgagtctgcagcccagggcagagtgccaacttctcctcatcccttcgtacgccatagaatggaaagacactggggctcctctgttaggagcgtaggagggacaggctggacaaaagggctcccgaacagcaggttcggaggagagcaacccggccctgacccccgcccccaacaccgttcccgacctcgctccccaatatcccggctctgcaccaattcctcccgcaagccaaggaaccccgaggcactcctagtctctaaaccgtttatttctccccaccagaaggttggggtgggcgggcctagaacacagcgtgcggcgggttcccgggtggagccagcgcagacagcgtgggtccctgcggctcttaggcgaaggtggagttgttccagcccacattggccgcgttcatgtcgtaatagttgatgtagaccctgcggggggaggaggccggactcagcgggtggctcagtcccgggcctggccgcgcgccgccgcccctcccccgcccctccgcgactccgcgtacctgtccgggctgatgcgcaggcgctcggccagcaggccgcacagcagcttgctgtaggagcggttctg

SEQ ID NO: 1445 - DNA, 986 bp, Homo sapiens
cacctcttcagattgcctctcatcttaagatgccattaaactcatgacctgctgtacacgggtgctgggggccggtgtcctaggcggtatctttacctggcgttccctctgcctccactggggaggcaaaggcatcaatgaagtcattggagttccacttggtcatctccttggggaagacctcctcactgtccgagaagccttctgaggggacagggggctgtgtcatggggtgggaggagctgctcggggacatccccactcccaaaaagggcctcagtgctgaccgtgggcatcaaagaactcttcctcggagctgttctcagagtctcgggcaatgttctgcatgcgccactcagacaagctctggggagacacagcccctgccgggccagctcagcctcagcctcagcccaggagcccagcctggggagggccgttcctcccatccctgtgccccagcctcacctccatgttgggatgagtaggaggaacgggaggatgaggaccactgcttcccaaagctggcatcgggggaggcatctgggcctgggggggcctcaggcccatcgggggtgccagtgttgctggccgcagaccgggcctcggtgctcggtttcccggggggctgggcctcggacccctcactgcctgtgttgcacttggccatgcgctgggccagcatgcgagcagtctcctcttccagtgcccggatgtcagccatgctcagctctgtccactcatcctgccagcaccaggcctggcggtgggcccgcagcatcacccgacgcagacctgcaggtgcccaggcgtcagaactgccccctccccctgcttccctgccaccgcagctacatgcccagccttgaggttggataatggctcccctggggacaccacccacccagagccacaaagtagggcagggccagtgcagtccaggaatgggagtggaaagtggggcatttgtcttcctgcctgactcc

SEQ ID NO: 1446 - DNA, 914 bp, Homo sapiens
cagctctgttccctcttcaggtagcagcgggcgagaggaagacgcggcctccacgctaggtgggtgggtggtccccagggcagaggtgactgggtgccccagccatcagctgggccttgtctgggtgcgggagggcctgggagctgccctttcctcttcctggtgacctaggctttgctgcttcctccacagtgacgggctctgagtatgagacgatgctgacggagatcatgtccatgggctatgagcgagagcgggtcgtggccgccctgagagccagctacaacaacccccaccgagccgtggagtatctgctcacggtgaggtggggcttccgcctcccggggaggccttgagggagtacccgggcgtcactgccctgatgggcggttgggaaggcaaaacctgccctgaaaagcctttgggtagtgattctagccactaaaggcttcccacaggaggctggatgtgagtgatgggtgggcctctggagggcagggccgaggcctcatctgtgtcctgccagggcatggaggagggtggcagcaggaggtctgtgcattagaactaaacaggacccctgacagggaattcctgggagccccgagccggaacacggttctgtccaggagagccaggtatcggagcagccggccacggaagcaggtgggtgtgcacatgccgcatctgccctccaggtacctgactcacattacactccaccccgcagtgctcctaggagcccggcgtggtgtctgactgcaccccttcctactaccagcaggagagaaccccctggagttcctgcgggaccagccccagttccagaacatgcggcaggtgattcagcagaaccctgcgctgctgcccgccctgctccagcagctgggccaggagaaccctcagcttttaca

SEQ ID NO: 1447 - DNA, 1084 bp, Homo sapiens
cagaggcactgagactgagacagaattgggggtggggtagggagaaggcccgctggtggcgaagcggcggaaacggcctgagcgatggtcacccagtcttagagcgggggtgtgtcctgctgacctgcctccccgcggacaggcctaacgatgaggcctgaagttggctacgggaaagaatgaatttcccaagggcaaccgaggtccctttgcccagcagcacagagcagggcccgtgttccggctccgggcaggggtggagagacgccgtcgtccgaagcaataggggtttgtaagcaccaccccagaataagggactctccccattcctctctcggacggtccctaacttcactgtggaggagtgaggccgatcctaaagagcggacgccccaactttgaggagacgggagggtaaaaggtagatgggaatcagtactcgcctctctcctcaggttccagctctgattttggctctgtcgctgccacccgctcatctttaacatgatacgctcagtgccttagacttaagtctctgacctcgggagcgcctggctgtaatcttttaccatggccttgccctcctctcaggggcgggaccccaaaacctaccaatcagaaagtggcacgccggcattggccccgccccgtccctcgcatccgccactcaggagccccgcggcaccgcccccgtcgctccctctcgctagggggtcgacgtagtgtcggacccggaagtggctttgggtcacgaggcttcacggaggaggtgggtgagtcatgcgcgcgcgcggaggggagtgtagcggggggggaggggaggaaaggggggcggggatgatgcaatgtttggcaaccggtgtctgcacgcgcacgcgcaggggacaccgagggtggtgggaggtgcggagggtgggggagaggagagagggcggggcgccagctcccggcgcccaacggccccaacggctatcagccttggtcgcccctagtcggtcgtgagcctctttgccgcttgtctcccccagaagctgctgttccgcccacctagctttacccgccgttttacccccactataaggga

SEQ ID NO: 1448 - DNA, 1031 bp, Homo sapiens
ggctgagtccaagagatagcaaatcgagtcttaaataatccggggagaaagacgcccgggtagatttgaggtgcagccttggagggagggattagaagccgctagactttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcggtgctcgggctgctgctcaagaagctcaaggacgagggctgccgggcgttctacctggaaggtacgcgcccagggaactccgcgcgcggggcagggctaggggcgcagggctgcgggcggggcgcgtggattgaaaatacctctgctccgctcagctggagcttcggagccgcgctgcccgcctagggaccggcagccggcgaggtaggggccgcgaaccgcgcgttccgcaccagagaaccgggccggctcagaatccactcgctt

SEQ ID NO: 1449 - DNA, 955 bp, Homo sapiens
ggacagtgctgagagttagggtgtgcagagagacaggaaaggcagtgggcgggggggagtcaggcaggaagacaaatgccccactttccactcccattcctggactgcactggccctgccctactttgtggctctgggtgggtggtgtccccaggggagccattatccaacctcaaggctgggcatgtagctgcggtggcagggaagcagggggagggggcagttctgacgcctgggcacctgcaggtctgcgtcgggtgatgctgcgggcccaccgccaggcctggtgctggcaggatgagtggacagagctgagcatggctgacatccgggcactggaagaggagactgctcgcatgctggcccagcgcatggccaagtgcaacacaggcagtgaggggtccgaggcccagccccccgggaaaccgagcaccgaggcccggtctgcggccagcaacactggcacccccgatgggcctgaggcccccccaggcccagatgcctcccccgatgccagctttgggaagcagtggtcctcatcctcccgttcctcctactcatcccaacatggaggtgaggctggggcacagggatgggaggaacggccctccccaggctgggctcctgggctgaggctgaggctgagctggcccggcaggggctgtgtctccccagagcttgtctgagtggcgcatgcagaacattgcccgagactctgagaacagctccgaggaagagttctttgatgcccacggtcagcactgaggccctttttgggagtggggatgtccccgagcagctcctcccaccccatgacacagccccctgtcccctcagaaggcttctcggacagtgaggaggtcttccccaaggagatgaccaagtggaactccaatgacttcattgatgcctttgcctccccagtggaggcagagggaacgccaggtaaagatac

SEQ ID NO: 1450 - DNA, 923 bp, Homo sapiens
gtgtggtgcaaaagcttcctacttccaagcccaaaaacctgctctgcgactgagcatgccctgaactaactgcgggcgccctgagacttctggattgggatgtaatccggtctccgggttttgaccgcactcgagcggggaggtgggtacgacccgcgggaccctgccccgagagagctgcaggtaccagaagctacccctttcctagtcggaacagtatctcagacttggagtacctcctgttttctttgtgcaaggctgcagtgcacagagtcggtcagagaagacagagtagcgtttctgtggcgaacggtttagaaaaatctatggggcaggtttgctccgccggctgctcgtgcattccacggcacccacaggacttcgggtttccggcccccagacccacgcccgcccggggctgagtgaatggcgtccttgggcctttgataacgggagttggcaagaccacagcctactccatccctgaggcggcccgccgcgcccacgtgcttctcgcagagccgccgcccttgtccaccactcccacagctgtaaaataaagcggcctgcatgcttcctacagcgctttcctcgctcccatatacgcacacacaccccatcttccagccagttcctaactcgcgccactccccaaatcggactcaaatccggagccccgcccactgccccgccccctcccggccccgcggaaaaccaggagcggccgcttgggcaaggcgcggccggaacgcactgggcatgctcgccggggaggggcgggccgggctgcgcgcggcgagtaggaagccctcgcccagtagaggctgtgggagagagcgcgatgggccgcggcggtgggcgcacgttccgcggggactcatgccacgcgcgtcccggcccgacgcgcaattagcagccacctc

SEQ ID NO: 1451 - DNA, 901 bp, Homo sapiens
cctcactccctctggaaactgtgggctcctggtgcttaccaggcctgagctcgggctgggggagactccggccgccgctgtggctcacggtctcgccccgggtgctactgctatttccaacagccgcttagcctagactctgctcaggaaaggccagcggctgaggcagtgctgcccagcccacggactccccatgccaagggctgcagccccgcaacctcgcttctggattcttcgctgatccagtcaccggggaggggctgactggcagccacacagaggtttcagccactcgctgctcttcagtggcaattcttataatacaatccccactctgacgcaattttgtaagaatggcttggagtccaaaaacttgactacattctacttccgtgacagggagagcatgatcaaggccgctaggcaggcctgcatgcgaggcactctgacagacggggaagcaagggcaggcgagacttccttctagctgcgccctccctccttcccaggcctgcaggagccccgagcgtaggactgggctggtgccggcgcagcaacgctccttctcaccggcaggtggcgctgtctcccgcgtggacggacagagacccatcaggcggggagggcctgggcggtggcggcgcccccttggtggggccgcagagcggaggagcagcagctgccaccggccggaagcctgctggctcggccgagaacaatggccgcctgtcactgtggacagctgtctcccaggctaaggcaaggctgcgctcccagggaatgcgggcagggagccagggcggagggcagaggacgagagcgaggaggagagcgcgggcacccactgatgctggcggcctcgggtattcgctttctctctcttctcccaccttgttccttt

SEQ ID NO: 1452 - DNA, 1051 bp, Homo sapiens
atgcaacctcactcaaacagacaacagggccaagaggaccaggtggtgactgacatgtgcactaggaacatctcagggactgcagagctccccaagaccatagcagaagacaggcgtggggaaatggtttgctactgttttgcaaatcaaacatttacagtgcatcaggagagcccggtaactaaagaagaaagtggttagttcctatgaggcaatgtcttaccgcctgatttgtgtgtatgtgctgaggtttctatgcgtcaggcttgtttagggtggacaagagggcatgcccaagggagctggagatccccacactagctggatcctcaggcttctacgggaggcggggggcgtcctgctgtgggaggccacatggggactgggggggacgagaggggagagaaccaggaagatggcagctcggcggttacgagaccagtgtcctgagacatgaccgccacctctccctccgcagaccgcagcccgagagccccgccccgccccgccatcctccaataaagtgtgaggttctccgaagctgttgcgtcgagttctgtccttcgtcccctccctgtcttccccgctgagacccttccctgcgtgggggctggagggacgcgggtccggccccgcgggcgggagtaactaagggatggccccgggccctggcgggaaggccgggccagagcctgggggcgggatgcggacgtccgcagggtcgccgcttcggttccagaggccacacggccgggcggggcgtgagggacagcccgaggactacaggtcccaaggttccccgcgccgcttccggggcacggtggcgtcccggcaccgcggccgcagtgaggagactcggccatgctacgcgcgctgagccgcctgggcgcggggaccccgtgcaggccccgggcccctctggtgctgccagcgcgcggccgcaagacccgccacgacccgctggccaaatccaagatcgagcgagtgaacatgccgcccgcggtggaccctgcggagttcttcgtgctgatggagcgttaccagcactacc

SEQ ID NO: 1453 - DNA, 1100 bp, Homo sapiens
ctccattaagaggagctcggagtcggggggcgcggagaggaagtccggctcccaggagcagggagcccgcggcgggaagcggacagggccgggcgccggtggttcaagaggcgcaaggcaccggccccggcgaaggactgccccggcaaaggacgcctccgactcgcccacccctgctcccgtccctggatttagtccacttactctgctcttagtccctcgcagccttcagctgtggcgatgcggactcaaaccctctaccaaccgggacctatgcactcaagggaagagactccgcgcccccctaatccgcctcctcagcaagcagacgcagaatcggacggaggcagcggacggaaggccgggaagccagtggcgttcaacgccatcaccggcggggtagacacctccgccgaccgcctccgaccggcgctcccggagaactccagcctcgcgagatttctttcctcgcgttactgtggggcagaaccgaccactctccgctttgccccagaaggcagggcggggcccttctatgtccctccctattcctcccttcccaggctttcgctcggcctctcgcaaagtctcgcgagtttttccaggggaaaccggcctgggtggagagacagagaaggggagaccgggtgggtgggtcgtacgcttagggggccgtggttggtacttcgctgttggggaggctttcaggtcgcccagatcctgcttcccaatgggtgactgggaaaattagcgggtggaaaatctcgaggggtggaggctttttttttcctccttggccccgccctcttcctgttcggcgactgggacgcctggccctacgagggggaagggaggcttggccgggctatcggagagcgctgtgcgcacgcgcgagcccgagtgcgtgtgtgtgtgtgcacgcgcacgcgcgctcctgctcttaggaagcctgggaaggaccggtgtgctaggagatgatcggggaaagcatagtcccctgtctgtggcaccagacactcccgactgtgcgctgactctccccgcccagccagcagccttttccagagaggctgtggtccatagcctctgttcgttttcac

SEQ ID NO: 1454 - DNA, 930 bp, Homo sapiens
ctgagttctgctttttaacgggaatccctcagaataaatcactgcatcctacttaaacaggtccataatacccgccctccagaaactggaattaaactagtttctcacagcacatttcactttgacaggtgaaacactttctggcataacagtactgcttcagacgtgaacgcggggtgctacaagtcaagcccccaagttaagacagtaactcctaagcacttacaatggtcccgaaaatcttcctgttcccacggcaagcgttaaagagtcactcagctctgaataatcgggtggctttggcatttcagagaaagccaacataaaataaatcccctgggtcacccggctaggagaaaggtgagcgccgccagcctggagcaccagctactagtgattaagaacggcgtgactgcggcgggtcacgcgcggcccggcccccgtcgccgccgccggagacccgctctgagaacctgacccggcagggaggcgtccccgccacttgggcctccgggcggccggccccgccccctgccgcgctgcagcgccggcacgccgcgaccaaggctgcgcaggcggcgccaggcccgggcctcgccgccttgcagcgccgcgagcccagcgcccgtcagcggtcgccggcggagcctgcttgcaaagctgaggtcccggatctcaccttcctgtcccgtggtggccagcccgcccgccgtcccggatgccgccgcagtcggagcttccggctcgggccggaagcgcgcgcgccccgcccccgaggcccgcccctcatgacgtcagatcgcccccgcccgccgcgcagcttccccgagcgagaccaaaacaggtggaatccgggctggagccggagctccggcggcgcgggtggcggcacgtccctccaggtgggtggctctctgggtctggcgactc

SEQ ID NO: 1455 - DNA, 1093 bp, Homo sapiens
cggtcactctgaaaaggaagagagttattgtgagatgaggaggccccgcccccgccccccacccccaattctctagtcttcctctttctcctcacctgagatcagggcgggagggattaggtttaagctatatccccgggcccccagcacctgccgggtctctgcacaactccgggtgacctttgcctcgctcccgggtccgggaccaggaccgggacacagaggcagcagcagaagcaggagaggtcgcagcgcggacataactgcagccaccccaggacggcaaagtgggtcctaaggaggaaagcagagcctcccaaactcgggaatccggtactcggccgcgggaccgctccgcgggccagagaaagagcgctgctccggaaaactgaataccgagcacgatagctggaccaggcggcatctgccgagacaatgggagcggggagccggacagggggcggggcccgaggcggggccccgccaataatggctcggagccggcttcaggggcgggggcaaggaagaaattaagccaatgtagcgcggaagctcggcaggggggcgggacccggctggcactcaggaggttggtgaaataggggcgtggtctccctcgggggcgtggcgatccggctcaaaaggcggggcctgggtggaacctagcctatggcaattgagaagccagattaaaggggttactagcagtctggtccaaaacccgcccaatggagtaggagattgagggtagcgggggtgggacctgggtgggggcggggctaaagcgggccgcccgcgtgcccaagcccacgtgagagggcaggacgcctgagagcttgaggccacacgaggctgtggagcggcgtgactcaaacgtggcgcgcatcagctcgcacacttccaaacctcgcgatagctactggccctgggcgagccgttgggattgcgcttgcgcacagcgtgtcttgtacgttcccgcgcttttctggaatctttcgcccccggaagggcagcggcgggcgcctgtgtggaaggtggggtggccagagacacccgagggacctgaggtggggaccttccctgaaccctgctc

SEQ ID NO: 1456 - DNA, 903 bp, Homo sapiens
tctctgaatgtccttccaaaagcaagctgtcatctttcttgcctctgatgtttaaagcgacattaggttaaggctacttggatttattctgtgcatggtggggagagggaggcgccagcaccatcccatcccgtgctgggttcctgagagaagctttgctgcttggctgggccgtcccgctgcgtcgtctctccaggcgcgtggctggtccaggcttcctcggcagagcagagtcgtgacctgcccaaggaggtggggggcaggcttgcgagcacagcgtgggggccgcctgggagccctgcgtccgccaggtcctcattcttcagagggccccagtgcaggtgtgcctcgaagtactggggttggagcggggcacaggcgtgcttcagtagccctggcaaccttgacctcctggaagtagtcagccacccctcctggggcgcccccggctaccgtgtgcctccgcagtgtcacagggcatcgcggaggcatctttttagtggaaagatccccacgctgaactctgcccctggcatctggccgagccccacacgtcaccgtgggtctggccagacggtcctgtcccccggaccttccttttccgcccggctgtgctgccacggcgggcagtgggcccgggggcccaggagcgggtccttgctgggtgggaggcccgggtgtgtgggaatgcgcgcggctctgtaaacatctggtgactcaccgcatagctatgtcgtggccggcctgtgcactgacgtgctcgcagtggagctggaagcggtgcccgcggcccctccctctgacatggaaaagtttctcatggtgctcccagccgccggcatttgcaggtccccacggtggcggaggcagctgggccccagcctctccactgtcaccctcacc

SEQ ID NO: 1457 - DNA, 1063 bp, Homo sapiens
ctccagacaggacgtccataagtcaccgaggtgtgccacccagcaggtgctggaggtgcccaatgctccctcctaggacctcgcagccaggcaaggctgtcaggttgttttgggggaagagggggtcatggatggctgagcagagagcggggaaaatgcaggctgagtggggcgacctcctgcctgccaggagccccctttcaggacacagcgggggtctcacacttgctgtccccatccatggcccgagggggaacctggtggtctcttctgagcttttggacttggggatgccaaacacgtgctcaccctcacactcgccccggcccgctgcgcccctaattgccaaagggtagggaaatggcgaagccagccaccaggtcgctggtgacagggccagggttatgcaggaaggtggtgcggcattgccttccacatatgtaagtctctgggcggcgccctcccagctccctgcctctgtttccccatgtgggccgtggggaactcccagagctacctcttgggggagcgtggtggcagcgatgatggggagacgcctggaagctcacagaacttgggtctggctggctcctgcccgtgacgccttgcccagcagcaaggtgcgcaacatggctgccagccccgcctcccacccccaccccgagtcctgagctcactttcgccttctccatcccctgccgtgggggccacagccacacctcaccgcccagtccagctgtctccagaaggggacaggcagtccgcggtctctggacaatcaactcaaggtacgcccactgcaaggcctccctcccaccgcggcccctgcctggccacctggcctctctgcaccagggtgacaaggggtcctcgtctgccccccaatgctccagggccagtcctaaggagctgagggtctgaggacgcagggagggtggaggtgtcctgaggctgatggacagtgaccgccactggcccccaacatgaccacacgtgggtgctgaactcggggcgccgtgcccaccggcatggtcctcccgagctccgacagcattacctcacc

SEQ ID NO: 1458 - DNA, 1061 bp, Homo sapiens
agaccaatgaaacatccaaaggaaggatacttctaagtaaacatacaaactttactggggaagccgcctgattaaaaccttccccggcagaatcatgtccaaagtgaagtacaaggtctgcttaaacagcttattaaaagaaaaaaaaaacagcgaaaaaagcgcatccctattgaaaagatattttactagctcccgtgtcttaacttcttaactaagaaacgaaaagagccatacatcaggttgaagtatctgggattcccggacgaggtggagggcagcggaggaaaaacaccgagaggctgcgctgcaagggacgcagggaaaagcaagcctggggcaggtctgagttccgagttcccgactgctccctcgtggtgtctgcgacccggtagcgggagcaagtgaggttgttggactgcagttttccccctacagtggcgatgcggggccggggtcgcgggtatgaggagatggggtgtgagccggggtgcgccagggcagagcgcttcgcccaccgagacgggcagggcggctccgggcactggccgggcggggcaaggagctcctaggccgccaggtccctctctgctggctccgcggagtccgcccgggggaagggaaggtcggggagggccgggcttctccgagtggccgcgggggctgcgggacaggtacttacccgggtgccatttcagggccagcttccgataggccttcttgagctcctcctcgctggcgtcgcgccgcacccccagcgcctcatagtgacacttcatcgcccgaccgggcgggcggccggcgctggggcccgggacggggtcggggcccgggcccgggccgaagcggcggcggcggcggcgctggcagtcctctccggcgggagtccgccgcccgcaccgggccagccagcgagcccggcggcggcggcggcggcggcggtggtgtaggtcagtgaaggcgcgcggtggcggcagacgacgcaggctgcggcaagcgggagcgcggcgggggcggtgccggcggccgccgcttcgcatgggctaggggtgggctctgtg

SEQ ID NO: 1459 - DNA, 914 bp, Homo sapiens
aatagtcccattcggaaacaagcccggctctcacatggctccccacacctctcaggacggctccccaccctactccgcacccaccagcttaactccaattttccttcaggcaccactccctccttgaagccaccatgaccctccccagggaagggccttcctcctccaggctctttccccgcgacacgcacgcagccggccctggacgcactggaggggaagggactctctgcttatgcccagcccgccgctggccggatcgggggcagccagtgcacctgactcatgctgccggggcctgactgagaatgggcgcaaaccatgtttactgaatgaataagggaaagggctgctaactcgctgcgggtggaactggggtcggggccagggcccaggagtgtaagcttagtggggggtctcgggtcgggaaatcaaagtgcttcttaagggtccccaaacggaacgcgctgcccaggaagtgatgagactgacaactcgggaggtggccaagcaggggacggacgatccctgcccctgactcgaagggtcggagacgaaattcccgccccagactatgaggccgagcccctcggagactctgcccgggacacggcgggaccgaccgcgagggagcggcgccggcggcctcccgtacctgcgctcctccacctccgcgtctctctcaagctccagcaggtccagttgcttggtcacgaagctctccacagctgccgaggccatcgccgccgccggcctgggcccctagaagccgacgtcccgcttctgcgccgggccggtgttacagcggaccggtgttccccgccgggcccgtgcgttacgcacgcggttcgcgtcgtttccgtttccggccgaggctgcggccatggcagcatcttccctgacggtcaccttag

SEQ ID NO: 1460 - DNA, 1028 bp, Homo sapiens
atgggtgacttagggatggaaattccaggggttggaggggtcctcatttgcttcctctaaacagcctcttgttttgaaataagacaaatgaacttggcttaagttctgttttcccttccttcctcccttcaccccctcactctcattccttttttcctcagggattttttggcagagggcagagagaggaacccattcccaagtcctctattagagaaggcgtgatggtgagaggggggcttcactcagcaaccgtgccaggacaaagggcaaacgagggcaggccgctctcaggctgggtcgggggcagtgaggagcagagcggcccttctcatcgcagcccccaccttgctgtacgctgtgggcttgaggtttccaggagagtctgcggtgtagggagcgctctggctgggagggaggagacggcctattcctcagtggggcttcctcgctcacggtgtgtatggtggggagaggagcacacaagtaccattttctgaggattgtgccagaccatgtcatacgtataagctcattcaaatcgatttccagataaggccgggggagggtagccgacttgcccaaggccacgcagcatgtgcgcggtagagccggtagggacgcgcagagggtcttgctaccgactctccccgctctcccgggagtctgggagccctgaggtgtcccctacccggccgggaagctgggctctcgccccgggactgtccggagggggctccagcagggggcgccccgagccccgtcccgggcagccgggcgcgcctccagccggcgcctgggacggggctggccgctccgccccctcggctcctaggctgctcggcgggcgggtgccgggcgctctgggaggagaggactgcagggccgagcccagcgcaccccgccgcgtcccccgttcccgccgcgcccgccgcgcccgccgcgcccgccgcgcccgccgctcccgccgcgcctgccgcggccgcgaccgcggcagctcagcctcccgccgtgagtagcacccgtct

SEQ ID NO: 1461 - DNA, 1029 bp, Homo sapiens
gtctgagaaacgctgccttagaagtttgcagtattgcaatccttccaatccccaactccaatctcatcagcgtgagaaaaaaatggagcgcacacacaccgtgcacacggccagcgaccagcccacggtggggttgggacacctgtcaccctgtcctccccaacagttccccatccgctcaccttgatgcgctccccatcaatctccaccgctcgttctcggaaatccacccctatcgtggcctcggtgcggtcggggaagcggccagcgcagaagcggtaggtcaggcatgtcttgcccacattggagtcgccgatcacgattatcttgaagatgcgggagcgggcaggaggcaaaaaccctgaggcccctgacactgccccgctggacgaaaagcttgcctcgagcgacgactccatctcctcagccattcccccgacccgccccaaactgaggcggaggaaaggagacacagaaaggctgagagattacgccaccgcaagagcgcgcgcccagccggccagttcggctgcgcaacttcccaggagccaccgcccaccagccccgagcgcgcctgcgcaccttcccgccccgcccttgcccgcacaggtgtggcacccgcccgccccgccgcacggagccgcctgcccgcggccacacgccaggcgtcactcgggctggcgccggtctacctaggcaggcgtgggacctgtcgggggcttcacggcagcgcggaaggccagcctgcagagaggctgggcccagcgccctgactgacccagccccgccacgtccaaggttcccgccctctggaggaagccgcgcaatcactccgggggcggggagagacagacaactgagaggaaggaggtaccacgggcactctctcgcgagagggccgcagagccgcctttgacgggggcgtgtacctggagagcaacggtaaggacggagccgacggctccggcgtcgggtcggttccggcatcgacgtatcgtttggtcgccccagagaggagacaggtttctt

SEQ ID NO: 1462 - DNA, 1062 bp, Homo sapiens
aatgcacacctggtaaccctagtactggtctaaaaagaaaaccaacctagaataaggtgacgattgcaatccccagctgcgagggctggaaggggcctgcagagcccacctagccaagcctttcatgttactcaaggggaagctgaggccggacaggcagagcagccgtgaccccgcgtgccagtacctggcactctacccgggtctcctagctctgatgcagggctgtcctgcccgagaggtgggaagagggaaggggtgatccaggtcgtcccccaacccccctgcgttctgaagccacgctcaggaaccccaggctgcgggggcccggggtcctagcggctgaggcgaacgaaaactacccgccccgggcgccgcctgcaccctccgttttggaagaggaaaagcggcacctcctattctccccacacgcctccccgacgggccgtccccgcctagcccagcgggcacctggaagcggagacagcccttgcgcagcacctcctggcagctccggccagccacgccgaacttcctcgggctgcgcagggcccgcagcttcacgctcttgggcttctggagcattgcagatgtcctcaagccctctgggtcccacaggcggtggcacctgctgcccagctgctcagatccgtcctcgccctggccgcaggggtctgcacctggtgagctctgcaagctggcacaggccgggtgccgatcccggaaactacattacccagaaggcctgggaaaagtgaggcccgacgcggtcttgtgcgcaggcgtcgccccacggacaccacattaccttactcagaaggctcaggaaagcaaaggcgcgacgccacctggtgtgcccaggtgccgtggccccggaaactacacaaccctgagggccagagtagcggagccctccccttgtgcgcaggcgcggcctggggtggggcggggtcgcgcacgcgcagaggccctggcccagggctgggcttggttgtcatgagagtggaggctgcggccggggctatgggcagaggtggccgggtctgcttcttccctgtcact

SEQ ID NO: 1463 - DNA, 991 bp, Homo sapiens
ttttcattgagggagagcttgagttcatgataagtgccgcgtctactcctggctaatttctaaaagaaagacgttcgctttggcttcttccctaggcccccagcctccccagggatggcagaaacttctgggttaaggctgagcgaaccattgcccactgcctccaccagcccccagcaaaggcacgccggcgggggggcgcccagcccccccagcaaacgctccgcggcctcccccgcagaccacgaggtgggggccgctggggagggccgagctgggggcagctcgccaccccggctcctagcgagctgccggcgaccttcgcggtcctctggtccaggtcccggcttcccgggcgaggagcgggagggaggtcggggcttaggcgccgcggcgaacccgccaacgcagcgccgggccccgaacctcaggccccgccccaggttcccggccgtttggctagtttgtttgtcttaattttaatttctccgaggccagccagagcaggtttgttggcagcagtacccctccagcagtcacgcgaccagccaatctcccggcggcgctcggggaggcggcgcgctcgggaacgaggggaggtggcggaaccgcgccggggccaccttaaggccgcgctcgccagcctcggcggggcggctcccgccgccgcaaccaatggatctcctcctctgtttaaatagactcgccgtgtcaatcattttcttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagac

SEQ ID NO: 1464 - DNA, 920 bp, Homo sapiens
tagaaccatgagtgagagaggggaggcttccagaggcctggcctgggtccctgctagattgagggctctggctatggtacatggatatttctgctgtggaatcaaaggagcaggggatgctgaatatcccctctggccctatgccctgctacctgtcctttcacggaagggtgtgtgtgtagggggtgcaggaccaggcctccctgggtgcatctctgccaccttgccctttggctcaggtggacctccaccaggtattcagaactccagcccagaaacgcgccaagcctgtggggccaagacctagggggtgggggtggcctccctcccgcctgtagccaaagggtcctcccttgcccagccaggccccggtgtcgcttactgctcttatccacccctccttcccaggccggtcctcaaggccccagcaaaggaaccaagttcccgtgagcctccgaaaggcgaagggcaggcagcagccgctggcttctgcgcccactaggagcttcggatgcccgagttagggctgcgccaaggcggccggagcagagagggagacggggacggggacaggcagggacaaagtgcaagaggcaaaactggctgaaaagcagaagtgtaggagccgccaaggggcgggacgaacaggtccgtgggccgggcggagccaagggtgggggccggggtccctccaggtggcactcgcggcgctagtccccagcctcctcccttcccccggccctgattggcaggcggcctgcgaccagccgcgaacgccacagcgccccgggcgcccaggagaacgcgaacggccccccgcgggagcgggcgagtaggagggggcgccgggctatatatatagcggctcggcctcgggcgggcctggcgctcagggaggcgcgcactgctcctcagagtcc

SEQ ID NO: 1465 - DNA, 1046 bp, Homo sapiens
acgcgtccagactgcaaacagtatttcatcattttgtctgtagcatgcagcggccaaagctgccaacctatgaaacgctttgagaagccggacgctttgggaggccgaggcgggtggatcccctgaggccagcctgggagacatagttagattctgtctctcaaaaaaatttttaaaaaattacccctgatgtggtgcgcgcctgtagtcccagctactcgggaggctgaggcgggaggatcgcccgagcctgagagttcgagaccagcctgggcaacgtagcgagactccgtctcttaaaaaaaataagtagccgtttttctgggtgggtgcatccctctctggttcctcgctctccaactggccctggtcctgggggcgtgaaggctacgatctggagagacagaacagcgggctgcctctggaggacgggcctagaccccattcattcattcattcgttctgtcacccacccgtcctgcgcgcacgcgagccaccctaagccccaggacctcaagaacccccaccccacggggcacagacaaggacaggctggccagcgcctggaagccgcgtgcctgaccacgtctgcccgagcgagtaccgcctcccacccgggaggcaggagagccgcgaccgtcgggccgcgcccaacgtctcccgctcaggggcgcgccgcctcgctttcagcgcatgcgcgcccgggagcccgcccggggcgtcggcgcacgcggtccccaccggccggcttgcgtacgcgctcccggctcgccctcccacgcggtccaccgcgcctcccgccccaccctaagcgcagcgaccgcccgagcggccgaccgaaccgcgttgcgtgcgtgcgcgcacgcgcgggccacgtgggcgggcgccgcgccgttgccccgccccttgcaaccccgccccgcgccggccccgcccctgctctcgcgccggcgtcggctgcgtctccggcgtttgaattgcgcttccgccatctttccagcctcagtcggacgggcgcggagacgcttctggaaggtatcgcgacc

SEQ ID NO: 1466 - DNA, 959 bp, Homo sapiens
acgtgggtcacacattgtagatggccacatcacctggcgcaggtggtccagctttggtcgccattcatagagggaagggttcccaaaaggcacccaagaagagatgaagtttgttaaaccaaagcttataggtccagaaggcagtcggacaactggtcatttccagggatgaacagagagggcgcccttccccagaggcacaaatggccaggacgcaggggtgggacaagccagtaggaagcccgcggggctctcacagcgcaacctggttggacttaaggaccctggacaacaaacgtcaggagagctaggaggctggctcttctgcgggaggttatagagcggatcacctgggcgcaatcgccgcgtagttgaagtttccctaaagtctcagtggggcttttcctcccgtgagaagccccattcctgagtatctagtcccggaggctccgcactgcttccccacgccccctctttcttcgccccagctctgggcgatctcactgccgggcacagggccgcctttgcctgcctgccctgcagcagcaggcccgggcggctgcgagagggcgcagggggcggaggcgcggcaggggcgggctctgccgcccgccccaccacccgctccccgcccggctgcggggccagtggcaggagcgccgcgcaccgccagccgcagggggcgtgggatgggggcggccggggaggggggcgcccacactgactagagccaaccgcgcacttcaaaagggtgtcggtgccgcgctcccctcccgcggcccgggaacttcaaagcgggccgtgctgccccggctgcctcgctctgctctggggcctcgcagccccggcgcggccgcctggtggcgatgacccgggcgctctgctcagcgctccgccaggctctcctgctgctcgcagcggccgccgagctctcgccaggtacggtgctggtttctctc

SEQ ID NO: 1467 - DNA, 1033 bp, Homo sapiens
gcgcctagtaactaccaggttcaacgctcccaggtggccgacatgtgatgtgctctactgtttgggctggggatattagctcaacaaactctggccacaaggatcacgcggatattcttggggatgcctagcgaaatgcgctgtacctaggcctcgaactctcgcctgctctccggtgggcggtctcgaactccagcctgctctccggcagcccacagcaatgcgcctgccaagaccttaggctgcaaaactcgccacggcccagagctcgcctccaagtgcgccccgcacagggcaagctttcggcgaggactcgcgtcccacccatctagccctggccgctgtcccaactcccgcagttcacagaggcggcggcggtgagcgcagccgatgccacatcctcagcggcaagctgaagaaacctgtctcctctctggggcgaccaaacgatacgtcgatgccggaaccgacccgacgccggagccgtcggctccgtccttaccgttgctctccaggtacacgcccccgtcaaaggcggctctgcggccctctcgcgagagagtgcccgtggtacctccttcctctcagttgtctgtctctccccgcccccggagtgattgcgcggcttcctccagagggcgggaaccttggacgtggcggggctgggtcagtcagggcgctgggcccagcctctctgcaggctggccttccgcgctgccgtgaagcccccgacaggtcccacgcctgcctaggtagaccggcgccagcccgagtgacgcctggcgtgtggccgcgggcaggcggctccgtgcggcggggcgggcgggtgccacacctgtgcgggcaagggcggggcgggaaggtgcgcaggcgcgctcggggctggtgggcggtggctcctgggaagttgcgcagccgaactggccggctgggcgcgcgctcttgcggtggcgtaatctctcagcctttctgtgtctcctttcctccgcctcagtttggggcgggtcgggggaatggctgaggagatggagtc

SEQ ID NO: 1468 - DNA, 1093 bp, Homo sapiens
ctccctttctgtgctgtgagtctgtgtccagagcaggaagggctgctccgagctgcagggacgggctctgtgtgttaaaccttcaaatggcttccagggactcatggagcatccaggacacctggagatggcgactcctgggacccctggcccttccctcctctggccttcggtccgtgagggtgaattaagtgtgccacccaccaggggcagagacacatggagacagagattgagagacagagaacagagggggagacagaaagagagagggacatgaagagcaacggagttacaggaggatctgacgctccgttggggagacagggagaaatgtggggagatgcagcgtcccaggtgctccccagtggccctgcccctcctcccctctcccctccccaccaggcaggaccctcagggagctccagcctggacccgaaccctgtcccaccctgacgcacctgcaccaggccaggctggacctgtggggtgggtgcaggcctggccccagcccggccactgccctggaaacccctcccccgccaagatgctgatgtaacatccaggatttgatgttttactctccaattctgcaaatccagacgcaggaggttttaagaggccgttgcaccctgcaataaagtgcgggacacaggaatcttggtcctcggggcacccccttccctcgggggggtttcgccccccgcactcacggcccctgagcccgcgcggaggcccgacgccccgcggccgacgccggtccccgccccgggccgccattggctgttgccatggcaccagcccgtcttcccgcgccctcattggctgtctcacccgcatccctcatcccgcatcctcccccgctcgcggtggtctcgcccagcgctaggagcggcagcgccgcctgcccaggcccggaccgggctttgtccgccccggagcccctgcccgcgccgcggagaccccggagcccgcgcgctccgaggccaccccgggccgggatttccggtggggcccgcggagccgcgcagagggaggaggccccagacccaggcgccccgccagcccagctgcacgtaagcgggtgtgtgtc

SEQ ID NO: 1469 - DNA, 921 bp, Homo sapiens
ctcctgatcttttcagctgcattgggtaaatccttgcctgccagagtgggtcagcggtgagccagaaagggggctcattctaacagtgctgtgtcctcctggagagtgccaactcattctccaagtaaaaaaagccagatttgtggctcacttcgtggggaaatgtgtccagcgcaccaacgcaggcgagggactgggggaggagggaagtgccctcctgcagcacgcgaggttccgggaccggctggcctgctggaactcggccaggctcagctggctcggcgctgggcagccaggagcctgggccccggggagggcggtcccgggcggcgcggtgggccgagcgcgggtcccgcctccttgaggcgggcccgggcggggcggttgtatatcagggccgcgctgagctgcgccagctgaggtgtgagcagctgccgaagtcagttccttgtggagccggagctgggcgcggattcgccgaggcaccgaggcactcagaggaggtgagagagcggcggcagacaacaggggaccccgggccggcggcccagagccgagccaagcgtgcccgcgtgtgtccctgcgtgtccgcgaggatgcgtgttcgcgggtgtgtgctgcgttcacaggtgtttctgcggcaggtgaatgacgggcgtgggtcggtgcgcgctcggcttgcgcacacggtgtctctaagtgcgcgggtgacgagagtcgggatgtgccggagaccccggggcggagagcgggattacaagtacaggaatccctggtcacgctccccgcccctggaaacccagctggggcgagggagggcgtggacgggaccgttctgggagctcgcctttggctgcggttggctccaggccccaggcgcagtttgctcgcggcgtggggatgaagtccgtgtccctggag

SEQ ID NO: 1470 - DNA, 1083 bp, Homo sapiens
agtagaggctgtgggagagagcgcgatgggccgcggcggtgggcgcacgttccgcggggactcatgccacgcgcgtcccggcccgacgcgcaattagcagccacctccgcagcccgccgccaccgcctccctgccctcccgggctgccgcagctaggagctccagccgtcgcctcgcgcaggctgcgggcattgtcctctcggttcgccgcccgggctgctgctgccgccgcggactgctgcggggcccggacccgcaccccagggatacgctgccgccgccgccggccggcccggcgcccggcctccgttcggtggtttccgccctgcgttctctgggttgctctctcctgggtttttcctgcgtagctgaggaaggggaagagaagtccagccgccaagcccagccttccccggcgcgcagccccgacggggccgcggcaggcgcggcgagagcgctgacggagccatgagagagtacaaagtggtggtgctgggctcgggcggcgtgggcaagtccgcgctcaccgtgcagttcgtgacgggctccttcatcgagaagtacgacccgaccatcgaagacttttaccgcaaggagattgaggtggactcgtcgccgtcggtgctggagatcctggatacggcgggcaccgagcagttcgcgtccatgcgggacctgtacatcaagaacggccagggcttcatcctggtctacagcctcgtcaaccagcagagcttccaggacatcaagcccatgcgggaccagatcatccgcgtgaagcggtacgagcgcgtgcccatgatcctggtgggcaacaaggtggacctggagggtgagcgcgaggtctcgtacggggagggcaaggccctggctgaggagtggagctgccccttcatggagacgtcggccaaaaacaaagcctcggtagacgagctatttgccgagatcgtgcggcagatgaactacgcggcgcagcccaacggcgatgagggctgctgctcggcctgcgtgatcctctgaggcggccaccgcgcgccggccgcgctctgcgcacaaaagccaaacgcatccgactctctaaat

SEQ ID NO: 1471 - DNA, 1031 bp, Homo sapiens
gcttaccgggactctatctccatactttggagcagggcaagccagggcctgcctggactggccattaggcctgcctagcttctgcatagcccggggctgggcggtccccgggagtgctgccacctcccctacactttcatcctgaggcaggatttgctagacgtcggcttgcctctcttccccagcaggagggcaggagtcactaagtgctgcagaaaagatccgcgctggagattgcccgtcccccccatgcctttccccagaaacagttgagagaatgggtagctggtgggaccagaccggtttcccagaggacaggaaggccaataaaaatatcagctgcctgcctggagtgtggtgtcttcaagggtgggggtggcgaccaggcaccccaggactgggctgggcccgacctcggtggcagggctgcggccaagggaggaatgtgggcgcagccggaggctggggccgaggttcctctggcccagcgcccagtccagcctccccgccccagctgggctccccggagctggttgccaggcttcggctgcctagcacctggaagctggggccacggttcctgggctgctcacggccccggaggccgagctgttgcctctggagaagaaaacctttgtggcgcggcccgtccccttttccgacccgcacttccccggggcccgcgggctctggggagaagcggagccacgatctctgtcccccaggggaaagaaaagcccatgatcccgtgggtgggcgagactggcggtcaccagacccaaaaaccatgcactcgggggtgggcggggccgcgagggcgcgcattaggaccgcgcggccgcggtccgccctctcttccggagggcgggcttcacagccgagccctggccgcgaccgccagtcggcgccgcccggagccgggagcgccgctccagcgaggcgcgggctgtggggccgccgcgtgcctggccccgctcgcccgtgccggccgctcgcccgccatgcctggcttcgactacaagttcctggag

SEQ ID NO: 1472 - DNA, 912 bp, Homo sapiens
ttccctgagacactctcatctccagatgtactccccacatgcagttatccacgcttcgcctacaggtgtgtgccccacttgtggctagttctcctcggaagtgtcaccagtattcacctgtggtcccctcctcctcagatgcggcccccagtccagctgtgggcccctcctcccagttacatccaccatcccccgcaatatgcatcttcgttctagacatggcccctcgtcctcggatgggctccttcaccccagatgctccccccacgtccagctgcgcgtctcccctcgagcagccccatccagcccgctcccgaccctcctactccccccctccccgcccgctgcggcaccttccagccccgccgtcccacctagctgtgcctctcccctccccaagatgtgcacccttcccgcccctccccactcacctacccgccccggagcggcgtccacctcccacaatgccccgcgcccaggcctggcccggcccttgctcccgggatgccccgcgcggtctcccgcctctcttcccgccgtgcctcgcgggggcgcttccaccgattcctcctctttccctgccagtcactcctcagaccctcagccacacccgctcatccagggcgagggaaagcgcgggcattttcccagtgtgctctgcgggagggctcgccccacttcaccccttttcccgccctcctcccattcgggagactacgactcccagtgtcctccgcgcgacggcggcggtgcggacggtgcccaggtcccgcccctaggctctgccccgcccccgcccgcagacgtctgcgcgcgaatgccgtggcgcgaacttgggactgcagaggcgcgcctggcggatctgagtgtgttgcccgggcagcggcgcgcgggaccaacgcaaggcaagtg

SEQ ID NO: 1473 - DNA, 1013 bp, Homo sapiens
agggcatctaggatagttggaggaagggtggtatgtgaagggcctctggagagccaacgcttctcgggtgtctcagcggctcaccatagagtttgggggttctgagttgcatctgggggtgagggaggaagcaggccaccagaaagggctagtccatgagtccgggaatcccgcccgaagctctggcagtgacccgcaacatgccaggcaccggcagccctcgggtaggggctgaagcgggcggcagcagcatgcgcagtgtggccgccgcgggtacaccgcggcttttgctgctgccacagctaccagggctgctgctgctgctgctgctgctgctgctgctctgcctgcgccgctgtcacttccagttcctacttctgcgatccaggtccgggtcactgcttacccgctgctggcccagtgcctccaggccgctttccctccgctgctcggctccggctgcgggcaggaggggaccggcgcgggtagctgagcgtggtctggagaagcttcgcgggctggctcccccggcagtcgctcccctccactcgccaccccgcgcaccctcgcccggctcgcagccagcgcacccagcggggcgcgcctccggcacccccagttcggccccgcgatcctccgcccgccgagcggcacggctatggcaacaagaacttgaggacaagactctgacttccctttagattaaaaaacaatccctgggctggagaggttgcgggcgcggcacagagtttggagacgggcgccccctcctcgcccgcgtccaggcgcaaagttgcagccgcccctccccgctggggcgagcctagcccagctctccagtttcgccctggtggcggccgcgctcagggcagggtcccagctccggctgggttgatctgttcccgcagccttggcacaggcttgcccgcccgctcgccggccccgtgactcgggagggcgaacggcttccaggaggcggcggcggcgcggctggagtgagggagcagctggag

SEQ ID NO: 1474 - DNA, 903 bp, Homo sapiens
gaaatttgcccctcaagagtgtagaagtgggtagcggaagatgtggcctggagcatggtaaaagccttgaaattccagactctgcttgactcctaaacctggcaaggcagccctcgggccaggcaagccaggcgcgagactgtgccttccttccaggccctaaagagggcagcactgggccgggccccgggcgagggcgagggacacacgcggtccggcacactgaaaggggagtgtcgggtaacatgcccgggcaaaagcgagcgccgcccctgcctctccgctgctggctggaacgctgatctatctagttgctggggagacgcccccagatgcccgggccccactcggacttcagcacacatcccgaaggatggggaaagaaagaggcccccacgagcgggactcgcagtggccaaggaggggtgagaggcggacagggatcagctggcccctgcggcctggttgcacctgcatggtgactagctgccgggctgcgccccggggcgcggcgaggaggcggggtctggcagtgcgttgggtgggggaggagcttctgggtgatgtaaggccgggaatgggagtggcctctcctcgactcgctgctaggaagggggcgggactctcggtgaccagacgccggggagggggcaggcgttcattgataaaacgctgggctcccctgggcgccagcgcagcgtagcaaatccaggcagcgccacgcgcggccggggccgggcggaaccgagaagccgggaccgcgctgcgacgcgccggccgcatggagcctgccgccggtttcctgtctccgcgccccttccagcgtgcggccgccgcgcccgctcccccggccgggcccgggccgcctccgagtgccttgcgcggacctgagctggagatgct

SEQ ID NO: 1475 - DNA, 1084 bp, Homo sapiens
aggagttttccaccgggaattaggggtgcagggctctgtctcgccacatacccttcgccccggggcaggtccgggcctcacaggcgcctcccctggatctctgcagccccggggcgcacgaagacccccagggacctccgaaggttggcgaggtgggcgtccacccaacgcagcctgaccccacagtcccggagcgccgcggtgaggcccggcccacgggccgccctccggtggaccccactactggacacaaagggaggaggtcttcccggcctgtggcgcccttcccccgacggcggctgcaccccggagggagcccggcgctactccggatgccgctgcggcacctcaagtcttcgcgggtcgccgactgcccagactccccacctctggttctatcccttttgcccgggatagagcagtcacgtccactcgctacctcttcttctccgcctctggacagcggagcagtcaaatcccgccggatccacccagcccggacggcgcgcgcccgcttatgcaaataaacacaccccaagccccaaggggcggccaccgctgccgccgcgcactcctgccacggctcatgcccgcgcgcgtagaagtgcccgcctaccccgcggacggggcgtggctaagcctcagggacgcgccgcgttcccaccaatgccggactcgggcagcggcggcgcgcccgacgtggcgcgcgcgaccccttcgtcctgcccctcctcctcgggtcccgtcggcctgcgcgcgcccgggagtttgaatttcctcggatttggagcaatatcgcagtggaaggcgctgtgggttgaggtcgccgcccacctctcctaggggaactatggagctggcagctgaaagactcagtgaagcaacgaggatgccggggagagggaaggggctgggctctgggcggtgccaagtctgtgagggggcgcggtcaccgcccagggttcccacgaacgccaaggcggccacgtcctgctccccctggtgaagaagctgccctgggcttgtcgtcctagggtctccagacatgtctgaggtgaagagccggaagaagtcggggcccaag

SEQ ID NO: 1476 - DNA, 1031 bp, Homo sapiens
gaaactcagaatcctcaggggttcctgagttcataaggccaaagagaactgacctgaggctggcgcgggtttggtggaccatcctggtgtccttggctcctcctgtcgcttcctcctgggagcaggggagagatgctcggtccagggagacttctgggaggtggaggccgctcgggacggctgaggctgcaaccagacaggcggaggtgccgatcgagatgacactgtcccttggcgttggggacccggggcagggcgaggccagagagctgaacagggaggcactgatgcccagctcgtcgccgtccctgggctggccgcacacgctgaggtccgggctgaggcggccggagtcgcggctggggaagggcggaagtcggagcgggccgcagggtgtgctgcacttctgcgggggccgagctcgcagccccaggcgtcttggggtcacggttaggcttgggcgagctcgcagcttccagcgctttggggtcacggtcaggctgggccggtccttgggcactcggccgccgggacgcctccgccgccgcctcaccgggctgccggggaagtcggggtcgtcgggatcgtcaggatcgtcggactgcgaggggtcgccgatgctggcgtcgctgctgccgctgctgttgaagaaacgcctccggtcctgcggcgggaaccactgcgcggcttcccggcccggccgccgctgtctcctgccgtccgcagccccatatgtgcggaaaagccggctcccaggtcccgggagcgaagccgccatggccggcacccgccaagaggttcaaacgcaaacatcgcgagacttccgtgcgacgcggacgcgcccgcctgccgcggggtcctagctcccggccctgcgcatgcgcacctcgccagggccggggccgggacgggacggaaaactggcggcttggtttgttcagcgcgtcgcggtcatggctctcgtttcaggcctccacggtgtgcacctggagtcaggagcgcgcttgtgcgtacagttcggttcaggtaag

SEQ ID NO: 1477 - DNA, 915 bp, Homo sapiens
ctcaggaatgagtctcccaagaatagatggccgggggacttacccaaatacctaatgtcacagtccggtctccgaccgacatcaccttggccacgaaggcggccccgatggtctgcaacgagagggaagagatcggggccataggtgcagattaccggccccccactcccccgcccaccgtgcctggcccctccggatgcactcacgttctgataaggccccaccagaaagcggtcgtgcacgtagcgctccaccaggctagtcttgcccacgtactccttgcccagcatcaccaccttgacgtccacgcgctgcccgctcatgctcccggggccgcttcagccacgtcagggtcctgagcggggacgggaggcaaaccccgatctccgctcggcccaggcagcgcccaagcctcagaccccgaccccaaacggcgccaacctacgactccagacagcgcgtcgggctcgagctctggccgtggccttgcacttcggcagcgccccgtgtgcccccgctgttcggccccgggcgccgattatccttcgaagaccccaagcctcggggcggcctgggagcgcgcgggacagcgtcctcaacagcgcagcacgccgccgtgcagctcgctactccgtcattcgctcgcctgcccggcttaagctccgttctggctgggaatcccaaccgaacctggggtctcccgcaacccggctcctacccgcagcgccgcgactcccgcgggagggggctagagggcgagggggcggggccgcaaggtcacgtggcgcgggcgccggaagcggtggctactgtgtggctgcgccggaagtggcgcgcggccggacaactcatggcggcggcggcggcggcggcagctgcttgggcgcggtgcggtggtgactgagctacgagcct

SEQ ID NO: 1478 - DNA, 1083 bp, Homo sapiens
gatctgggttccaagaaggagttgtgtttgaggtggggtctgggtcctcgtggaagtcaggactcccaggcagaaaagaggcaggctgcagggaagtaaggaggaggcatggcaccttctcatcgggcatcacaggtggggttttgccccacccctgaacgccctctgtggcgccttccacccacctgtaggcccagaaggatgtcggtctgctaccgtcccccagggaacgagacactgctgagctggaagacttcgcgggccacaggcacagccttcctgctgctggcggcgctgctggggctgcctggcaacggcttcgtggtgtggagcttggcgggctggcggcctgcacgggggcgaccgctggcggccacgcttgtgctgcacctggcgctggccgacggcgcggtgctgctgctcacgccgctctttgtggccttcctgacccggcaggcctggccgctgggccaggcgggctgcaaggcggtgtactacgtgtgcgcgctcagcatgtacgccagcgtgctgctcaccggcctgctcagcctgcagcgctgcctcgcagtcacccgccccttcctggcgcctcggctgcgcagcccggccctggcccgccgcctgctgctggcggtctggctggccgccctgttgctcgccgtcccggccgccgtctaccgccacctgtggagggaccgcgtatgccagctgtgccacccgtcgccggtccacgccgccgcccacctgagcctggagactctgaccgctttcgtgcttcctttcgggctgatgctcggctgctacagcgtgacgctggcacggctgcggggcgcccgctggggctccgggcggcacggggcgcgggtgggccggctggtgagcgccatcgtgcttgccttcggcttgctctgggccccctaccacgcagtcaaccttctgcaggcggtcgcagcgctggctccaccggaaggggccttggcgaagctgggcggagccggccaggcggcgcgagcgggaactacggccttggccttcttcagttctagcgtcaacccggtgctctacgtcttcaccgctggagat

SEQ ID NO: 1479 - DNA, 1066 bp, Homo sapiens
gccggtaaagttgtttctcctctaggagaaacattcgctaggccttgttgccaacccgcaggcggctgggcgcttcatcccaccctcacccctttccagccaaggtggctgatgggagtcaggctctcgagggcgcattgccacgaaacagcgtgtgtgagcgcgttgtccccggcccccggcgccacttcccctcggcctagcagcctggactggggaaggacgggtctgctgtacccgggaggtggaaggaaaagccgaaagcggagaagtgtgcgggaggggagtctccgcgcggaggcagcccggcctcctccagtgcaggctgcgcgctggggagccagccagggtgagtcactcccggccgcttccctggagggcggcggccacacacacacccgcccatctagtgagggccgggcccagcgctggcgcctagctccagccgggcaccagcgtttcgcgaggcgccgccgccttaacttccttgcgcgctcacgcccaggggccgtcccaggaatctccacgcgcgctcgccggcttcccgagaggcagctgccctgcgtggcccgcgcctgccggtcccgcgaccagcaccgagcggcgcacgcgcactgcaggacgcgcgtccggctctcccccagcctctatccggcccggtctcctgccattcggggagactgcaggccaaccgggaggctgagttcgaagctagcagggcggcgaagccagtgtcgcccgcggcgttgagaagacggtgtggccccggagagggtggagacaactgtgacgggcttcccggctgcccgaagtgggagtggtgtggggctgcaggaaggagagaggaagaggagcagaagggggcagcagcggacgccgctaacggcctccctcggcgctgacaggctgggccggcgcccggctcgcttgggtgttcgcgtcgccacttcggcttctcggccggtcgggcccctcggcccgggcttgcggcgcgcgtcggggctgagggctgctgcggcgcagggagaggcctggtcctcgctgccgagggatgtgagtgggagct

SEQ ID NO: 1480 - DNA, 945 bp, Homo sapiens
tgtccaactgtctctgtctctcgtctaccctctacctggcccccctccctctgggagacacctctctgcactctccggcggcccgcagcccgcgctcttccgtctccaccgcgctctcggcagcctcagcgtccccacgcccactcctctgcagacaccccgacatggcgaagcataggccccaagcattcggcgcacccgccgccctccgcctcccatctgcttgcggacggccccacttgccttgcgttggtcccgcgcgccgctgcccgggcaacacactcagatccgccaggcgcgcctctgcagtcccaagttcgcgccacggcattcgcgcgcagacgtctgcgggcgggggcggggcagagcctaggggcgggacctgggcaccgtccgcaccgccgccgtcgcgcggaggacactgggagtcgtagtctcccgaatgggaggagggcgggaaaaggggtgaagtggggcgagccctcccgcagagcacactgggaaaatgcccgcgctttccctcgccctggatgagcgggtgtggctgagggtctgaggagtgactggcagggaaagaggaggaatcggtggaagcgcccccgcgaggcacggcgggaagagaggcgggagaccgcgcggggcatcccgggagcaagggccgggccaggcctgggcgcggggcattgtgggaggtggacgccgctccggggcgggtaggtgagtggggaggggcgggaagggtgcacatcttggggaggggagaggcacagctaggtgggacggcggggctggaaggtgccgcagcgggcggggagggggggagtaggagggtcgggagcgggctggatggggctgctcgaggggagacgcgcagctggacgtggggggagcatctggggtgaaggagcccatccgaggacgaggggccatgtctagaacgaagat

SEQ ID NO: 1481 - DNA, 1002 bp, Homo sapiens
gatccaaagacggtccctgaggcgaggggcgggagaacgattcggggcaggtctgcagttcgaacttgcccagagcaggagaaaggcggcccagtgtcccggtcgtggcaggcgccatctgcccgaccagcgcctgggtcagccccgcgccgccccctgctccgcacgggttaatccccctcgccgcccgctcgccgcccgctggcttcccggtgccaaagtgggtgttgctggaattcctcgctccctctccggtaatgagggggctgagctgtccctccgaggagggggcctggtgtggataaaagagacgaaaaagccgggggaggtttccaaaaataaaaccgtccgggtccccttcagacggctgcaggcacagggaggaggcgcgaaggtgcagcagccgtgcgagcccagctggagtaggagcgcggactcgaggctcggggcgcgcagccctcgttccgccgagagccgggcccccagtcggccgcttcagggccccctagactcagagaagctggccgccgggcggggccgggagaacagcccgcgggcgtccagcgtgccgaccacaaagctcttcgcggtgcccgcgcgcaccactctccagccgccccgcgccatgaggccgcggaccaaagcccgcagcccggggcgcgccctgcggaacccctggagaggcttcctgccgctcaccctggctctcttcgtgggcgcgggtcatgcccaaagggaccccgtagggagatacgagccggctggtggagacgcgaatcgactgcggcgccctgggggcagctacccggcagcggctgcagccaaggtgtacagtctgttccgggagcaggacgcgcctgtcgcgggcttgcagcccgtggagcgggcccagccgggctgggggagccccaggaggcccaccgaggcggaggccaggaggccgtcccgcgcgcagcagtcgcggcgtgtccagccacctgcgcagacccggagaagcactcc

SEQ ID NO: 1482 - DNA, 890 bp, Homo sapiens
gctttcattcttgtgaaggtgctcgcaggcgggcagcgaccacaggaagcggcccagccgctcgatgttgccgccctgctgcagcacctcgcacacgcacgccacttgctcctgcgtgaagccgaaggtgggcagcatggacatggtgccggctgcgtccccgcccgcccgcgcgcgccctcaccgggccgcgcggtcccgcatgggagcttcctcgccgggccgtccgggccgagacgcgggcggggctggccccctggcccggcactggcccccggtgagccccgagtcactgccgtacgtccccgcgccggccgcgggtcccacgaagctccgaaccccaacggcccgcgcgcctggcccaagccctcgcccaagcccgggggccgcccggggcgccgctccgcatgctccgcgcccgcccgccgttccctcgctcgcttctcactcgttctccctcccgtctagctggctctcagctttcttaataatattattctaagcgggcatgaggcgcggcggcccgcgccctgattggtccggttatctgacccggggcctgccagcgccagacaatagtcggagtcaaattattcgccatggagacgctgtcagtcactggtaacccgagcctcggcgggccgggcggctccccccggccggctccgctgacagatcgccccgctccgcgcagaactgagggcggctctactggagcctggggcgctctgagagcctgggaggcggagaggggccgggttggggccggcggcggcggagattgacggggcggatgcccaaagagggagggaggaggaggacaggagagcggggggagcgggcgaagacgaaaaggggtggatcgaggtggggagagaagaggagagaag

SEQ ID NO: 1483 - DNA, 1012 bp, Homo sapiens
gtcatggtgcccgaaataatagacttaagttctaaatatgccagaccacaggcgaccaccgaaattcaaagtaatcctccgcggtaccccagagaaatcttgtcaacgtgccgaggtccagcagcctgcaagacagagcagacaggttagctaaaggtgccaacgtccagggcaagcgtgcaggccccaagccccgcgcgccctgcccccagcggcgacgccagggcagccgcactgcggcgcgcgcccctcacccctcccagccctggtgcctggcggatgtcgggcctgcagggccgcgtcgggcccgcttccactcaccgtgatctagtgctcgtgcccgcgtccgtgcgccggcggccaaggtgcctggccgggccccgacgaggcgcgggagggcaggctcccctaggctctgacggacactcgggggccacagcgaccgatgccggtactccaggtgcctgtggtactgtctgcaacgagaagtgatggggcgatgacagtcgcgagcgggcaccagggggcaaggctgaggagcgctgagtcgccagacccagagagccacccacctggagggacgtgccgccacccgcgccgccggagctccggctccagcccggattccacctgttttggtctcgctcggggaagctgcgcggcgggcgggggcgatctgacgtcatgaggggcgggcctcgggggcggggcgcgcgcgcttccggcccgagccggaagctccgactgcggcggcatccgggacggcgggcgggctggccaccacgggacaggaaggtgagatccgggacctcagctttgcaagcaggctccgccggcgaccgctgacgggcgctgggctcgcggcgctgcaaggcggcgaggcccgggcctggcgccgcctgcgcagccttggtcgcggcgtgccggcgctgcagcgcggcagggggcggggccggccgcccggaggcccaagtggcggggacgcctccctgccgggtcaggttctcagagc

SEQ ID NO: 1484 - DNA, 979 bp, Homo sapiens
ccagtgcagccactctcctccggccgaacaaagaggccccgggacgccgcggagcctgccatgcccggacgggtcgcgccagaccaaagggccaagggcggaggcggcggtcacaaagcggcttttgtgccacccacccggcccgctgcggaagccgaaactgcccccggccgccgcagaagccggaccgcgccgcccccgtcgctccgggctcgggagggactcaaaagccggtgcctccggcggccaaccgccaccccgcagccccgaggggcccggcatctgcctccgcacagccggccgcaatcggccggccacagggccataacccgcccgctcccacccgggacccaccggaaccgcaacccggggcaacctggaggagacgccgggctccgaacaaaggcgacagcggggatggggggccggtcgtggattcccagcccgagaggcgacgatgcgacggctactcacaggaatatgtttactcattgaagattgtggcctaatcatacagccggtcccgaggcggcggcgacacaggcggtggcggtggctgcagggcaggaggcggcggtggtcgtggcggagcggcggtggcggcgatgcaggcggcggcgggggcaccagactctaccatgcagtgagcggctcggagcagagcgcgtagccgagccggcccgcagccgaaggagccaatacacgcgccgaggcgcccttgcgtcacaagccctcccctttatagccggcgcgacgtgcaaccctccagccaccaatcgcggcctggaaccgcgggccaggagccgacaggcgggggcggaggcccgccccctccggacgtcactccgcggcggccgccgccggtgtgaaccggttgatgaatggctaagcgccgagtcggagcatccccggggcgggggagggaaggggctgccgggagtgctccgggatgcaggaagcctgaagttaagaaggggtg

SEQ ID NO: 1485 - DNA, 998 bp, Homo sapiens
gaacgtgttatttccgtggtctcccatgcaccccggtttacgaggcgttccttgtaggtcggacgggcatccctgtcgcagggcgcctgagtgtgtccttttctccgactgactctcggaggcttggggctgctgtttctggggaagccactcccgggctgaggatttccttgatgtggagccccgagctcgcggggacgggggcgaggagtccacgggacccgcactgatgcaggcggggaagcagcagcctcccgccagcggctcaagacgccgcgctcgacctctctagcccagtgccggaccccgcccagccaagttattgcggggttgcggggccgggcgggggagagcagggccgcccgagggcagagcgcgcgcgcggccgccgccccacggggtcccgggagccggcgcccggagctgcgacttactcacctctcccttctgcttcttttcatcggcctctgagggcgcagcgcccagggtctggcggaagaccctgatgacagtcgggtccccaagcctcggcctccagtctccccacgtctccatggccaacaccgctctccccggctcgtgccctccccactcccttccggctgccggcgcgccctccctccctggtggccccggctcctctcaccctctgctcccacttgttgcaattgctgtacaaagggccggggcgggggtggggggcgggcgagggcagccgggcccgaactggctgcctctgcccggccacggccaatccagagcgcgcccgcgcgggagggccctgggcagccgccgccggcgggcggagccgcgggcaaagcgcggagctcgccgagtagacggccccgccgcccgctgcccgccggggctctccagcttcgccatgccgccgtggggcgccgccctcgcgctcatcttggccgtgctcgcccttctcggcctgctcggcccgcggctccggggaccctgggggcgcgccgtcggagagaggaccctgc

SEQ ID NO: 1486 - DNA, 1118 bp, Homo sapiens
gaaccttggacagaagctccctagctgccgccgccgccgccgccgccgtcgccgccgccgagcgcgagcccagccgatccccgccgagcgcccccgagcgccgccgagcgccgggaccgcggcggcggggccgcggcgcgcattgcggagggcgcggagcgcaggagctgccgcctgccgggtaagcctgcgctgggcggccgtccttggccctggggagcggagaccggggtcgcgcccgtgcggggtgtccaggcgggggtcctcggccgcctccgtcggcgaccgggcccctcccggctgcgcctggggaccgcagcggcggcggcgggcgggggtgctgcagtggaggcggcgaggctgcgtcgcgggggcgcgggtagggcccgggactggggcggcggggtgcgccgaggcgcggggcggaggggcgcaggggcgcaggggcgcggcgcggagcccagcctggcgctaagaaccatcttgttttccaggcagatccaagggggcagcacgcttcccgggagcgcccccgcctcctctccggggccgccgcaggctcggtgagcggttttatccctccggccggcaggctgggcgcgcaggggcgcgagcccccgcccggcgcgcagcagcaccatgggcacggtgctgtccctgtctcccagctaccggaaggccacgctgtttgaggatggcgcggccaccgtgggccactatacggccgtacagaacagcaagaacgccaaggacaagaacctgaagcgccactccatcatctccgtgctgccttggaagagaatcgtggccgtgtcggccaagaagaagaactccaagaaggtgcagcccaacagcagctaccagaacaacatcacgcacctcaacaatgagaacctgaagaagtcgctgtcgtgcgccaacctgtccacattcgcccagcccccaccggcccagccgcctgcacccccggccagccagctctcgggttcccagaccgggggctcctcctcagtcaagaaagcccctcaccctgccgtcacctccgcagggacgcccaaacgggtcatcgtccaggcgtccaccagtgagctgcttcgctgcctgggtgagtttctctg

SEQ ID NO: 1487 - DNA, 944 bp, Homo sapiens
cccttcttccctaagtggaaccggcagtggcaacaacgaggccgaaggcgaagtccctgctcccaccgccggcacggtgacccttttcccagggtcacccccgaaccaacaaagcacacacacacccgagatgcgccccaggccgcagcgccaaccccccttcagatgtcccggagacaggcgagcagcggtccccagggctcccgtcgccaccgcttctcccgcacccctcagcctcctcgggccggcgacgcgcgcagccccaggcctgctccccgctcgccaagcgcaccgccccgcgcctcagccaccttgaccgagtcgcccacgcgcgggggcggctccgagcgcccatttcccatccccgaggccgaggctggccaggcaggtgctgatggggagcctcgcgcctgcgcgagccaccctcgccgcgaactctgcacagcccacgccctggcccagcctcggcgcctcccctccgcccactgccgcagaaccgcaccccctccccctcggcagcttccacaacggctccgcctcaaccgtcggaagcttctcgcctgccggcttgaaaggccaagccgaagccccaccctccctccgcgccccgccgtgggggaagcccacccaggcactctgctcaacctgcctgcggcaggaggcgtccgcgtagtgtcggtggagccgccccctatgccgccgagcgtcgcaactctgcgcctcagggaccgccgcagcgcctccggcgaacggcggaaggcgggaagcgcccgtccaatccgcgccaggtgcggtcgatagtgcgtccaatcggcgtcgccgccagccaggtcccgccccccccatcccccccacccccgccaacgctcgccggggtcgcccgaggcctgagccaagggggacgctgtgggcgcggctcaggccaggccctcaggttagtgggt

SEQ ID NO: 1488 - DNA, 1094 bp, Homo sapiens
gaaagcgttttcataggggaggggaggggggctccacactcgcgtcagggttggcaaagaacctggcagtgggccgaggctgggtagctgccacgaaggggcgtcccctgcagccctgggtctcccctctggaatctgcccgcaggtgactgtcgcacgtctccaacctccggctcccgggtctgaccccagccccgctgcctggctgtggggtagccccacttccctttcggctggcccgggccgcctgacccgcagttgggccctcggggaggcccgggtggcggcgagggggtgtccccgcggggtccgggaaaaggggaaggggaaccgggaggctctccaggtcggcctcctagaactgcccgctctcccgaagcggcgcccccgcctctgccagaaatcagccttcttagaagggaggggggtggggggaaagtgtgaatgagaagttgggggcggagcgcgcggcggggaggggccgctgccaggaacgcgccgccggggctggcgccgcgcccaccggccgcctcggccgcctctcgtcgcgctttgtctccgcgcgcgtccctcccggtccctgcccctgctcgcggcccgccctcggcgcccgcggcccctccctcaccctccgcgctcagcctttctctgctgcgagtagtgactaaacattacaagaaggccggccgcgcagttccaggaatcggggggcggggcgcggcggccgcctatatacccgcgagcgcggcctccgcggcggctccgacttggactccctgctccgctgctgccgcttcggccccgcacgcagccagccgccagccgcccgcccggcccagctcccgccgcggccccttgccgcggtccctctcctggtcccctcccggttggtccgggggtgcgcagggggcagggcgggcgcccaggggaagctcgagggacgcgcgcgcgaaggctcctttgtggacttcacggccgccaacatctgggcgcagcgcgggccaccgctggccgtctcgccgccgcgtcgccttggggacccgagggggctcagccccaaggacggagacttcgattcgggaccaggtaggaag

SEQ ID NO: 1489 - DNA, 1098 bp, Homo sapiens
agactcactggtgacccaacggtgcgccccgccgccgccgggcggaagtcccgcccctgccccggagaggaagttccgcctcatcgagcgccgattggccgcaccgccttagagaggacgcgcccggggccaccccgccgctccctccgagggttctgcggaagcaggcggcacagcctgcgaggggctttcgtttcccggactcagccgcatcgcctcggctcgggcgcgcctgcatcctgccgcccgtccgcgcgttgaaggggcggatacaaacaacgtggacttccgagcccctgattggcgagcgtgtaggaaaggggcggggttagcagagccgtgatggacatgcaagcgacccaatggcgccggcgacggggcgggcgaggacaacggcgttgtgggccgggggcggggcggccggcggctctgggatttctctgggaggcagccgcagggaagggaatgatcttggtgaacttataatcgaaccaatggttccgggaaagcaggaggcgagtggccaatggcgacggcgatgaggcaggcgtccgctgtctccgcaacgccgtgtgggaaaggcgggggaggggcggtcatgacagacgtgcagacaggccaatggctgagggaaggagggcggcgggcgacctctggtgactacgggaaggcagggcggggtggtgaagaggcggtgcgaccggaggtctggcggcgccgtgtggaacgccgtgagggcggggaagtcgtgacggacgggcgggtgggccaatgggctcgggagggcgggcgaagggtggccaatggcggcggcgcggccgggggtggggcggcgcggcggccctggtggtgcgggaagcggcggggcggcggcgaggctgaggtgcgcccgggcgcgggcggggcggggccggcgctgggcttcgggcgcgcccactcggccgccgtggggcggacgcaacgggcgcaggtgcggggcgcgggctctctcacgccgcggcctcacccggcggtgcttcggcaggcggccggcgcggggcgcaggcggcgcggccatgggctcgcagggcagtccggtgaagagctacgactacctgc

SEQ ID NO: 1490 - DNA, 1018 bp, Homo sapiens
gatctctaacgtggatggagtggcgcgtttcagggtggggctatgacaatgcactgcatgtgcagccgccatcaccgcgccccctccaccggctccgcagtctcctgcccggctttcccttctccacctccatctctgcggcggtaaaatgcagcactcgcagagcgcctgcgcggctttcaggccgggcggcggcggcggcggtggctatttatagtaggtgacgtcaccttgaaatagaccgttagggccggcccgcccttcccccctcccactcccgccgctccccgccgcccggcctggccactctcactgcgcaggcgtcgtcccgtcctcccatcccccagcgcggccgcgtctcctccctcggcgttgtccgcggcgcgagccacagcgcgcggggcgagccagcgagagggcgcgagcggcggcgctgcctgcagcctgcagcctgcagcctccggccggccggcgagccagtgcgcgtgcgcggcggcggcctccgcagcgaccggggagcggactgaccggcgggagggctagcgagccagcggtgtgaggcgcgaggcgaggccgagccgcgagcgacatgggggaccgggagcagctgctgcagcgggcgcggctggccgagcaggcggagcgctacgacgacatggcctccgctatgaaggcggtgagcgcgccgggagcccgggcggctggccggggggggcctggcgttggggagggacggggatggccgcgggcgcgttcccctcccggccatgggcgacccggcgacccggctgggcgtggccgcccgcccgcccttagcccgcgcttcccgctcccgctgggcgccccgccacttcctgaggctgggcccagggtgggggatccgggagggtgcagttcgggatcgcgaaggcagccccggaaggggggcgggccggtcggggtcgccacatcttagttcggaacccggccgggggcagagggtgccctaggggacgcgaaggagccgcatttctcctag

SEQ ID NO: 1491 - DNA, 1041 bp, Homo sapiens
aacacaaggtcctaccacccagtccagggccactagcccatcgtccgccaactgcaggtactcccgggccagctcaggcccaggcgctacgggcaggacgaagtggcagagggtctgcaggtggggcccggagaaccaggagcgcgggccggcctccagcgcctctgagcgccgcagggcgcgcagcaggcactgggccagggccgacggcttgcaaacaaggctgcaccctcccggcagtggctcgcgcccgtcgctgaactggtccgccgggcctccgccgtccgcctcctccccgtcgtctcggtcttgggcccccggcagggtcctctctccgacggcgcgcccccagggtccccggagccgcgggccgagcaggccgagaagggcgagcacggccaagatgagcgcgagggcggcgccccacggcggcatggcgaagctggagagccccggcgggcagcgggcggcggggccgtctactcggcgagctccgcgctttgcccgcggctccgcccgccggcggcggctgcccagggccctcccgcgcgggcgcgctctggattggccgtggccgggcagaggcagccagttcgggcccggctgccctcgcccgccccccacccccgccccggccctttgtacagcaattgcaacaagtgggagcagagggtgagaggagccggggccaccagggagggagggcgcgccggcagccggaagggagtggggagggcacgagccggggagagcggtgttggccatggagacgtggggagactggaggccgaggcttggggacccgactgtcatcagggtcttccgccagaccctgggcgctgcgccctcagaggccgatgaaaagaagcagaagggagaggtgagtaagtcgcagctccgggcgccggctcccgggaccccgtggggcggcggccgcgcgcgcgctctgccctcgggcggccctgctctcccccgcccggccccgcaaccccgcaataacttggctgggcggggtccggcactgggctagagaggtcgagc

SEQ ID NO: 1492 - DNA, 965 bp, Homo sapiens
attgacaaagtccgggatgcagcggcgcgggtggccgttctcgtccgagcagggatcgggctgcgccgcctggcccgcgaacatgctgagcccgggcccgccgcgcaccgcgcccaccaggcacgccaccgccgccagcgccgccagcgcctcccacactgcgcgcatcatgctgcgtccagcttgccccggccctgccgcgccgaggatctgtccgcctgccgcagaaggcgcctgcggagagaagggagctgcgctcagccagcccgccccgcgccctccagctctcggcggggtggcgagcggagatgcgggagaacgcccggcttcctgggcacccaccccgcagccgactgcccgcctctctcccccaaagtcccgcgggcggcgaagccggggccctccaagtccgcaccgctcgcgccccttcttccccgcccggcgggagaacgctctgcttccccgccaccgccgcccccacgccgcccgaggggcatgcctgagccggtctccccgtccgcgaccagcccccctcgcaccccaagtttcgggcgcaggagagctgggggaccccgactctgcacggcccgcgccccttcgtctcgcagcccggggtccctctcagatgccccccgatcgcgtccccgccggaaagtccgcgttcgggactttacctctggagggggcaaaagagaaagaaaagtttgcctggcccctccggggagcccgcgcgccggtcgccggagagcctctcgctcgctgctagcaggcgcgtcccgcctcagcgcgggcttgccagctccatgcccggcgcggccgccgctgccccagccccagccccggtcccggccccgccgccgcctctctcgcccgagtgactacgcggccgcccggctcccgccgctcccgccgagctcggagtgctgccctgcccgcgcccggggcgcacacacactcacgctggc

SEQ ID NO: 1493 - DNA, 1075 bp, Homo sapiens
gtcaggtccctgagagtgggtcccagtggggtgatccctgcgggtcgcgtccctgcgagttgggtgcctgccgggtggcccctgcgggtcgggtgcctgcggggtggtccctatgggtcgcgtccctgcgggtcgggtgcctgcggggtggcccctgggaatcgcgtccctgcgggtcgggtgcctgcggggtggcccctggggatcgcgtccctgcgggtcgggtgcctgcggggtggcccctggggatcgcgtccctgcgggtcgggtgcctgcggggtggtccttgtgggtcgcgtccctgtggggtggtccctgtgggtcgcgtccctgtggggtggcccctgcgggtcgcgtggtggcccctgcgggtcgggtgcctgcggggtggtccctgtgggtcgcgtccctgcgggtcgggtgcctgcggggtggtccctgcgggtcgcacccctgcggcgtggtccccccgggatgggtccaccgaggaggccgctggaggccgagcccgcgcccgcccgcggcgccaagatggaggcaggaagcgccgccgcccgcgcccgccaccgcccgcgccgcccgcctgacgccgccgttgcgcctgacgccgccgcccgcgcggccgcccctcccccggccctcccctccccccgccgtaacgtcctgacgctccgcagggacccctgactggacggcggcgcgtgagcggagcgagaggcctcgccgcgggggggccgcgggctcgccggcgccgcttacctggggccgcgccgggcctgcttaggcacccggcgggggcggcggcgtcgggagctgcggcggcggcgggcggcggcggcggccgcgggcttcgctccttgttggggattcggcggcggcggcggcgcgggcgcgcgcttcctagtgacgcaggcggcggggccgcgcacgcacggggctgggagggccggacacttatttggcgctcgcggaggaggaaggcggggccgtgaaataaggcccgacgggccccggggcgcgtgcgcggaccgacactgtcagctcctaacgccgcaggttcctcctggtccccgag

SEQ ID NO: 1494 - DNA, 826 bp, Homo sapiens
agactgtgagtcaaatcttgccccatgctgcttcaatccccctgtggcttccctttggaggtggggcaggccgaagccccagccctgtcttcctggcctttctctctccagacagccccaggcaggtgctgggatcctcgctcttcactgccttgaatgcgctgaggctgctttgctgcaggccatccctccctgctgttcctaggccctaagtaccttcttcaaactctgtcttttgggtcttgttggagaaaagagtcaaactctgtaaaacagttgaaatttattctgagacaaatgagtgaccatggactggggcaggatctcaagaggtcctgatgcgtaaggtggttgggctacagcttggttttatatgttttagggggacataggccatcaatcagcacatgtgagatgtacattggttcagtctggaaaggcgggacagctggcagcggtggggtggggactccaggtcacagatggattcaaagatgctctgattggtaattggtcgaaagagttaagtcatatctagagacctggatgactagaaaggaatgtcctggtgaagataaagggttgataaggtttggctgcatccccattcaaatctcaacttcaactgtatctcccagaactcccacatgttgtgggagggacccagggggaggtaactgaatcatgggggccagtctttcctgtgctattctcgtgatagtgaataagtttcacaagatctgatgggtttatcaggggtttctgcttttgcttcttcctcattctcccttgctgctgccacataagaagtgcctttcaccctctg

SEQ ID NO: 1495 - DNA, 943 bp, Homo sapiens
ggatagacaatgttcctatgcccttatgttcattcaaaagttaacaatataggttttaaaaaatacacccaggatgtgtgtgtgtgtgggagggggtaaccaaaacacaatataggggtttctactgtgaccctaacttatattatgatcccgatttttaaaaagaggaaacggagaccagaggtgcccaaagttacttggctagtaaatggcagcgtcgggatttaagcccaggcatgtaacttccatgtaacagggaagggagtcccaagcattcagaggggccgctccagcaggcgacgggtccgtggaaaggggtcagattgatgaccagtgctgggggtgccggaaccagcagaaagggtgaacggacccgtcctgcccgactcctctaggccaggaaggcaggacccggcgagctgccggatgagggagccgttgatggagtcgcctgggccgctgtttcgcctcagatctgaccagaacttcctaaggcacagaaagtaccaaagaaccacacacaagcaccccagagcgaagaaaccagtcacgcgccacgaccttcagccagtgtccatgggacccgacccgcctgtgaggagtgcctgtccacccctcaatcagaggaagccttgagcaaggaggggcgggacatcagtaggtcgtgtccaatgaggagccagcgccggattgcttcaggacagactatttctgagtctcggcggaaggcggagggaaggccgtggggatggccaatcaaagggggcgactcaggtcggtggggaccggcagccaatcaggagagcgctcgctcctgactcgaccggcccacgcttcccgccagtcccctaaccctgaggctgccgcgcggcggtcactgcgccggggtagtgggccccagtgttgcgctctctggccgttccttacactctgcttcaggctc

SEQ ID NO: 1496 - DNA, 985 bp, Homo sapiens
aggactggaaggaaattcagctcaaatgaattactatattatgaacttaagtaagaattgttgtgcattttgtacagaatgcaactcctaggagttgacaaatgtttgttaagtgcatcagtgagcgacataggaccttctcctccctactctcttgtcacggtttttatttaatcaaacatttattattgttcgatgctcttaaatgccatttccttcagctgattatttgtatgacagaagagtcaattaagctattttgtcctaaaaattacgaaaacgaaatgtacaattgtgaagtaaaattttgttcctttgcaaattttaataaattattgaagtttattttttgtttcaaataatctgggcttcagttctaataatggaaggacaatgtgaaggcccagaattcagcatagcgcctggcattaataggaggtcagtacatttttagtacatgtttctcaaatagatcttaaaatttcatttaagagcgtttcctcacgtcacagtatgtctctggcgttacttaattttgaaaaacctcaacacagattctagttttaggcaaagctcagaaaatttctacttaaggatatttccaaagcgaaaggaagcgcggagacgttcatgactggcatcatctcgcacgtggttccggaaattctcggtaggatgccctacatctgctctccctccactaagaagaacctctttgtgtggcgaaagtaaaagtattagggcttttaagttgcccagagtcaaggaacacggataaagacgctgggagattgacatgcatttcgaccaatagcattgcagagaggcgtatcatttcgcggatgttccaatcagtacgcagagagtcgccgtctccaaggtgaaagcggaagtagggccttcgcgcacctcatggaatcccttctgcagcacctggatcgcttttccgagcttctggcggtctcaagcactacctacgtcagca

SEQ ID NO: 1497 - DNA, 971 bp, Homo sapiens
atgtgtcgtaggtgagccattttcttccaaatgacgaagagtttttgttcctttgaaagtctggcccaggattttgtttgtttttgtttttttaaagttcttattttacttacagagttaagaaagttgaataactatacaaccagtctctaaatagaagttctaataaatcctaagatgttgcagggcactgaaagaggacaaaatttgatccctaaagccctctccaatctcatactcggtgaaaataacaaacaaaaggcttcagtgttagtggaaaactgagttcttaaaaagcaggtaaaggtcctgtttggtccttctccagagctgaggagaaagggttttcagattataaataacagaggtgcccttgtatggcacagaattgcgataagactttacttcttaggggcttaaataatgaagtcagtaaaagaggactgaaaacgaacataaagaagagctttagctttgacgcaaagaattacatcagtgcttgacaaaaccgaggattcttaatttctaaaaacgctttctttaagcacttcctaacctttcattatctgagacaacatatcaagtgagcagcagtacaaaggatgcatgtgatttcgaaatgccacaattgagccaactgcagttgcacgcgtacgtagtatagagaggtgtgatcaaaaaaagaatatagggagcatagggcttcgtctgcatcaaaagatactctccccatcttctatagccttaagttttgcgaaggtaagtttctccccgcttgaaagcgcccccagggacaagaattcatcttgaccaagcctaaggccgtggcatgcaaggtgttgagtcaccgggtacagcggtcttgcgacataaatattatttgatgacgaaggtactcggggcccaggtgccaaggtaaaccactggcaaagatgaccgtggttaaggcagtagaaagcaggctcgacact

SEQ ID NO: 1498 - DNA, 1081 bp, Homo sapiens
atcaccgagcagatacatccctagattatgagttcctaaacttttacacatctttcttttctaaattttcaacagtaaatactaaagatgaaaaaatgtttctcacagctgtcaagggaaaaggggaaatcccatttcgtgcgccactaatggaagaggaaacagacacgaactctcacttctcaaatgccctaaaaacatggttttttgacccagaaattccaccttcataaatttatttaaaggatcataatggacaggactgaatcatcttatcttttagaattacacacataaggtattcattgtaaaaaaaattgaaaagcataaaggagaaaataaaaacttcgtaatatccccttaaaatacattccatctgtatgcgtcttctaaatcccccagcaaaatcaaattcaagctatatacatctgatgttatccatgatgattttaatgaggtatgtgtttttctaaattattttctgtgctttaaaattttttctacaataaatatatgttactccattaatcataatcaagttaaaaactatctaaaattagtatctttttttttttttttgagacggagtttcgctcttgttgcccaggctggagtgcagtggcgcgatctcggctcaccgcaacctccgcctcccgggttcaagcgattctcgctcctcagcctcccgagtagctgggattacaggcctgcaccaccacgcccagctaattttgtatttttagtagggacagggtttctccatgttggtcaggctggtctcgaactcctgacctcaggtgatctgcccgcctcggcctcccaaagtgctgggattccaggcgtgagccgccgagaaacggatcgcacatggtaatttttgcagcaccacgggttaaatactgtgggccctgaacaccattttcatgtggattccatgatcctcaatgacctcctgactcagaggcacgggagcagatctcccggcttttcctgcccttcgtggcggccgataggctcagtcggaggtgggtatggaggtgggtacggaggtggcaggaggaagctatggacaagagagcaa

SEQ ID NO: 1499 - DNA, 1088 bp, Homo sapiens
cctgatgttacatttctctcaatcatttctctctttctttctctctctttcttttaaagagatagggtcttgctctgtcgcttaggttggcatgaagagcaaaatcatagctcatggcagcttcaaactcctgggctcaaatgagcctcccacctcagcctcctgagtagctgggactacaggcataagccactgcacctggcttattttttgtttatgcagagatgggggtcttactgtgttgtccaggctggtctcaaactcctggactcaagaggtcctccagtcttgactttccaaagtgctggcattataggcatgagccatggtggcaagccctcatcagttatttttctatgattctgtctctctgtcccctccttacaaggaaagtaattttgaaacaaccaatccagtcttggttctttgtttctgctttcttcagcccttctctgtctataaaaccaacctcttctgctcagctcatgggagcacttattctaatttaatggagatgttgcccaatttctagaatcacaaataagatctttaacaataaaagttaaaaaatgaaaatcaacaacaacaacaacaaaaaagatctttaaatgtgttgtaattttctcctttgacaggttacaagtgcaattgaataaaccaaacaaaaaatgtcatggttattcggtctttacttcccaaatcagggtcaagatataagatagcaagaaccaatctctaccataaaaaagatccagacccaagaaaatgtgatttatctttaaagctgcaacgaaactttctttttagtctaggagactaaaagccatcagttgatacaatctctttttttcttgaagtttccaaaggaaggcaggtgagtttgcactgacttccattttctccctggcttccttccggtgtcagatgagagtccccgcgctcctcccggacagccctcagggtcctcggctatcatatatgggggagggggtggaggtgggcgagatggttttgtttgtacaggaaggacgggcggcaggcacggggagcacgggctccggccccgggaacactcactcggcgcaaag

SEQ ID NO: 1500 - DNA, 816 bp, Homo sapiens
tacctgcaatatcatggccttctaactgatttccctgcttctaggcctgttcccccatatcttttcttcacattactcccctccacccccagatggtctttggaaacaagtctgtatcaaattcctgcttaatctttaaagatctgtccatgcattcatccattcttttctctaattcattcagcaaacattcattgtctactggcttgcaaaatccattgaaagttctaaagtttgagcttctcagccagggctctgcctgttctgaaccctgcctgtatctccagcctcttctctgcctcatgctttaggttccagcaacactgaatggcatcttcatgggtactgtgctatttcttctttgtgtacttgcccttgttctctttgcttggaatcttctccctgtttcctttctccacctcctgctcctcacctaattaggctgctccttttcacctaattaacccagtttataaatgggactcagttataaagtttaggtccacctcctccaggaaattttttcctgacacctccttcctcccaatctcggttgggtactctagcattgtgcttccaccctttgcacagagcaatcatcatgtttaccacatctactattaacataattgtttgtgtttttctcctccacaagatttattttttttagatgaggtgttgctgtgttgcccaagctggacttgaacccctaggctcaagcaatccttccacctcagtctcccaagtagcagggactacaggtacgtgccaccatgcctggctaaggctgagttttttgaaggctgggctcatata

SEQ ID NO: 1501 - DNA, 1072 bp, Homo sapiens
attcaggcaaagctgagtaggtggccccgctatcaatttaaaaagagatcggcttacctgctactcgcagagttaccctgggctccaatgcagtgatggcagatggggccgggggccctgggcccggtcagtcctcagcggctaggctgaggagctgcgggaatgcaagcggttcttcactttttgtcttgttaaaggggtggtggctctgaggagcaggcttgtctgtctgttgagaggacagtcggacttccagtggcctgtctgctggcacactggacaaggactctttggcactcaagggttaggatacacccatgcccagtggccttctttgccacacttaaaacaaggcccggagggttgctgctatcgggtcttttgtgcccttgggtgatacggctgggttgatggacagccgctgctagaagctggtatttagcacgatctctttgggctttatctaatttattttgctcatccctgttattaaagactttgaaagccaagttaaggaggtctcgttgtggggtctgaggggcatcttcagcctttttaagtttgcgccagatgtcgggggcagattgggaaataaaatggatgtaaagaacaatagttccttcccgggaggcgggatcgacacgcgtgtatttttggagagtctctgtaaggcgagaaaggaattgggcagggttttcattggccttttgggagattcctttgagtttttcgaaatttacagccttatgggcagttttgttaaggcctgcagtgaggcaagtaatcatatgattacaggaggtctggcaggggcctgtgggttgatacgcccaggtacgctcttctcagggaactgcagcggcccctactggcctagtaggatcttgccgatggaggtcatcggcatgggcctgggctgcaagccacactctttccttttcttccggaaggagggtagaagacaaaataatatagagatcatgccaagtaagttcataagactgggtgagatatttaaattatttgatgtaagtgtcgggatcggagaagaacctggacgtttctcaatttg

SEQ ID NO: 1502 - DNA, 976 bp, Homo sapiens
cagggaaagcgagagaacagtaagcaagaaaaatatactgcaggctatagattggacatgaagagagacagtattgaaggcaagtaaattcggtagaaggattcaaatgcactgtttcctgttatctcagtgacagaaaaaaaaaaaaaaaaaaaggattcaaatgcagtacagcagagaaaccatgagaaccagaactgggtataagtgaaaacagaagacaggagaggttagttctgacagacacttggtaataagactctacaagggctttagactaaagaagtgatgaccgggtggggccaaggatatggaatcagggatgggtatatgattcatagaaacaggaaagtttggggggtctagtttgctgataatttcacccttaatttcctttcaagcaaggggaaactgaggctctgaaaagtaaggcgatccaggggcacagaagatacttaggctactttccgaacacaaagcctggggttacaggggctgctacaacagagccggcttcgaagcggggctaaggtggccgaaccacactcatctagcgtgtgcctggcagggaaccaggcctgggacagacctgacagccatgaggtttcctcctttttcgcctctgcctttactcaccagcgccacggcgtctgcacccagctaccactaacctcgcgccgcggtactcacacacgcggagaccaggatacccacagtccagtgcaattcttccggaagtgtgggcgggctcaacaccctacttccgttgctgtgttgcggaggtgacctagagacaggaatcggaagggcgggatttggagccatagccaatcgtcgcattaggccgaatcgcgggggccggctaaacgcgtgcgggggaggtggcttcttccggccgggccgagaggtggttacattcgttgaaggacaccagctgcggaatttgcggctttggcaggtgggtgaagaggggagt

SEQ ID NO: 1503 - DNA, 952 bp, Homo sapiens
acccagttgtggctttctttacagaaaaatcttccaagtagaaagaacatgaaagtctaaagccaaaaatccaaaaaattctttatagagataaaaaaaaaaccccacaacagagcaaacaaaccaaatcactgcaaaccagtgctaagaaaaatctttaaaagcagccagagaccaaagatccaccacccaaagagaggcaagatgccctggggacctaggcccacagaaaccacagcaggagggggaggcagaggcccctgtacactctcctcactaggacagttaggtcctccctccactcagaggtgagaccaaggacatactgtggtgtggggcggaaacagtgaaaacatgaggtgtgtaacaatatcccatgaaactccaatgcttcacactgacattcttctaggtcaacaccagcattctcttgaccttcctttcactgttcctcctctcccttccagcccctctgtacagtcttgagttaggtctaggcccacacacttccccactctgagctgcggtctcttcctctgtaaaatgtgatgattcagaacctctcctggccccaagcgcagttccaggcgctgagcacaccatgctgttccctacaaagccgactctttgtcccttccccattatcacggatacttgccaagaggtggcaagaaaggctcttcccaggccaaaatgcagctgctattatcaagcaggtcaggccccaagtgccacaactcccttctcctaaatctcgttttcccaaggaaccccaaacaatggcattggcgatgagcggccccgcacgcgtaggggcgcagccgctaaggaggggaaggggcctctccagctgcgcccgcgacgactcccgcgcacggaacggaaccactgggccgcagcgaccacaggggagttcttcgccggccgcaggttcaaagcgatctgcaatgag

SEQ ID NO: 1504 - DNA, 774 bp, Homo sapiens
agcaaacttcattgttgtcccattttaagaaattgacacagctattgcagccttcagcaatcactaccaggatcaatcagcagccatcaacatccaagcaatgccttccaccaccaaaaagattcccattaggtgaagatgatctttagcattttttagaaataaaatatctttttaagttaaggtaggtacattgctctttctagacatcgtgctattgcatacttaacagactacagcatagtgcaaacgtaacttttatatgcattaggaaactgaaaaattcgtgtgactcgttttgttgcaatactcgctttattgcgggggtctggaacctaacctgcaatatctctgcgttatgcccttatagcgccgggagtgggtgccttccgccggctgtacagagcgccggcaggtggcgcccagcggcgagcttgttccagcttggtttgggccaggtggactggaaggggcggaggtaaccagaagcggctagtggcggctgcctgcgtccccaaccccctccgcgcagcgctcgcgacacgcgtgccaggagtgggagcgagcggcggggccagctgcgttctgagcctgggcgcagctgccatctgctctgggaagcaccagggtgtccccgccgccctcagctcgaagtcagccaccatggaggcgcaggcacaaggtgagtggtcgccgatcgccccgagagtcaggtcctggggcgcgcataaaggctcttttcctgcaccacctaacttcgctctcggacagaac

SEQ ID NO: 1505 - DNA, 1001 bp, Homo sapiens
agaaagttcacgatttaacggcatgacagggctccaataattaggcattacacattatgaaactgatgctcaaagaaattaagcaaaccgatcaagatcaaagttgtttgtcgacagtacagagataaaactttcagcctcccaagctgaggcgctccttcaacaacgctgcgtgccatacccttctcaaacgagacaatatgctgagaacagtaacaaattcaaaaaaacgttaagaagtaggactggagaaagagtaaaaagaaacagttgggtacctgtgcttcttcaaatactactttatttacatctcctaaggctaaagttcttacttgcttgggacagaggtcccaaagctctcctagttcacaactgggccggctccaggatacgcgcagatctgtccggccggattctccctccctccctcccgtagagaagcaccacggggctaagagtctccgggatcttagctcctcaggcgactcctgccaagtccgcagttctcttcagccgcagctttcctgtcgtccccgcgcggtgctgaaccccatctgtctcaacggctcgggaaactcagtttccccaccgcagcttccagaaggtgtctgtagcgcacagcgccgcaaaaatgcctcaagcgaaaatcaggtcttcccctaaattcttttttggcgcttcagtgatccaacttccgctcaaagaagcggcaagacgagaggggcggggcggagtgcagccaatcaaggagtttggccagacggaagccgagaggcttccggaagcggtcttgaggtctgggccggaaagcggaagcggcgtgcaacacgtgggggcggtgccggtcggagggctcctagtgcgccaggttgtgggaagtgaggctggcggtggcgacaaccgaggaggaggggcgggacgccgtggagcacggcgaccggctgagcgtcatggagggctcaggggagcagccgggcccacaaccacagcatcccggagac

SEQ ID NO: 1506 - DNA, 958 bp, Homo sapiens
tgttgagaagaaacccttcaggattagtttttaagagaaaccttcccgttttacatatgtagaaactgagcccaaagaaacaaaattatttgtccaaggtcacgcccaatatcagtggccaagtcagagaggaaccccttgtttccaatttaatagccaagccagctgcatgttactactctttaaaacaaaaattccctaactgcatcgcttcaccccctctcgatttttgaataaagttgtttattcaaaacggcccttccccacggtggtgcttttatgccttcgggtagtaaaaccttccataacgtgttagtgaaaaacacgaggaggccacgtctaacgcggtgactttcacaggcctttttctttggccaaaattttctcggaaagactgttaatcctacattccgctgggggaggagcgacgagggaggagggaggtcaccggcagctgacaagtccttacatgtacttgcgcgtgcccgggacgcagcctgcggggccgaggaaaccaacgaaggatgtattaggacgagagggaaggaagggggcgggagaaaaacacggtagtgggaaatccctgtgcactggatctgccaacccctcgcaaagctgagaagagccgtgcgtgaataaatctcattaaatggcccggcgcagacactgcagcagcaaagaggagggggcaccgcggctcgcgcggcacgttcgggaagggggaacgccagggcggcccttttataggccgaagcccgcgcccgcgcgcccccacccttcgcaccgcccccgggccacgcgcggagccgcggcgttacctgagaagggccggctgcgtccgcacccggccccgcccgttccgccgcccgcccgcccttccctcccgcgaggccgcagcggcacgagatctgcgcctcgcctccctcctcacgcgggcggattttcttaccttgtgaaa

SEQ ID NO: 1507 - DNA, 922 bp, Homo sapiens
cataagccttcatttgaacctgcaagactggagggacctggcgtgtgcaaccgcggagggggctcccacccctggctgttgcattctcttggctgatcccagcgtgccccggggaggccgctgacagctggatgtttccccagcctccccttaccatttccagcttcgtccagcacctcctccttctttcccacagctccacgggctcgtgtatctggggtggaggctgtggcacagaaactgcctttctcctcactttagtcacagcattcttgaacacatggccacaggcgcgatgtatgtggcactttgcagtttatgaagcactttgctgctaagcctgagtgagcctcaggctggccctgggggaggggacctgcatggggatggaaccacgcaggggtcagtccaggaaggagctgtaatggccagtgctgggagagtcagggcaggcctgctggtggaggtggccttggagctgtccacgtcctggtcgtgctcggactaatctttcagcagacggcaggcagccgtgaggcagggctgggtggagggcctgccgaggcctctgaggtgccatctccaccagctgagctggcttccaggagggcgagtcccactgtcacgtgacgcgtctggcctcagcacacttcttccgggaaagagtgaagggccccactgccctttgccatccagcttcctctggctttgctaatggccctagggggcaggagaccaactgctggaatcccagagccctggaggtgtgcaagggcaggtcaaacagaatttggaggatctggtgcaagagccaggaagagagagagagagagagtgtgtgtgtgtgtgtgtgtgcgcatctgagagagagagagagagagactgactgagcaggaatggtgagatgtttatcatgggcctc

SEQ ID NO: 1508 - DNA, 807 bp, Homo sapiens
gcatttcagtctcaaacacctcctcagagtgatcccaggagatctctgcagccacggtgacattttctttatctgaagcgatgacacagctcactgaatgccattcttccacatgctggaaaagcgaggtctagtgaacacaattcctttccgtgcggaaagtctgaaatctttttaacacttcggacacagagcatcgtaaggtcccagaatagagggtgtgagcaatttcagcgctcacctcggcccaagcgaagctccagcgggagcaattgagacccagggacgaagctagggagggcctggcagcccccggcactggccggcaggggtaacccaggaaaaacagtctcctggcctctcgttacccgcttcaggccctccgccctcccctggcctctcgggacggccgcgcttacctgaaccgaactgtacgcacaagcgcgctcctgactccaggtgcacaccgtggaggcctgaaacgagagccatgaccgcgacgcgctgaacaaaccaagccgccagttttccgtcccgtcccggccccggccctggcgaggtgcgcatgcgcagggccgggagctaggaccccgcggcaggcgggcgcgtccgcgtcgcacggaagtctcgcgatgtttgcgtttgaacctcttggcgggtgccggccatggcggcttcgctcccgggacctgggagccggcttttccgcacatatggggctgcggacggcaggagacagcggcggccgggccgggaagccgcgcagtggttcccgccgcaggaccggaggcgtttcttcaacagcag

SEQ ID NO: 1509 - DNA, 1099 bp, Homo sapiens
aggtactggggcttgtgggcacaggctgcggggtgggggatcaggaaggcctgcagcaggtagcagggccagggcttctgggcacaggctgggtagcggggctcaggagggcctgcagcaggtaccagggctggggcccatgggcacgggggtggggggtggtcaggagggcctgcggtaggtaccagggctggggcttgtgggcacaggctggcaggaggtcaggagggcctgcagcaggtaccagggctggggcccatgggcacgggggtggggggtggtcaggagggcctgcggtaggtaccagggctggggcttgtgggcacaggctggcaggaggtcaggagggcctgcagcaggtaccagggctggggcccatgggcatgggggtcgggggaggtcagaaggacctgcagcaggtaccagggctgggcctcgtggccatgggggttgagggggggtcaggagggcctgcagcaggtaccagggccagcgttcatgggcacaggctgcggggaggtcaggagggcctgcagcaggtactagggccagggctcgtggacatggagtgggggtgggggtcagacccggaaaacaggccctcttgctgtttgcttatcctcccaaggcctgggaagctgaggatttcagaaccagggatctgagatctggatggagtcccggtagcctcttgcctgaagctctgagctgagggcccttagcacgtggctgtccctggttgtctggtctagggtgtgtgagcagcctccagaaggtcctcaaactccctaaaactgcccccctgattttgagtgtgagcatttttctggggaaagggccccagctttaatttgatttgtagagggtgtggcctgggggccctagggcttgcttagtgtcctgcggcaggtcagtggcaggtcagcagctgcatgggcctgcctcctggccattgttccacacaggaagtgggggatgagagccagtgtgtttcatggggttggggcacttggctggggtgtgggtctgggggcaagatcttgggcccagggtctacctgtatgggccaggctcagccccttgaagacccctagtcatg

SEQ ID NO: 1510 - DNA, 1039 bp, Homo sapiens
ggcccttttataggccgaagcccgcgcccgcgcgcccccacccttcgcaccgcccccgggccacgcgcggagccgcggcgttacctgagaagggccggctgcgtccgcacccggccccgcccgttccgccgcccgcccgcccttccctcccgcgaggccgcagcggcacgagatctgcgcctcgcctccctcctcacgcgggcggattttcttaccttgtgaaaaaccgtctcagcggctgcccccgcctcctctgctggatgtgaaatggcggtcggcgaggcaagtgtgagcatcgcagctcctgccaatcctgcatagccgccaaaacggccccgaacactggcgcccccctcccgcaagcccctcggagcccatccatgagatcggtgctccgccgccccttccgctgcccctcacccaggtgaccgtgcccgccagccgagtcatcgatcccgcgcgggcgctgccggccgccggccgcctccctcgccgcgtgcccggggagggggagaaagccccttctcggcccccgccctccgtgtcccgcccgggcgcccgccctctcgctccttttcccgccgagccccctcccccgcactactcgcagcctcccttcgccacacacacccccctctcccctccccccagtggttgcgtccgtgacatcatcatcatggcaacaagagctgcagcctgggaccgaggagcccgtgtgattcccggcggtggcggcagtggcggcagcaccagcaccgacgaaagctcgagggcttctctcctgcggccccttgccgggtgctcctgaggaggcggcggcagcagcgcctacaccgccccgcccgccgctcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagccc

SEQ ID NO: 1511 - DNA, 944 bp, Homo sapiens
ttgtgacactggttgtgtgactggggcagtaagcaacttatagaaaaacaaactaagccatggcaggacattgtttatgcctattctttagcaaagtctaagcccctaccataattccaaccttgccttatgaatgcgcctttaagctccaggcaaggagggggatcattttcccttgactccaagtttaactataaactaaatccctctcataggtttcttggcctttgtactagaataagcaaaaagccaaccaaaaaaaaaaaaaatcccctagaaaacataatttagcctgggaggttagaagcaagatggagtcagtcttgttagatttctcttatttatagttctgcaaaggcagttcaagagtcaccagactgttaaaggatttccatactgcaaacaagcttaaggacaccttaaagaagaaagaagaaaactatttttaaaacatttttaaaacaacttccttccatcacaatcatcagattgtgctactaaacgtcagtgagttcctgagagattcggagtcagtgcaagagaccagggctcttttggaatactggggtcatttattttttgctctttatcatctacaaattgtgtctgtgttctcttaccagacatacagggtgtcctcaccaccgattaaacattcagtgcctggaggggatggagtgggtcatgggagctggcttttccttccaaaagtcttaaggatgtccttcttagagcaagaccacgattactaattaactaaaaattctgatcctggaaataaaagctggccattcatttgcatttgaaagccattaacattttcttgataggtcggtaaatagttaccagatctttggttgctttggtggactgtgctcctctgcttttattgctaagccatccttcagacagagagggagcggctgcaagaggtaatgaggtat

SEQ ID NO: 1512 - DNA, 903 bp, Homo sapiens
ataaaactggagtctgccaaccacaccaccatctaagaagataattaatatttaaattcacatatctttctataatttttaaaagcattgatgaaatttttattctaattaaaataatgtgtattttattaagaaatgccttaaacagtttctactgaggatacattctagtacttcagtttatgtcagtatgtgaacagtaaaatgtctgagatctaagattttatttaaaagtaaaatatttagaaaaagactacaatacttaaattaacatgtgaccaataagcacattttatctaaataacatgcttttttttgtctttcaaagtaaggcatatttattatagacaacttgaaaaatataggaaaaagataaagaaaattaaaattgtgtaattctttctccaaaataaccagctccttttaacatttaaggtactcttctgcagttattctttttccccctcataaatatcatgtttaattaggaaactattactagttatttgttgatatgtccgtttaaacatttatgagcttaatgcataattagtgctttgactttttcctaaagcaaggaatacaatttatgagcatggaaaaagagaagtacttgtgcttcaaggtattttgcatatgttatcaacctttctatgagaatataaacttaggaagttatacctacttatctccctctgatccctagataatttatgggtagctagatatttaagcttagcatttcttttctaggtgtggttgacctgcctgaggaaaatcgggaagcagcttataatgccattactttacctgaagaatttcatgactttgatcagccactgcctgacttagagtatgtgtcttcttttaaaaaaaattgttgacttggtctgcaataagcag

SEQ ID NO: 1513 - DNA, 1003 bp, Homo sapiens
ttccctagagacaaggacacgagagcctgttgtaagaagtgatgaggccagagtggatatggcagctcttcagagcaggcagggcattcaggtagaagatgctgcatgtcatgttctccccaagacagtcctagtgccttggctctctggtgtctctggggttcaattttaactttattctctggaggataacaaagaaaaatgcaatatgaaccaaaagtttggattgttgtagttgaggctcatatgcacagagaatagtctttaccctcctatttttgaaagaatcagctttcccttccacatccatctctctgcctccagcaacaagttaggcagcttgtgaaatacctacaacatagccagtaacacagaataggagagaatacaggtttggggctcttacaagcttagtgggctggagatttcccaagcttccgagtccaaatcagctggctggggtggtgggtgatgcgtgtaggacacctcctgtgatcccagatgcatagccctccttcgggctgagctatttattcttctggacatgagtccttctcccctttcagatggccaaagcttagtgcagagtttggggtctgtgcttcctccccctaaaggccccatgtgaggattacatgggtgagaggtgagattctaggcattcactgattgacagctggtattatcatcagcttagttctgtaacattgcattagttcacgggcatttaaaaatcaaaatgtggccaggcatggtggctcacacctgtagtcccagctattcagaaggctgaggtggaaagatctcttgagcccaggagatcgaggtttcagtgagctgtgatcacaccactgcactccagcttcggtgacagagcaaaactctttctctaaaaaataataatcagtttgtcactgagtgtgtatggggttctttgatctaaatagacagtttatattttacttaaatagctttctggagtatggttaaaaattaaaatggg

SEQ ID NO: 1514 - DNA, 1157 bp, Homo sapiens
gactgataggcccggttattttttaaattggatgctgaatattgtgaatttcaaattgttggccaggcccggtgtggtggctcatgcctgtaatcccagcactttgggaggctgaggcaggtggatcatttgagctcaggagttcaagaccagcctgggcaacatagtgagaccctgtctctgcaaaaaatgaaataaattattggctggtgaattttgttgaattcctttgaataatgttgggtttgggtctggaatgcagttaagtcccttggaagcagcgatcctttagagacttctgaacttttcagtgggtccagtgctgctttagtctgcagttgacttagctctattactaagggtgatggccttctgcggagtctacccaataccccacgaattaggagatctctccacggtggcttgtgggaacacaaaatattccctgtgtgaactctggggattgttttgtttgctacttcctcaggagtctttcctgggccttctcatatagtttttctcacccaggcacagatctgttttcagctaaagactccaggagaccctctgcagatcctggctctgcctctgcagctgcctcctccccaggactctgccctgcaaatagcagcagccttggcctccctgagctctgaactctgtcttcccaactcagaaagactgcaggttccggctgagtttccctgcctgcgctgcagcctggaacccgcctcctggctgtaattggtgcagtcataggatgtgctctcttgtctcccttatcttggaatcactgtcctgcactgttttccaccaactgaaggcaaaagtatgttgtccagttttccaggtgttcagggttccctgttgctgcatcctacatgagtatataaacagagaacaaacaaaacagcctgtcaggagtttgctgaagtttcagaataggtggtgctgggtgagctgatgggcatgagtaacactccccttttccttcttttagtgaccacaatatgaatgggaacagcaagatggcaaaagcttgctgagtggtacagcgccagcctgggtagtggcctccccagcaagttgcatgtcactagcttcctgtggctgtcactcctgggcccaggcacctccgaagatcagcacctcctcat

SEQ ID NO: 1515 - DNA, 795 bp, Homo sapiens
gagctcctgaggctagacctaccggcaccccccattcctacaggttctataaggcaagtcaggtattccaccctgtaaaaagctcttctctctcctgccccgctagactagtatcccctccttaaggctcccaacatccgaagctaagttgtttgtctgcctatcatccaggaacgcgtctgagggcagggaacaaatttattcatcgtaatcgagcccagcactttgtctcgcacgcagctgacagcagaattttaagataaagtattaaataaatgacagacctctcaaggcttcctgtctttcactaaaaagcttctctcaggccacgcccctacctccactcaggtcagccccttcctattgaagccccgccccatcgccttccccgccaccttacaccccgcccctctctcttaaagccctaggaagattactggagtttggcgccaaccgtgtttttttttttcccttccaaaggcgggaactagttgtgggcgctgcgacgtgctttgcgtctgatatgattggccgtaggcactcagtcccgcctccataccctgatagcgctctggtattggtggagatgccagggagacctcggtgggcagaaaggaaccgggttgtcttgggccgggcagggcgggtaagttgtcgtaggggcccggtccgtgagggactgctaaggaagaggctgcatggcgcggtagtcccccgagtggaggtcggctgcccctgggaaaccagagagtcggagggagtccatctggagcggccaagtaggtcggggaaggg

SEQ ID NO: 1516 - DNA, 1014 bp, Homo sapiens
atgagaacctgaagaagtcgctgtcgtgcgccaacctgtccacattcgcccagcccccaccggcccagccgcctgcacccccggccagccagctctcgggttcccagaccgggggctcctcctcagtcaagaaagcccctcaccctgccgtcacctccgcagggacgcccaaacgggtcatcgtccaggcgtccaccagtgagctgcttcgctgcctgggtgagtttctctgccgccggtgctaccgcctgaagcacctgtcccccacggaccccgtgctctggctgcgcagcgtggaccgctcgctgcttctgcagggctggcaggaccagggcttcatcacgccggccaacgtggtcttcctctacatgctctgcagggatgttatctcctccgaggtgggctcggatcacgagctccaggccgtcctgctgacatgcctgtacctctcctactcctacatgggcaacgagatctcctacccgctcaagcccttcctggtggagagctgcaaggaggccttttgggaccgttgcctctctgtcatcaacctcatgagctcaaagatgctgcagataaatgccgacccacactacttcacacaggtcttctccgacctgaagaacgagagcggccaggaggacaagaagcggctcctcctaggcctggatcggtgagcactgtagcctgcgtcatggctcaaggattcaatgcatttttaagaatttattattaaatcagttttgtgtacagtatgtgtctagcaaagccaccaagggcctcacctttcccacagtctctccctggggtttttttcatccctgccaagaactctgggcacttttgaactcacgagccttgcgcaaaacccagaagatgtattcagagccacccaggccactgacctcccactttggggaactcaaaggactgacctgcccctgccgcctgtgcccttgctgggtccagggtaggcaaggctgccggctgcaccctgtatggagctagagaggg

SEQ ID NO: 1517 - DNA, 973 bp, Homo sapiens
tcataatccctcagtttggaggagcctgggcctgccccaagtgtatagtaatcctacccagccagatccaaactctagtcaaagaagggtccccaaatgtcccagaacactgacctctggagggtgggtggggggtggaaagggacagggaagggcagcaggttgtagggtctgctgtcaaaggtcccattccggaccgtccttctccatcccaccccccgggtctccattgccgcggccctgccccaccactttcagctgaggggtagttcggagctccatggtcccttccctagagcggccgccccctcgggcctccccagagccttcgaagagccgcgtgaggaaacggggacctgcccggggcagcagatctccagcggtgaagacgtagagcaccgggttgacgctagaactgaagaaggccaaggccgtagttcccgctcgcgccgcctggccggctccgcccagcttcgccaaggccccttccggtggagccagcgctgcgaccgcctgcagaaggttgactgcgtggtagggggcccagagcaagccgaaggcaagcacgatggcgctcaccagccggcccacccgcgccccgtgccgcccggagccccagcgggcgccccgcagccgtgccagcgtcacgctgtagcagccgagcatcagcccgaaaggaagcacgaaagcggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgctggcgtacatgctgagcgcgcacacgtagtacaccgccttg

SEQ ID NO: 1518 - DNA, 904 bp, Homo sapiens
ctcacctaatcgcccctcatctggtcgcccctcccctgaccccctcacctggtcgcccttccccgggcccctcacctggccctccctcaccaggccgccccctcccctagccgcccctcacctggtcccctcccctggccgcccctcccttggctgcccctcccttggctgtcccctttcctggccgcccctcccctcgtcctctcctctggctgcctctcacctggccgcgtgttgcaggtgcgcggcccccgccatcccgccccgccgccctgcgccatggaggagggccctctgccgggcgggctgcccagccccgaggatgcgatggtgacggagctcttaagccccgagggtccgttcgcttcggagaacatcggcctgaaggcccccgtgaagtacgaggaggacgagttccacgtcttcaaagaagcgtacctgggcccggcggaccccaaggaacccgtcctgcacgcgttcaaccccgcgctgggcgccgactgcaagggccaggtcaaggcgaagctcgcggggggcgacagcgacggcggggagctcctcggggagtaccccgggatcccagagctcagcgcgctggaggacgtcgcgctcctgcaggccccgcagccgcccgcctgcaacgtgcacttcctgtcctcgctgctacccgcgcaccgcagcccggcggtgttgcccctgggcgcctgggtcctggaaggagcctcccacccgggcgtccgcatgatcccagtaagaaccgcctggggaatgggcacagctccccctccatcccttccccaacccatctgaggctgctagtgtaccccaggatttccctctacaagcattttccctggtgacaccacacacagcccaccggagtcactgattctcggtagagcgt

SEQ ID NO: 1519 - DNA, 1079 bp, Homo sapiens
aagacgtctaaagcaccatccaggttcttgcaattaaaatgagatgacaaacacggaaacatgtgccctgctgacgtcatggaacggaaaggggtggcatcctgctgcgtcacgtcgacgtcatacagcgcacgagggaagttacactggggaagcaatttcccccaaggggcaacattcgagaaaaacaagttagctcagacccgaagaatgaccaccccactctaggggacgtcttaaaaagggacactctcccctcttccaaactgtatgattcccctcatcaggcaacaaggaactaatactcggggtttacaggaaccaggggatgggccagatatggagaaagagacgcctctggccttgggggctcgttcttgagggaatcagcgtgatggggatgagaagggcatctttggaacgggggccttctccataggaagaggaggcgagtcccctggccatatttaaaccacagttctccacgccacctgtgcgactcgggatccaacctccccgcaccagccccagtccaggtacctggaacttagtccgatcggtaaccggcgactacgtggggtacaggtacccgagcgcgcccccgacagacgcaccgacctgcgcgcgcgccgcgggcaggatgcgtgcgcactccccggacgtcccgccccgccccctctgcggccccgaagctgggcggcgtgcgcgcccccgcgccgcgccgagccgggcgctcggaaaggcgtccccgcggtgcctgacagttccttcctcagcgcctgccccgtgagtgacgaggagcgcggagtctcgccatatcaggagggccctgttacgtgaggctgtgcaccgagactattccaggaagaagaggggacacttggtgggcggggtgatttcgggcagtcaggtgggcgacccgcgtaggcgtctgaaaggcccgcgtcgttagggagggcaggagtggcgtctctggttacggggtcgggcaaagggcagaggtcaccgtccaggttggacagcagcacctttgagcgatggcggcgtctggggaaccccagaggcagtggcaagaggag

SEQ ID NO: 1520 - DNA, 1048 bp, Homo sapiens
ctacaggacagttccattcccacacctgagctttggacaactgaatcctatgccccttcccacccagggaacctggtgccagaaattcccaggacttacccaccatccaccacgccacatagcaagtgtcctcagtgtctgcagaccagaaacaactcccttgtgtctcagcaccgggccacctgctgaaaccccaaactgcctgccccattgtttgagacccagtcaggccttggctccaaaagtcctcttggactgccactggcccccagggtctctcctgactgcacctcggtcccggagctcccacgccgctgggccccgagccccatgccccgatccagctgtggctcctttacgggggccttgctggcctttcctaagggaggtgttttcccgagggcaggtggactgctcctcagactaggggccctcggagggccaggcctgggcttctacctcctctcgcaggctggtgtttctctgcaaatatggctcgtgtgtcctccttcctctcagactgggggcccctgaggactgggcctgagtttccctctcccccttcagaatgggggttccctgaggactgacccagggcctccccccgtcccctccatctggctgttaatctccaacactttcacctccagtcctattctgcacagcgctccccagcgctgggagctcagaggcctcttcagccttccccagggctggggctcagggagggcttcctcaggcgctggccccagagtcaggctgcacattggcttggaggacaggcctttcctctgggactgtgaggcccagagtgcccacccagaactccacctctgacctcacaaaggcctgcttcagaactcggtctccactgcactgctggccagacgagggatgttattttgggcagtgcatctggacttggttcaagtggcaccagccaaatccctgccttactgacctctcccctggaggagcaggagcagcgctcaaggccgccctgggagggctgagaggcaggctctggactggggacacagggatagct

SEQ ID NO: 1521 - DNA, 984 bp, Homo sapiens
ccacatctctaagcctcccctacgcagagggggccccgcgtctctaagcctcccctacccggaggggtggagtggtggtctcccctcacagcgaccgcagaggaagtgtctggggatcatcctcaagctcagctgctgggggagtcaaaggggagaagggtttaaaatctgataccaagccacacccagaaccagctataagccagaatgcctggggagtccagggcagaggtcattttaaatctgagtacagaaagattggagtctgccacagagtggggttcgttagaaggcacggctgctgctggcttggcaggcgggaggccaggcccgggcggtgtcaccgggcagctcagccaggctggcctcgcagttcccgaggcttctcccactgccctcccagggctgggggaacagggagtgggtgctctggccagcttcctactgaacaagctctgactcccagcccgctgccggcagggcaccgtgctgagcctgtggaggaccccacgggggaaggcaagatccccacctgcaggccgtagcttgctccagggagtcccagaggagggggcaaatcaggaccagcaagggctccccaacaagcaggctgggcaggggtcactggaaagccctgtcctgggaagtccccccagaggccagaatccagcctgagaggtcctctgcagagggctcttgtgagcacagagggcgagggctggcccggtgcagagggctcccagtgagcacagggagggcgagggccggcccggtggggcccagctcactggttgtgcctgcctaggacttcgggaactatcacctgggcgtcatgtcctggatcatccccgtcttcgtgggcctgtcctgcttcggctccgtcaatgggtccctgttcacatcctccaggtgagcacagcccgacccaccacaggtgagggaggcccaggcctcatggccaggttcaacatgttccatgtctgt

SEQ ID NO: 1522 - DNA, 915 bp, Homo sapiens
agaaggtcctggtgaataaaggcccagggggcgtgctcttgaagtgtgctcgtggtgcagcgccggcgggggccaggagggggagctgcaacccaggctgtgggctgcagcctctcagggcttctggtgaattctgggcctggggcctcagggtagggcaccaggggcccaggggctggggtggggggcccaggatgcaggggtctgcccctggccaggctctgccttcagaggaggctgagcgtcgtcacacgggccgggctgaggccctgggccctgaccgtgcagcctaagacaggactgtggctttaagaccctcctgacccctgacctctgcccccagtggccctggcccctgggcagcccttcctggccgccatgtgtacccagagcctgggactggctgggctgggcagtgacccaggtgggaaagggtggtcttgccctctaaggcccggcacaagtgagaggcctgggggtccatgttgggctgggctgggcgaggggtggtctctgacttcctgggggttctggctgggatgggcagggggctgggtgggagagtgtgggccctgccctccgaggccgggcatgggcgagaagcctgggggtcctggctgaactgggctgggtgaagggggccccctgacccccttggggtccgggctgggctgggtgaggggcggtttccgacccccagccaggttcccaggcaggatgagctggggttggggtggctaggccgtgggccttgggagctgggcagtctgggctgggctgggctgggcagggcgccacatggaagctggaggagcaacgggagcgctgggcgtggggtgcaaattgcccggtgccttctgtttcccaggcagctctgtggccatggatatgttccagaaggtagagaagatcgga

SEQ ID NO: 1523 - DNA, 909 bp, Homo sapiens
tttcggtagactctgccactttccccggggatctgaaagagttctccaagaagcccccacttctcaggcggcaacagggcaggtacctgggcggtagcccttatgctactgttcataaatcaatctgagttttatgggtgctttttctgaggaaggagagatttaaagttatgtagcggcaacaaagctttctaataatatttttggcaggctgctaaagaaagatgaaataagaaaagatacaagccctgggagagtggtggtagcccttgggacgccagccagatgttggtgctcacaaatcgggggagacaatggcctttactgttgccatttacaatgccgggcagctcattaatcatcagctaaaatgatttcactttcagggtctaggcaggtcggggctggggttggggagggctgtggcaggaggcctggcttccaggccggggaagtgtcccagagacctactagacggggcccctcccctccactgctcagggcaaagggcaccaggaggcggagcgggggtcgaggtgggagtgggtgcgtcacccttgttttccgggctgtgagtctcccagcgtccccagctttccaggtagggacgccccctcccacgcagcacggttccggcgggtggaaaggaggggctgggctcccagcgcccgcccctctatccatcacatggccggagagtcacaaaaacaacagctttggccaagaccgtgacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacct

SEQ ID NO: 1524 - DNA, 1083 bp, Homo sapiens
tccaagagaaaacccttcattcaatttcctaattaaataaattcattttcatttgtccatgttactatctagtctttatccatacacttattatttacatttttgtagtaatagtacaggtaattttttttttttttttaaagatggagtctcactctgtcgcccaggctggagtgcagtgtcatgatctccgctcactgcaatctctgcctcccggattcaagcgattctcctgcctgtctcccgagtagctgggattactggcgcccgttaccacgcccggctaatttttacgtttttagcagagacggggtttcaccacgttggccaggctggtctcaaactactgacctcaagtgatccgcccgccttgacctcccaaagtgctgggattacaggcgtgagccactgtgcctggcctatagttaagatttttatattcatttttagtgaatgttataccgtataccgtaagtactctccccccacaatccttctgcctctcatcttcccttttccattttcctaatacctcctactgcctcctctcaactacccttgtgtgtttcttcatctttctccgtgcttattcaaaaatatcctgccacacacacacacacaggcttctctttttgttattcagacatttaaaaaaattaattcttgatcattcaacttgattatttagacatttctgtacagccatcttttctcgtttaccaccacatcatggctgtctgcccctctacatccgcacacggagctctaacgcatgcttgttaaacagccttcgtaatagtctttaaagatcaaccacactgttcccacgtaaccctacctcccaggtagggttcccccagtaacactttcacacataacttatttactgttccttttacttctggaagattccgagaggaaagattgctgggtcaaaggtcacacgcgttttcaattttaatagctattcctggattacctcctcaaagggctctaacaactcgcattgctctcagcgtgtgagagggtcctttgctctgaagggtcttctaaaatatttgttcaatcgttacttagcagggg

SEQ ID NO: 1525 - DNA, 1474 bp, Homo sapiens
gggtcacagagaggcttacagaaaacgattcttgtgaattggcttgcagtaataattcaatacctgccagctattcttattccacatccaagccctttcgcctgctgctgggtgaaaacacatgtcagtgtttcctgacggtttccacaaagaagattccaaaattacaacctgccagtctgaagaatctccaaaacatcccgcacgcatcctggaggcgcgggcttggggatgggactgcccgcccgggtcctgaacaggatgcgtgcgcgcaggcacacacacaccagccagcctgtgtgtgcggccggagtccggtgcggtcccgggtgagcagcgcgtggctggtgggcggggcagagccattgttcgcaggcgtaccgagtcccccgcgctcgcccgggagggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatgtgagtttcccagcctggccccgtaccgccgggtcgcaggcgcgggctgggcttccaggggacgggttggtggcagaagagaggggagagctccgcggaggacttggtcatctttttcgagttgtgctgccttccgtgagttgggaatgtggattgtaatttgggga

SEQ ID NO: 1526 - DNA, 975 bp, Homo sapiens
cccagtgttaaataagcgaccacagcaagaggtagaggcgcagggactgaaatgaagacaaatatctgacaagtttaaaacacgtatttaaaatagaatttataaaatgcttaatctgccgactcaggagcccgcggtgcagggtggggtgggagttggcaggtgaccgctacaccagcagagtaagactgcagggctgcggccctccctcctatgcccttctgttcagacacccgaggggcccatgtgcactcctgggatcatacgaccagaaaacaggaccctagaggtttcttgagtttctgcttaccagggcggctgggtatagccctgccagcccattgcataatcttctaagttctccccaccaccctccattccagcagcgaggtgcctgtgacgcggtctccatcctctcggcctcgacccggtggtccccgcgattggacgcttaggcggtcaccaggcctccttgttactaacgtgtgcacacctttcagttctctcatcaggatgaactcctggaaattgctgggtccaaagtgtttaggaagtctggagtgattcttgttgcagggggaagagggaactatggaggtgtcactgaactttcaggggttccgggaccccccaacccggtgcccgtcccagctccccgagcgcctctcttcccccatcccccacctcgcctgttttcacctcccgtggcctcactcccgccgcgcagctggaccttgcccggggcctcccgatcccggagctcgaatcccagccggaccagcccagcccgaccagcccagccccgcctcttctccggcaggatcgcggccgagcagtctgcccagagacttagcgacagacagacgctgggacccacgacgacagaaggcgccgatggccgcgcctgctgagccctgcgcggggcagggggtgagtgccccccatcgcgccccactctccttttccaggcttggt

SEQ ID NO: 1527 - DNA, 928 bp, Homo sapiens
ctgtgcttggatctcagagacgggcaccgactgccgagccccagacgaagtgccccagggtcggggatcaggcttgtgcagggtagcacctggggacctgagggacctggaggccttcttgtatcctgaagtaggaccttctaagacttcatgagtcctggcccccttgcaggggttggggagctggggatcccagatctgcctattgcgcccgatgccccgaggctctctcttggactctggccctgagttcttctgcgcgatccttcggagacgtctggaggcctgctttatgcatctctcttggacctcagtttccccacacgtgggaggaggcagctggacgattcctgaaaggactttcccttgcttcctcatcacgtggaagagagcccacccggcacctggaaatggaaagccagtgaaggctgctttgggccggggcagcgggtgggaccgggcgggagggattccaaagagaccgccgggaaggctagagcttggaattccggctcctcggagtcctggccctcccccaccgccgcctcggagctcagcacaccttggatgggggaggcgggcagctcctagccccgcaccccaggaggcgcgctcggagggaagccgccaccgcgccgcctctgcctcggcgcggaacaaacggttaaagattttgggcagcgcctcgcggggggaggagccaggggcccaatccgcaattaaagatgaactttgggtgaactaattgtctgaccaaggtaacgtgggcagcaacctgggccgcctataaagcggcagcgccgtggggtttgaagcgctggcggcggcggcaggtggcgcgggaggtcgcggcgcgccatggggctcccggcgctgctggccagtgcgctctgcaccttcgtgctgccgctgctgctcttcctggctg

SEQ ID NO: 1528 - DNA, 1085 bp, Homo sapiens
caatgtgtgttcctcaaaagtcggatgtaggtcgggcgcagtggcgcatgcctgtaattccagcactttggaaggccgaagtgggtagatcacctgaggtcaggagtttgcaaccagtctgactgataccatgaaaccccgtctccactaaatacaaaaaaattagccaggcatggtggtgcatgcctgttaatccgagttacttcggaggctgagacaggagaatcgcttgtacctgggaggcagaggttgcagtgagctgagatcacgccattgcactccagcctgggcaacaagagcaaaactctgtctcaaaaaaaaaaaaaagtaggatgtaactccagtaacatttgaagagtgccaaggagtcctctctttaaagggatcctacagtatatcagttttttgaagcaaagaagcctttagcaatgccacaatcgcctctgatttatttgattaatttttgtaatacttggttttcttaaagcatggcacacttaaaccagttatttattggaatagtttttgttttcaaagtcactaccaattgaatgtgcagccttcactggtgtcattaccccatgcttccgtctcattttgcaagatagtgttagaactaaagtgggggtgaccccaaggcgccttgagccttggctccatgttagggatcccatagaggtactaccacctgatcctctccacagcctcgtgaggtgcacctcacagcatttgctgttcagaggagggaactgaggtctgagaaggaaattcacttgctgaagttaacttgctgcctccagtgagaggcaggattgatatttgagcccacgtctgtctgactccaatgctaatgatttttacatcccggctgaaggatgatattgccaagcccttaaagaagaaggcatatttggacacctcattagcaatttgggcgctaaatcataccctgttggccaggaagaattaaagttgctgcccagggctcccacctcaggtccagggagtagcctcaatactgagggaatctgaattaaggagcttggaagttccccccacctagctgtagtgggcagtttcagagt

SEQ ID NO: 1529 - DNA, 964 bp, Homo sapiens
gtacttggcacagggaagggcgctggcgcgtgctgcggctcggagcctgggcgcggtggctgctggtggcgctgacggcggccacggcactggtacgcctcgcccagctgggtgccgctgaccgccagtggacccgtttcgtgcgcggccgcccgcgccgcttcactagcttcgaccaggtggcgcagctgagctccgcagcccgtggcctggcggcctcgctgctcttcctgcttttggtcaaggtgagggctgggccggtgggcgcggggctgggcgcacaccccagggctgcaagcagacagatttctcgtccgcaggctgcccagcagctacgcttcgtgcgccagtggtccgtctttggcaagacattatgccgagctctgccagagctcctgggggtcaccttgggcctggtggtgctcggggtagcctacgcccagctggccatcctggtaggtgactgcgcggccggggagggcgtcttagctcagctcagctcagctgtacgccctcactggtgtcgccttccccgcagctcgtgtcttcctgtgtggactccctctggagcgtggcccaggccctgttggtgctgtgccctgggactgggctctctaccctgtgtcctgccgagtcctggcacctgtcacccctgctgtgtgtggggctctgggcactgcggctgtggggcgccctacggctgggggctgttattctccgctggcgctaccacgccttgcgtggagagctgtaccggccggcctgggagccccaggactacgagatggtggagttgttcctgcgcaggctgcgcctctggatgggcctcagcaaggtcaaggaggtgggtacggcccagtgggggggagagggacacgccctgggctctgcccagggtgcagccggactgactgagcccctgtgccgcccccagttccgccacaaagtccgctttgaagggatg

SEQ ID NO: 1530 - DNA, 2647 bp, Homo sapiens
gaaagtacacttggaagaggcccaagcaggcatcttggaggtcaagtgcggcatttgacctttgatttagggtgttatatgttggcatacttctggggtcctgcctccctttttccttgattcttcccttagggtgaccgagcaaatgactctttaagcccgtgtccacatatgtaaaatatagttgtgaaacagaatgagattatgcatgcagagttgctgacacagagcctggcacctactgtccatagcataaacattattcttctctcttaactttccaagtggatttgcatgcacagtgtggggagtggcttggtagggagaggggttggtgtttggagaggcaggagtccaagaagtgccttagaagctatcacctgaagccaggtgagagataagccctgaactaaggccctggccatggggatagttgcagacttgagggctaattgagaagtacaattccaaaggtcctggcatctgattagctatgcaggataagaatagtctagactgattccctttggggcaactggccagatgatggtgccatttgctgaggtaggaaaccatgagagcaggtgcaggattatggagaagatgatgaccttcaggtcaaccatgctgccaccagtgtgcacacctttaggcccaaaggttggccaagaggtatgtgtttgcagctgggtaagtgtggacagagtttggatctatgaactggggggaaagagatccaaatacatatacctgaggttgagtgtaggctagagcctgagggggaagagacggggaccagtagcaagcccgtggctggagaccagctctccttatcccactatgttccagcatagaactccaagaaatctgagaatcaagactgtttctgttgcaagtggcagaactccaattaaaattagcttgagcaagagaagaaatgcatcaattcctgtaactgaaatcaggaatccattgctcgccatctccctgctctgcttcctctaggctggcttctgtctcagccaggttcctgctttgcagtgccaagctaacactcagcagctccaggcttatattctaccagctcagcaactcagcagaaagagagctaacttccaaagttttagaaaaagtcccagagagggatctcatgcccatccttgaacatccttgattgctgtggccagagtgaggaacacaaaagttggctaagctgcaagcctacccccaagaggggtgacatcagacccacatgacaatacagactgaggagatggttccccaaaagaaaatcagggtgctattaccagaaaaggcgagtggatgctgagcagacacccatcatagatatgctgagtttgaggtgctatatagcattgtgggtgatatccagtggtctcaggttggagagagatgtcccaatggaggtatagcttgagaaatcacctgaggactttatgatggtagttgggtgggcagatgagtttcctcattggattgtggagagaaagaatgaccaggccgggcgtggtggctcacgcctgtaaattccagcactttgggaggccaaggcaggcggatcacgaggtcaggagttggagaccagcttggccagcatggagaaaccccgtctttacaaaaaatacaaaaaatcagccgagtgtggtggcaggcgcctgtaattccagctactctgcaggttgagacaggagaattgcttgaacccgggaggcggagtgtgcagtgagccgagatcgcgccactgcacgcactccagcctgggtgacagagtaagactccgtcaggggaagaggggatgtgccgggggaggagaatgaccagatcagaggaccaaggaagagacccaggggtagagagactccaccatttcatggcaaggcagaaaggagccttgatcaggaggagaaacggggatttaggagttggggactaagtggaccttagcattgggcacttggactacagaaaggcccaggactcagggtgtcgcgtccccaggaggaggaactggaaaggcaatgcccaaccccctaacttctagacgtctggcccctgtagtctcccgcccctggcctcgcccctcgttcctagcttgtttgccacctagtgtctctcccgggagcaagagtcctcaaagttacatcatgtgcggctgggagggcggtggcggatggggggcggggcctcgaagtcgggggccgaagagtggacccagtcctccaatgggagagatgggtttggcggtttggaggcaggggttggggcggcggctgggctgacctggagcctggagccccggggccgagggagctggcctgccagcggggcggaggaaagctagtgccagccctaccaggttccgcccccgcgcctgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggtgagtgacccccggcccggggcccacccgcaccttccgctgcgctcgccccctcggggctgccagtggcgctctcctgctctcagcctc

SEQ ID NO: 1531 - DNA, 3441 bp, Homo sapiens
ggggttagaagacaagccctagattcctccagacaagttattcttagcgtctgtggaagacatcttaaaatgaaaggatgaagcatctgcaaatcttctccccgaaaaagtaaaatagaaagaaataagcttgctcttacctcaataatttctttctcttcaattcctctgcaggtcacctcctcccatctcaattttcctttctcttgtctgccctcattcccttggcaagtgaacattctctctcacccccattgcatctattaaagaagttaccagcttgtgcccctccccctcagcttgaagcagggtctgaagcagagtacacatgatcgggaaaaggaggcaggggttctgtgaaatgctttgagctctttcagagttgggggtgatggccaggtgtggcagctcaggcctgcaatcctagcactttgggaggccgaagcaggcagatcgttgaggccaggggttcgagaccagcctggccaacatggtgaaaccctgtctctactaaaaatacaaaaaaaattagccaggcccagtggtgcctgactgtggtcccagctactcaggaggctgaggtgagaggattgcttgaacctgggaggcagaggttgcagtgagctgagatcatgccaccgcactccaatctggatgacagagtaagaccctatctcaaaaaacaaaaacaaaacaaaaccctccccctcaaaaaaacagagttgggctaggcccacaattattagagaagagaaaggcagtgtgatgctggtggtatagagcagaaagcaggagaggcagctacggtaaggccaagcaaaacaagagggaatgggagacaaagatggaggggcaagacacagactgcaggggacaactttggggtcccttgcagaggaaggagtattcgccctgccctttttggggtgtggaaacctgagaagttttgagggtcctccttaaacctgtcccacctgcttccctttcctctcctgagctccgttgtttacagagatcactccctgaactcttgccctcctggacttgccctagcttcggccccaggcctccggccaggcagacaccctgacaggttacaaatgagcgtgggtgttggattgccccaagctcttgccctcaagttgtccggaggaggagagtcaatgggctctacctaagggcttctcttctagtcccatctgggtttggagtctgagagagtgaagaagacacatcctgtgtccctccgcaacagccacacagaacaaaaaggggcgagactccactcctcactctggagtcttagaattcagagcctcagggcctccaccccgattctcccactctctgaccaaactccctttatcaatcctagaaaaattactgaaatctggaggaatctttaagatttaactggtattaaatttatgcatttgaggtttggaaattttttttttttggaaggagatggagggtggtgaaggagagacaggtaggagggaaccaggagaatgcaggtctccactagttttaaacacttcaagaagagaataaaaaattcccctcctcttcaccccgctgtaaacatcacctggctgtgctcattgtggctctctagagagatatagggagttatttaagtctgagtgagtgagccagctacagctatggatggctagagagaggataaatacatctagagagatgagaggtagggaacgaatataaatatggagaaagatggacgaacagagagatggattgagacagagagaatataaagagaggctgagggagagaaatggatgtgtgaatgaggagagaacatttatgcaaagagagagagagggaagatggggcatttctcatccttttctccacatttctgtagtcctgccttgctccctgaaatgccaatttcccacccctggcttcatgaattcttcctctagattctagatcctgccccacacccttaggtgtttttgcaccaccttcccccacctccccaccacacagtcatccatttggcccaagataacatacctcacccggctgtcctagcccaccaccctaagacaaattggaagaaaggaacatggtttgggagttctgggcaaagtatggaagctggattccccacctccaggtccacagacttagggggaaggtttctctgaggggtgggaagagtgaggggcagctggcttgaatttgtccaaatctaataacccaggagcctattgaaggccttgggggttgggagggaaggaaagtcttgaatattctcctaactttttccccctctccctctggtcccttctttccaaaagtctttgaagaaagatgtttttgacgcttccatgtcgctctcagatggatgggctgcgggtgattgaagtgtctttgtcatgctaatgcttggggggtgatggatgggcgctggggctgccaaactctggcccgcttagcccattggcctgggagagatcacatgtgccccctcacccccactccctacccccttcctagggaagcgcttgcccaggcgagcgggtcaggccatggattcgagccccagcgctgtgacatactgccgaaaggttgtagggcaagagggtgtctcccccaaacgggccgaccctcctgcggccttgacgcatggactataataggatgaactccttcttagagtacccactctgtaaccggggacccagcgcctacagcgcccacagcgccccaacctcctttcccccaagctcggctcaggcggttgacagctatgcaagcgagggccgctacggtggggggctgtccagccctgcgtttcagcagaactccggctatcccgcccagcagccgccttcgaccctgggggtgcccttccccagctccgcgccctcggggtatgctcctgccgcctgcagccccagctacgggccttctcagtactaccctctgggtcaatcagaaggagacggaggctattttcatccctcgagctacggggcccagctagggggcttgtccgatggctacggagcaggtggagccggtccggggccatatcctccgcagcatcccccttatgggaacgagcagaccgcgagctttgcaccggcctatgctgatctcctctccgaggacaaggaaacaccctgcccttcagaacctaacacccccacggcccggaccttcgactggatgaaggttaagagaaacccacccaagacaggtagggctcagatgtggccaccccttctccggggcccaaagcatctctgcttcccctgcagtgacatgtcctgggtctgggctgggttcttctctttcagcggctctggtagacacaggtaagagcacaacctacgtctcaggtcaggtgaggtctccccacccagtatgtaaccggtcaccccaggagtaagtttccataca

SEQ ID NO: 1532 - DNA, 2914 bp, Homo sapiens
ttctctctctccccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtgagtgaagccctgatggaggtggggatatggccctggcacctggtcattagggaccccattttttctcctgagactttcaaaatataagctgagaaatttgctgggtttgcatgttcacaatcttaatttaaaatcccaatttttaacatcccacgggcccgtagccatagactattgctccatttctttctctctgactatcttaattaaacccattacattcaagagatgtttattgtcctaggacagtcatagattcaaagatgattatagcctagttgcctaggtttgtttgtttgtttttgtgtttgtgtttcaacagtctttctctcttgcccaggctggagtgcagtggcacaatcatggctcactgcagccttgacttcccaggctcaagcaatccttctacctcaacctcctgagtatctgggactacaggcacacaccgccatgcctggctaattttttgtggggacaaggtctcactcactatattgcccaggccggtagcttagttcttaccttcaaaaagtttgtagcctatcggggtggagagataagccaagtatccagataaccatggcataaggcagaatattttctgtactatgagaggtacaaaggggagggagattgctcaatgggcaacaccaaggaagtgatatgaaataaatagtgttggaatccaccaacggatagaaatttttacaactatgtgtggggagagacagtgcaaacagaagaaacagaatgagctaaaacacgaagcatgttccagcaatagagtccttttgcttgaagtatagggtatgggaagaagtaagactggagagactaatgccattcttgtcgagtcctaaaagcagacttaggacttaattcaataagcaataggaagccattacatcttttgaactgcaatgtggcatagttacggacgtgctttaggaaggctgcttttagaacaagtgtaagaaaccactgagccaaagtgagaggtagggacataagttaggtaatgaggacccctgctagcgaagcagtggcagaaatggagaaaagagttgggtgcagggaatgtcagtgatgtaaaagtcaaagacttgactgctgaaggaatgtagggaatcagtgcccttggaatgtcaatggcctggtctacattgagaatgaagactgagaaagggcttcctgagggacagagagctgcaggtgatcaaggacactcaatgggtctctgagggaaaagaagaccaaagaattagggagtagctagcagaaaatggaggcatgacactaaacacagactgaaaaagagtgctgattagaaagagaaaggagcccaaaggcagatgggaaaaccagccaaggatggagagacgtctgttcattagtttgtagtttggacctcacctatcttaccaatgtggtattatgctctagtaaaaagtcagcgatggccgggcatggtggctcatgcccgtaatcccagcactttgggaggctgaggcgggaggattgctggaaagttcaggcattcgagaccagcctgggcaacatagtgagacctcatctctacaaaaaattaaaaactaaatgggcacgatggttcatgcctgtggtcccagctactcaggaggctggggtgggaggatctcttggcccaggagttcaaggctgtggtgaactaaggtcacgccactgcactccagccttggcaacagagtgagaccctgtcaaaaaaaacaaacaaaaataaataaaacaatgaacttagagtcagacaagcaattcaacatggaagaaagacagcccatcccctcccaattagtgtggaagatccatgtaggtgtggagtccccctccattgacctggtgtctggtctgtcaatgtaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtaagtcagctgtccaagtaagactacatccagtggtctgctgattaggggattaggctaggagccagaaaaactagataaatctgttttttatggctactttgtatctcagtttttccactataaaattagggggcagtatactggaaaacgcttttgagagtcaggcaacatgttttatgtaaaaatgaaaggataagaaacaaaacacaaaaaaacactgattttgattccaggttctaaaacaatttccaaatgccatgtatgctccgggcccggcggctcatgcctgtaatcccagcactttgggaggctgaggcgggcaggtcacctgaggtcaggagtttgagaccagtctggccaacacggtgaaaccctgtttctattaaaaagcaaaacaaacaaacaaaaaagaaaaccaaatgccatacatgatgagcaccttagagttttcctttctttcatcaactctgggctggactgcagtcttgcttgaggcaaggaatgcataaatagaacaatgggatcatctgagtggccagtaagcctggtgttttatg

SEQ ID NO: 1533 - DNA, 1756 bp, Homo sapiens
ggaaacctagtggttctacaggcagtacaacaaacacatggtcacagacactcagaaacacacacagtcacacatgctcagaaatatacaaacggtcacacactcaaaacacacgcaccatctcccaatctatcaccaactaattgcctatcacccggtcacttcagttgttctctctcccaggacaagtgggcaaccaccacccagggcctcatgagagtaaagagactttgcgttgggaagactctcccaccgacgtccaggaccgattaggaaccaagcgagcccctgagatctcagcccggaccctccgggtcacagacaggaccaagcgccgctgcgggcagtctcgggcttctgcctggcatctctttcgcagtgcagatgcgttcccgcgcccaggcccttgctctcccagctaacgcgcgtgttatgggagatgtcccctccccctgaccttttcctatcagaaaccagacggtcgtctccagctcactccctgaagcggctgaaggggggcgggaggaggagcccggcagggggaggacggcccgacttgggtccgcctgccctatcacacagacatctgctctcagtttcttcctctttgtggtcgctacagatgacaaggggagaggagcggaccgaggcggaacaaaaaaaaaaagttatgtcataaagatataaaccggtgctgtgactcacctgctcttagccgcaggtacgagtttcgtggcagcgcctccgctctgctagcccggggcccgggtcggcctaacgtcacttggctcggctgactcagatgacccggtttctagtgacgaagcaaaagtggggctttttcccttttctagtctgaagctctcaggaggaaagaaaaaaaaaagtctgtattctccagtctcccggggttgaactttgggtcaggaatcaggagggaggaagcaaagagcaggaggggcgcgagactgggccgcagcccgcgctcggaaggtggcgtgtacctctggggagggaccccggggtcagttatcccacaaggtctctaagcccagtctccgacgccaccgcccccggccttctccggctgcgaggttccgatccagagccctagcccgcccgcccgcctggccccgcctattttttctttttccaaagggggttacaccccctccctccccatttccctctttccctagcctccgggcctaaaccaattacactgctttgcaaacaaagtgagggccccgcttgggggaggggtcgcgggggaggggtcgcgcgcagcggtgaagcggcggggcgggaggcgcggcggccggactggcgggcggccgccttgcaggtgcacctcgggctttgtaggtgcgagcgtctttgtgcggcggacaaatggggagaggacgaggaggtgggcactcaagcgacgtaagatccacatcagctcaactgcacttgcctcgcagaggcagcccgctcacttcccgcggaggcgctccccggcgccgcgctccgcggcagccgcctgcccccggcgctgcccccgcccgccgcgccgccgccgccgccgcgcacgccgcgccccgcagctctgggcttcctcttcgcccgggtggcgttgggcccgcgcgggcgctcgggtgactgcagctgctcagctcccctcccccgccccgcgccgcgcggccgcccgtcgcttcgcacagggctggatggttgtattgggcagggtggctccaggatgttaggaactgtg

SEQ ID NO: 1534 - DNA, 3071 bp, Homo sapiens
actaatgaggaaagggggaacaggggaagttaaaacccttggtgaaggtcaaatggcaagtaagcaaaagaaatgggtcaggaaacccagtctccttgctcttggtgctcatggcactacatattacactgctgttaccttgatatttggataaaggaatgcaacatactgctcctcccaaaaggttttactactttacacaggttagctggtcattttatttttgcttctttaactcaacccctttcacctgggcctagttctcatcaaagggtggtattcaatgtatccaatgaacccaattagcatttctaaaacgcctgggcaacacaaccaataagaagatgctattgaacctcttacttccccactaatccccctgcagttggcagaacttagctgccatgctcagtctacagactacaaagttgctttgagtttcaaaagtggggatctggaaaaggatcttggcacagcccaaaaaaataagaatactttcacaacgatccctcatccagagttagacttgctgactttagagggtgggagtgtaaactaaggagaatcatatacaaaccacctatgggaatctaagaggtgataggctggtaggctctttggaggtggctgggacagagaaaaaagaagagggacaggacctctgtgaatcaaagtcagatgtgcctgccttagacaatcattgtttaatgttgtctaatattttaactccttcaaaatgtcaactgttcctacagaatacacacatgtcaaatttccaagacagcatcatctacctgtaccatgctccaaatcccatcctcccagctgcccctacttgaaccagactgacctgcaaaaatagagcagaaaactcacaggcagtaatgttccccttaaataccctacaatatgtcattaacaagaatcacgatgaaacactattgtagaaattgccagcattaaaccaaaagaatgttggtcagttcatgtttcttttacagtgtgactttgtttgagagggataaaggacaggaagaggagtgtacatcttgctttagctgttcctcacttggctaaggaacttttgctgtaggaagtgaagaccctgcacctagttacaaggcttttgatgcttgtttgtcaagttcaactgttaaaggggagataggctcttccctagtagggagagggaggaaggaaagggggatggggcggggggagggaacaggtaatatctgccatataaatattagtatgtagctgacacgttataaactgagctgttagggtgaatttcaattttgttggaatcgaccttttttccctcttaagttcaattgacttacagtagatcccagaaagaactcaatacgttatttattctagaaagctttcttccctgagcaaaggaggcagagctaacgaggagaagggaggagcttaggtgaacagaactgaagtcacagctggttagcatgactagaatgcatggaaaagccagcccaaattagatgagtgggtagatagagagctttgaaatccttggaattaatggtggagtccatcgtaattgaaaggtcgggccttagtgggctgggatagggagagaagctgtcggggacctggggcagtgagcctgtaccccgtggcttctcacacactattttgaaggcgttcccatgcgcaatctcgcctgtcagttcaggctgtaggtttctcctttctaactcctgagcagaacaacactgaacggtggtagtcttgccttgccacccaatgagtgctagaaaacagtcacttcaaccaattggttcagtccggagaacgtgagcacattctactttactttctgttcaatgattttggaaaacaaccttttagattctggtcagaaggggcttggatccgtgactttgaaacactcgccactaccacaaacgactttggaagttaatcagaaataaacagtatctgggatctcatccgtcctaaacccaggggtcagagcgtggggggcttccactaacttcaggttaagaggatgaaacagatccgcggagaagggtcccacgatccctggagactaaaagcaagccacgaacagccgggacgcgcgggccggggagatgcgccgggggctggagggcggagagcaccccccgcaggtcccggccagagcccggggccgggtcacctgactcgcggaatttggggccgcgaggggtggaatgggaggggaatggttagcgcctcccttcccgctcccactggatccaggtcggcgggggccggcgcccggcggccacgtggtggtgctgccgctgcccccgccccgccggcctagcccgggagctcggcgcccactgacccccgcagcgggggaggaggagggactgcggcgcaggaagccgagcaggaagcgagcccggcggccgcgttttcctggggaagcggcgggcggggtggagcagccagctgggtccggggagcgccgccgccgcctcgatggggtgagtgcgcggcacggagttgggaggctcccggcgcggggtcccgggctcgtgtccccgcctttgtgtctggagctcgggcgcgggaggcgctggggacggcgcccgggcggagcggctgagcgggctgcagccggggtcccgccacctctccctggtccaccgccggcagcccactgtctgcggagagcagatctggggacaagaggaaggagaggaaggtggagatgagggtagagcgggaagacccggccaagttaggagaagggttcttcccgggtcctccgcgactcgcaggccggctggggcggggcgcggggcaggggccgcggcggagggagcgcgggtgggaatgaatgagcagacccggagatgcaccctggagtctgcgccgggtcccacctgtttcgccccgcgcggcgcctcgctgcccccgcgtcggtgctgctgagcccaatccgcctcccggctgaacttggaggaggtggggagggaggtgcgagcgggagactccgggtggctcccaggacgcggggtccgctattgttcctcctctgactc

SEQ ID NO: 1535 - DNA, 965 bp, Homo sapiens
gtccctggtatttgcaataatcgatctcatcctacacttgtccttccaagccagtgtttctaagagtggtcctgatctgtgatcactcctggaacatcggttaaaaagtgcagatcccaaggacccaagctagacttgtgaatcagaatttctggagataaggcccaggaatttgttcaacaagcttccatagtagttccaggcatatggaaccttttgaaattcactgctctcggagaaaacccatgctttttgcattttttttaaatggaaaaatgttgctagagacttttagctggaaatataagagaagataataacaacacagtaataataatgggcggagtcatggggaggggtcgtttgaagctctatttgagaacctgctggcattggtgttgttggcctgtctcagccaccctgatgctcaggtaggaactcctgaaaaaaaaaaatgtctgggccgcgccctatgagaccattgaaaggtctgggatgtccattcatccttggggtcacctatgccacaggaagttctggacaagaacttcccaacaatccataagcggacgccacgaggcgcgaagcgcgttggtggccacacgcaactccaggcagcccaaccctcccgctaccttctgcaactgcagtcagctcccaaaagtgaactggcacaaaaaggtgggacttccggccctggaagccaatgcgcatgtggcagtcaaccggttacgcaatacttcctgtcgcgtgatcctgaggaccaatgaaaatgcataattgcagtccacgtgcctcggtttccgttagcaaccagaggcttctaaacaacctaccctccttccccattttctgtggtccaactaccctcggcgatcccaggcttggcggggcaccgcctggcctctcccgttcctttaggctgccgccgctgcctgccgccatggtgagtaaccgaccctcag

SEQ ID NO: 1536 - DNA, 1189 bp, Homo sapiens
actctaggagctttggggagagaagagagaaaggcatggcagtgtgtgtcggggtgagtacttcctattcaggcctggagtgctgcagggtgatgaagacaactagaggtggaaggatttgagggcaaggcaagtttgcacattatattcccaaggctgctttgaggttgtggagttgcaatactgtttctgaaatctgaacactcagtgtcaataggacatggacttgatttgtctgcttatcccgcctggtgtacatcccttcctcagaaaggccttcccccgtgccttgcagaccttgcttgtttgatttttatcttccctgctagaaggttagcccactgaaagcctagaccaggtcatcaacactgtcttcccagcgcctggccaaagcctggctcacactaggtgctcagatatgcagtgacgggagtagctcaattcctatgtattcgtctagaataaatctgctgtcagcatgctctgggcaatctgtttctttcttggtatgccttaccttggttagacataccacccggcatcctatccttcatttcagtggtttaaaaaatatatgcccgttgtctcttattgggaagctgagcagaaagaaaacagtgtctgttttcagaaccggtcctggcagcaacactcactgatgcctgtccctgcccatgggtggagcagtggggtgactttgctgctggctgcccattggcctatcctccaccctctgctctcctgagaagtcaagtgtggattttgtctgctagttacctttagcccagtgggcagcagcgtggggctcggcatgtgacttgtgccctgagagaccttggtaggctgggggagcgcagctgagccctgctaacccccgcccacttccaggctcattgccctcttctgtgtctgcagtggggtgtcacctagtagtcagctgttggtggcacagatggtgagtggttttgttaagtgctggtgccttctttccagaaccatggcctgaagaaatctgcttatctgttctttctttgctgtcatggtaaaccttgaaatttcgtgtgtgtgtttgtgtgtgtgtgtgtgagtgagtacacttacatggattcattgtagcagagattgaatgagcagagcaaatacattatgttggttctggtagtattaatggcctgtaaaacagagacca

SEQ ID NO: 1537 - DNA, 1187 bp, Homo sapiens
tggttgaggtatggtcctcattttactggttaacagttcaaagctttgtgtctcactctttctctgataactttataaggggatgggcagggagtggtttaagtgtagaagtattcagctggacttgaatatttcaataagtcagattaataaaatcagggcatctgctttgtttcttctttttacatccttaggaaattcaattggtgatctataagatcactttaatgaaaattaagtgggtttaagatttattatacttaattgggaagaaaaagccacaaggcagtgggtgggaataactgactccctgtggaaccacttgcatgtttgttatgggatcccaaagttaccccaaatctttctcctgatgctcagagtgaggagatgggcccagagcagtgaccacagtcagggagatcagtgggatagggtttggacagcaacctctgctttcctctccagctgggagactggcatctcttttgagctgccgtacctccctctctctagggagagcctgactgctcttttggttcaaaagggaatggcttaagcaaatctaactttagggaatttgccaagccagggttaaggagcacgaatccaacaggtttggagtggtgctttgaaagagcagcaaatggcctggctgctgctctcttgttcctccctgaagcctgagctctgcccagctagtgaatgacaaagggggcgctttcagcctctgtaaatagcctattgtacaaggggaggaggcggggcacggaatggcagcatcttgccagcttgggttgctgcgttaaggaaagatgtcaggctttcttaatttgccactgcaggggcaagggtgtcatttatgtgggtttgtttgagggctgcattcctagtgaagtattccatcaaactgccattattcatcttgatgaaagcttgaggaactttagaaggagagaaacatccagaccacccggtttttggtttctaaatgacatgaagagaatacaatgttaatgtaagtaaaagtttgcagagttgcaggggcagtgtgtgtgtgtgtgtgtgtatgtttgtgtatgtgtatcttcaagagaatgatgtccttgtgagtcacctctggccctgagccactattttcatggtacaaataaaatggtgaagaggtgaacctttgtgtatagtgggcc

SEQ ID NO: 1538 - DNA, 1179 bp, Homo sapiens
gagatgagccagaggatggaatgccacaggccccacttcgtctcccagcccttcatctttcttccatgtccaaaggcggctccccagaggccaagggctcagctcttgtgttctctgagactgtggcacagctcaccctggcttccttagtaggaagcttttaagaactgctctgtagaaagaacaaaccctaatctagctccagcaaagagccaggatcatgctgaacttcctgtgagccttcgtgggggatcgaggctggagaaagtgctgcttcattctgaggtatctgtgaggtggggaaggggcaggaaaatttgtcatttcggcttcctaatctgagaatggtagctccagggcccccctgtagccacagccttaggcggatcaaaaatgagactaatacaggtcctggtaatactgggggtgaccaaggcgaaagaatcgatttttaagttaagttttgaggtgtgactgtatcagagggaaagaaaccatgccaattgaacgactcacagccctgtcgttcctgacttgcttattttcttggctttgccagaacttcttcagagaccaaggcaggcagctctggcgactggagagaggcggggtagaaggtgtttgtgtgggtctgagggctgaggtaccctctagccagactttcctgtcctccgaatccagcagggaacagcgtcacctctgcctctgtgaggcttctgatctgagggggcacctcaagtcattttagtttgtttgttttcatcttagttgaaagatgataggccacaggagggcagggtcaactgtgttgaggcaagctggcttttgtgtcggcccttaggggctgaggtgaaaggctttgacacggagccagggtagctttggcagcttctcccctcctggtcagaacacttccactttcagttgtgaaaaaaaaaattaaaaccaggaagtgaagtccccgagcacgttagaaagcctgacatggcctgactcgggacagctcagagcagggcagaactggggacactctgggccggccttctgcctgcatggacgctctgaagccaccctgtctctggaggaaccacgagcgagggaagaaggacagggactcgtgtggcaggaagaactcagagccgggaagcccccattcactagaagcactgagagatgcgg

SEQ ID NO: 1539 - DNA, 1145 bp, Homo sapiens
ttccttatcagttgggggtttttttgccatgataccatcgtggaaatgaaagacaacgtgaaaatcctgcgtccttgtgatatttcatcagtgggagtgagcggggatcttaacgcagtaagaggcaagataaacggatgagaggcattagttcaggcttacaggagcaagatgcttttagtcaaagtgttcaagatagctctcttaaagaggagcagtgaaacccaaaaatgagtgtcttttgagggcagctggaagatgacccgaggggaacttttatcctggggtggagtcctgcgaagcaagccgcaggtgagggcgtgggccaattctgcgcctcactgctgttaggcgcaaggacatcccgaaacacactcaacgacaccagcagcgagactgacagaagcggatcgccagcgggagcaacaacttgaggcgagccgttagccgcctcgccttcctcgcagcgcccctcccgcgccccgggaagcccgttcggctccgccttttcgactgacgtcccgggcgagcgggggcgggcgcgtgggtgggccgagccgtctgcagccagcgattcggctggctctgccacaccaccgcgcgcccccgctccgcccgcccctccgggcgcgtcttttccgggctcgcgctgagtcccgcctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccggtgagtatccctggatggggaggttgcggccccggcacccctgccctgtcggtaccagggccccatttccagagggggactggcgtacctcacctgagccgggaggaggttgggtgggcattccagctcctggagtcggctcgcttttttccttgagccagggctatctatccgctcgcctccgctggggccgggaagattcccgaggtcactgtatctgctcctgtgatggactctggggtcctcggaaccccagcctgcctcttcctgccgctcaccgcatcccgagggccagaagtcatcttcctgatcggggtacta

SEQ ID NO: 1540 - DNA, 1118 bp, Homo sapiens
aattgcttgaactcaggaagtggaggttgcggtgagactccgtctcaaaaaaaaaaaaaaaaaaaaaaaaggagagagtaggatggctgagccatgacgcagtagcaatgcttctttttttttttttttttttgagacagagtctcgctgtgtcgcccaggctggagtgcagtggcgcgatcttggctcactgcaagctccacctcccgggttcacaccattctcctgcctcagcctcccaagtagctgggactacaggggcccaccaccacgcccggctaattttttgtgtattcagtagagacggggtttcaccgtgttagccaggaagcaatgcttcctattctagcgccttgctaaactatgtgtgctgcagactgtgttcgtgattccgaatcctaaaaacaaccgtcctaggcttgtctctcagcctagactctagactgatttggctcatttggttgtcttggagacgttctaattctgaagggggcagtggtcccttctagaagatagctggtctgcaaatgcacacctctgcttagtctgaatcctaaagttatagcttgagccaattaaagtggcttctcatttttctctcactctgatctcaaggagccctttttcttctagtaatctagaccttcctcttcctatcacagtctcaaggattgtgcccccaaagcagatgcaaagccctgtctaccccttctccttcccctgaggtagagctttatcgaaggtttctcttggtaaacgttagctttctgaactaagggccgtcttttttttttttcccgcttaagcccattgcataacaatctcttgttttaatcttttgcccaacactgcttttcttactgtcagaggttactacaagtgtttgaacaggtaacttctacctttgaacttctgttgtgacagattcaaaggttccaggggagtgtgttggccactctcaggacagtacacagtagcttcgggtgtgtcccagtcagtcctaggagctgtggaaagagtagaagtgcctgaatgtggtgctgaatcaatacagccagctgtgaggggagcacttcctggacccaggaagggagagtcttcttccaaggtaagctgca

SEQ ID NO: 1541 - DNA, 1016 bp, Homo sapiens
actgatgaaggaaattatcgccaaggtgtttttatccgtttatgaaagccatactttgtatttgggttgctgcagctgctcaaaacaatgggagaaactgcagttataaattccagaaaagcctgtgaatggagtgaaagtggagtgggtggtcaaaaaccaatggccgtggaggcttagctctcttcacaaggcacacagcaggtgctcaatgagtgcctgttgaatgaatggccacgcagcccaatgcgtgcctatgcacccctcctcctccaggcagccctccggaggtccagcctcctccccaccctcttggcccgccccgccccgcccgcccttacaggatgtcttcgcggatggaggtgccatggttgaggttgtggaagcggacggagacgcagtccctgagaatgaaggagcacctgttctcccttttgtaggcgctgaagcactccttgaagtcctcataggtcttgaagcagctgcccagctccatggccgcccccacaacccacactaggggctggtcccagcccgggcccaagatcacaccaggggtcaaaggtcacactatgagggtttataggcaggcgtgggcccagaatgccttaagggtccgccccaactgggtggcctattctggaactcagggaggaaccctaggcctgaccgggttacaagaggaagggggtgtatttgctatctgacaggggaaatgacactcagtccatattatccagtcccgaggttccgcctcctcagcgacatatccagtcacacacaggattcgcagattggcattcattttctccaattgctagagaaagagggccacagccaccagcggactgacaggagtcctgaccaatcataacctagattcctccttcccggggtctgcaggagacttccggttactagggcaatctgccggaagagtcaggttctgtgtatgtctccgcgtcttccgcggagcgggtgtgcagggcctgcagcattgaactagatgtcgtccc

SEQ ID NO: 1542 - DNA, 904 bp, Homo sapiens
gtgaagttggttggtacaggagcccaggaccacctgctttgcccgccagggcttacctgacagttggccggcaagtacttaccattattattgttttaacttcatgatcaacgttttaaaaaatcaggagcggtctcattaaaactcagatttccgctttctcttgaaaattcagcagctctggcaaccctgagttccaggtcaggctggaactgggggcgccccatgggaagaggggagggcgcgcgccccctctcgggaggtatttgcctcgagaggccccactaggagcccacactacgctctcctggggggtcccctaggacggggagggaactaataattactgggccctccccagcggcagccgtggctcctacattagctggtttaattctccaaacaggtcttggaggaaggcatccttctattctactgatcagaaagctggacaaagtcccactgccaggctacacagttggtgccatttgcggaggtgacctttgacctttaacccacgcggccacccgcccgagctcttacccctgctgcccctcgcgcgtcccactccccgtccctgccggatccgcttccctgcgctgggcccagcgcgccgccagggaaggggccggagcctgggagcccgccccgccgtcgcccgtcctccgcccgcaggcccacccgcagcggtcacgtgaaggaccgagcgccgcgcgcccaggcggggcctccggcctgcacgaggagggcagagtccgttgcggctgccgccccgacgcccgcgcatccccgctcgccgcgcccgccgccgcgatgtccggggccggcctagccgcggtggtgagctgcctgcgcccgcagcccggcgaggagccgcagacccatgaggtaaggaggacttcct

SEQ ID NO: 1543 - DNA, 1076 bp, Homo sapiens
tgggtgatctggaaggagttaaatttggtagtcatgggagacgcttctgtgaagccataggagcgaagattgattgtggcggcaggactgaactcagcttctgaatctttctagccgctaaacctacagactaagtggcgtccttggggaatgctgcctcaaacggctcgcgacgtcctaaaacatgtacatttattttggaaaatctgttttcgtaaaacctagcatacttaatcaccaacatttgttaacttcatggtggcatattaatacctgtcaggttgattttagttggagtgggacggggctgacctcaccgtcctacccttcggtatgaggccggcgtcttcacgacctcgcttttcacaaccccagtccccgagggcttatttggggctgtcggagtccccaagacgtggccccggagaagggtgaggtgccacagttcgaggtgccccagtaccctgcgtccggacagggggcggtgctcacgcccaaggccccgctgacgcgatgtaggccgagatcacctcaggcgctcgcggtgcaatcacagagcgcgccgtcgccgctcgagctcgccctgagatccctccgctcagcgccttcaacgccgtgtcccggcaccccgcacccgggcacacaaaaaacgggtcgcccgcgattctcagggattgatcgcctcttcaggtaagttatcttccggccccgtaccactgtgccacaggcgcagcccgcttcctcaggtgccctatcccgcgcaagaagaccacggcttcacagagtgttatttaaggggcgtggccagcggaacatcccgccccattctgtgacgcacggggtggcgcgcgtgggacccgaggggtggggctgggtttagtaggagacctggggcaaggccccctgtggacgaccatctgccagcttctctcgttccgtcgattgggaggagcggtggcgacctcggccttcagtgtttccgacggagtgaatggcggcggcggctgggatgctgctgctgggcttgctgcaggcgggtgggtcggtgctgggccaggcgatggagaaggtgacag

SEQ ID NO: 1544 - DNA, 904 bp, Homo sapiens
ataaaagatggagttgacgctggcatcaacacacacacacacacacacacacagacacacaacacacaagtccctgtacataactttattaacccagatatggaatcttggcttagttacgtgctgtgtgaccttgggcaagttacttaacctctctaggccacaatgtccaagtacctgggacagggtctggcttaccaacatggtacaggacggcacttttaaaaccagggactcgacttggacgtgcgagtcaacaaggtacaggacacatttctctccggggaaatcttgtgtgggcgccgaggcccggacgtagcaaccaaacgtcgggaagaggcgccaaaaggatgctgggcctggctccttgaagcccgggttttcccttttgagagccacaaccaagaaataaaaatctagcaaagagggggccactttctgcggcgagatacgccctctcggccgctcctccagctcccaggccccctccctactcgacggtgagcagcgccgcggcccgtgcagccagacgcgcggggtgcggcggggccccgggggccggggtgggggaggcggagggtgggcccgcggtcacgtgagtcgggccagctgctgcggggggcggcgggccccagcgccgggagtctgggtagggggaagcgcccggcggccgcctccgccactgcagctgcagcccccgaggtcgccgcagtaatccggacccggcagcacccgcaccctcggcggccgcagcctcagcaccgcagagcggagagcggagcccggagcccgccgccccaggtgagccgcgtctgggagcgcagggcgtttgcagcgctgctttcccggcggtttcaccccacccgccatcgccacctcctgcgtttcatctcctcccgctgtc

SEQ ID NO: 1545 - DNA, 705 bp, Homo sapiens
ggtgggaagtgaacaatgagaacacttggacacagggtggggaacatcacacaccggggcctgtcgtggggtggggggaggggggagggatagcattaggagagatacgtcatgtaaatgacgacttaacgggtgcagcacaccaacatggcacatgtatacatatgtaacaaacctgcacgttgtgcacatgtaccctataacttaaagtataataataatttaaaaaaagaatgttacggggcatatcctttctctcaaataatggaacgaggttaaaaaaaaaaggttaaacataaaatggcggcgggctggatcggatcacgtgaccgccatttctttccttcccacccaaaggaaagcccttccttcagagcaagcgcaagacatatagccccgctcattgttaagcgaggccaaggcaacccttaggcgcgctctatttcccctttcgtagcgaaagggccaggcgtattgagcggtcaggggagcgcgcacgcagaacgtcagccagtaagcgccgttcctccgggagatgtggaggaggggggcggcgtggaggaagagggggaagttggcgcatgcgcctaaagctgacgggtttgaaatggcttcgatgttagccgggacccgactcaggtgaaggtctggtccccgtagttggagcagtgggcggccaagccgggtctcttaacatcttgtcga

SEQ ID NO: 1546 - DNA, 1064 bp, Homo sapiens
tttagtaatgggcgctctagttttaaaaaatattattcaggccgggcgcggtggctcacgcctgtaatcccagcactttgggaggccgaggctggtggatcacctgaggttaggagttcaagaccagcctggccaaaagggtgaaaacccgtctctgcaaaaatacaaaaaattagccaggcgtggtggcggacgcctgtagtccccagctactcgggaggctgaggcaggagaatcgcttgaacccgggaagcggaggttgcagtaaggcgaggtcgcgccactggactccagcctgggcaacaagagcgaaagcgaaactctgtctcaaaaaaagaatattattcaaaaactgattttcacatttttaaaaaagacccactgagggaggaagaccgaatcccacacatgcgcgcgcacagcggttccgagttctgcaaccaacctcccacgggcgccgcgccttctccgcgtcacgtgacggccgtctcccgcaccttccatactctcaatgtagggagaggacgggttccatcagcaatttaataaaaaccattggtgaagcaaaaaaaaaaagcctgccaacctcttataacgttttttctttatttttctcttttatgtggacaggaagccttaggttggctatatttaccctcaaatctctttttaaaatgatttttaagtttcagcatactcccgcgcttaatgaaatggtttcccccagcatccccagctggtgcggtctgaaccattcggaacttcccagaggggggcaccggaataggggcggtggaaaagggtaattgtcgggcagcggcccctgcttcccagtcagacctcggagttgtaggactcggactgtgttcctgggcttgcgagagctagggaggcccggctctcctcgcggtgcaggacgcgctcggacggctcccgcacccccaccgcagtgttgggtggtggtacggctcagggagtcacgcgcctgggtgtcggcggggctgcgggaccgcgagtgagtgtggtcgctcctggttctgccagctcccctgagagcctgaacc

SEQ ID NO: 1547 - DNA, 1081 bp, Homo sapiens
gtgtgcttgcctgaaagtgtatgtcagtctctggctgcatgtgtatctaggtcgtttctgtgaatgtgtctgacagtatgtgtttgtgtatatcttggcattcatgtgtctttggagtgcatttttcttcctggggtgtggcgccttttctggctgtttttcacaaatttgtgtctgagagttgccacttctctagcagcctctatcatgtctctcagtccttgcctctctcaactccaagagcagccccatgccaccaccactctgggctcacccccatcccccaagaaccaccccctgctgttctagattctagacttgctgactgggcccagggctcagggttaaaagctccaataaacactcaccaggcaatgctgcctttgaccaatgcacacccgtggcgttgatggtaggggttccccctccctggctaccagatatttccagggccctggcctcagctttccagtgaaggccgccagtcgcctggaggactccggtgaaggagtccgacaagcacctttcgagacggagtcttggatagccacaagcgcgaattcttagaagcccggcctggcgctatctctgtgctaatatccaggcagcggcggcaaaccaacttcccaggaaaggatactgcgcagttattttttaagtgtaaatacacacacacaccgccaccactaccaacaacaaccccgcgcaacaaccaaaacaagcgcggtgctgcaaagggattcccagaaccggtttcctcttggtgtgagccccacctcaagccccctcatttacatgcaggccccgcctcctcggaagaaccgagcgtgtatttgcataagggggcccttgaaacgatgagggtggtatgcaaataagaactggctccgattggctgtggtacagcaggtgccgcgtccggattgatcaaagccaggtgggcggggctgtcgcccagggtgactctcccgggaggcgcgtgcccaggctcagtagcattggggctggcgcgcgcggcgaatctcaacgctgcgccgtctgcgggcgcttccgggccaccagtttctctgctttccaccct

SEQ ID NO: 1548 - DNA, 716 bp, Homo sapiens
aaggaacacttgatccctgagaacaaagtcatcttcatttatttctctttccaatcacaggaaaaataagtcacaaaaccttgtactttattacaatgccacattgttctgtttttgaagtcctggaagaggtaataacagaaccccgtatctgagccacttcgcctaggttagacccactcagcaactcccgtgctgaagacaggagaccgagcggcttgggcccccggccagaattctcaagacgctctcgcgagagccttccaaccgccgcgagctctcgtgaacactagttctcttcaatctcagcacctccaagggtcagcacctcccctccggctccctccgctaccgcgggccggaacttttgtcgataggaacgggtttgcacagttgagtgttgtcggccggcgtgaaggagactagggggccatcctcttcctttcgccgtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactagtaagcgatcttccgtcttctcacctggggccggtttttgggggagctgtgaggacggggcctgtgactcccctgggcctggatcccagctcagttccgagt

SEQ ID NO: 1549 - DNA, 1188 bp, Homo sapiens
ccctaccttctgcaaccctactttttctcttcttctttttgttttttgtttttgagacggagtgttgctctgtcgcccaggctggagtgaagtggtgcaatctcagctcactgcaacctcctcctctcgggttcaagcgattctcctgcctcagtctcccaagtagcttggattacaggcacgtgccaccatgcccagctaatttttgtatttttagtagagacggggtttcaccatgttggtcaggctggtctcaaactcaggtgatctgcccacctcggcctcccaaagtgctgggattacaggcgtgagccaccgtgcccagccccccaatttttttttttaattagcagggcgtggtggcgcgcactcgtagtcccagctctttgggaggctgaggtgggaggatcacttgaccccagggaggttgaggctgcagtgagcaattattgcaccactacactccagcctggacgacagagagagaccctgtctctataataaaataaaaacagtctaggactctgagaggcatggaattagaaagagtctctgtgtcagaagacaccattttgagtctcagctgtcactactagtgaccttacccaagttagtaaacctaactctcagattctccatctgtaaaatttgatccatttattagaacattatttttaacctagggtgatcccgggcccaggttctggtgggctgccgcatacattggctgggtggctctggtaggtcacgccctggccgcttcgccatcgaggggagggtgaggacagtctccgaggcggcgctgccgaacctcccggtgacctggaggccgcggagcccgcagggacccatggcccccgaacctggggcaagaagggcgggcgcgcgcggggcgggtcacgtgacagctccaggcccacgcggggccggggcaagggcggggcctggcgcgcgcggccctgcgggtgacaggcaggcgggaaggggcggggcctcgggcggggccgccgtggggaggagggcggtgggaggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatc

SEQ ID NO: 1550 - DNA, 926 bp, Homo sapiens
tccttgcatttgctgtgtacaattcagtgatttgggtctctcatccatttatactttcaaattttaccaatactttttgaacacacttaaaaaaaaaaaaacccaggaagtatctctaaaaggccaaggtaaaataaaatgaatgggagttcttgtgttcgagttttcttccaactgggctttcctggaggaggtggaagagtgtgtggcagatgtttcagaaaatgagcgctcaatacggtagatcacgctcccggggtcaaggagacgttttccgttttcttttccctcgcttaggcggcgggcgcgcacagtccagtgggagcgatgaggtgtttctaggcccccaagtcacagaaaagcaggcgattgggaacaacggaggcgcggcgggcccccgggccgcgggccagcgccaccttctggtggatcttccccgacgcgagtctgggagtcgtccctccccttgccagcctacctggctcaggcccgccgcgcccgcagccccagcgcggtcgccgtggcaacgccccgcccagccgccagcctccctttgcccctccccacgtccggcgcggctgcgcgggacggggtgggacggaggcggggagaggacgcaggcgagaggaactcggcggcgcggcgcccgcggcctattggctgccacgtcccggcgccagaagccccgcctccctgacgggggtcacgtgatccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggct

SEQ ID NO: 1551 - DNA, 979 bp, Homo sapiens
accttaataagccgaaacacgctttttttaactttatataattatttgagattaaagatttcagagatattttgctcattaagcatctcacactccaagttggaaggatactgaagggatgaaaaaaacttcaagcgaatgtagcacttaaaatccaattatcattgcaaggaatgacagacccaggtctcgggatgcccgcttccttccctctctcccgcaatgcggggacaaggggaggaaatccagccccatcgccccctctgcgaagtcctgggaagggaagactcgccagccccatcctacctcaacgcagcggcaacataccggaggccccacgtcgatacggtatccatctgctccaaacctcccgccagcgcgctgcatcctgggaggccgggcggaggctgcgtcgaacgcagaggaggcggagcctagaagccagccaggagaggtggccaagggaggctgaggaggcggggccctggggagtgttgtgaaagcagagagcccgcgagctctctagggcggagctccgcgggggaagcgccggcgatctcgcggctggcgggggcgggaccgcagtgcgggggatgtcgcggggcgaggccagacgagaatcgaatgggacctaggctgagggcctggtcccgcctccagacccaggcgtccgcattggattgggcggtgcggcggcgcttctgtccgccttccggtgtcacgcgaccgcctccccctcccacccttctctgtctacctctgggcgggactgccgggtgatgagatactcggtcggcgacggtagaacgggcgacggcgacaaccgcaatcacatccacgacggtgatcatggcagaggtgaggagcctattgcaccgccgctggccccccggacccggaagccgcctctgaggcccggggaccgagcgcccgtgtgcaggtgggctgggttgagggtaagcgggttgatgcaagtagt

SEQ ID NO: 1552 - DNA, 958 bp, Homo sapiens
gaggaacactccgtatgtcgaacaatgattggctggagcccacctttcttcttttttgctattagatgggcttgctgctcccgcccatctaattggctttggtctaggtacttctgattggcttcccccgggcggtgggaggcgcggttttggggattgttcatcatggattggtgaatttgggctccttctcgaggtggtggcccatcccgtctgctctctgtcccgtctcccgacccgtacgcttttccctcaactcgcgcgcacgaatggttaaaaaaagggtgtgaggctcgagcccgccagccaggccgctagcacctcgcgcgcgccctcagcgaggacccgcacgagctgcccggctctgtgcctgcgttgtttgaaactgtggaacccgttaggcttttggggaactacagtcccagctggctccggagcccgtgcgtgccaggggcgagtggccgtcgcgagacggctcctgcctttcgtgtctctgcagcgtggagactggaaccggcaatttcaaaggacgccacgttcaatcgcagcgctggcgcgggcggaggctaaaacacgggggtcctgagactgaggaaaacgcgccaagttcccctcggtggcggagtgctaaagaccctagcggttcaggcgttcggcgagcggggccgctgcttgttgcgctcctggctctcccggggcgggcgcagatgggcgccgctcccgggatgtagttggtgttggtgcaagacgggagcgagcggcggtcggggttcccgctcttgggagcggatggtcactcccccgcggggagggcgagccgaccagattttcctggggccggggacccggcgggctcggggcagggactcacctgtcgcacccacactcattcgggttggacttgccggcgtcaccgccgcggacttcgctttgggccatgaccaggtaaggagggcct

SEQ ID NO: 1553 - DNA, 1094 bp, Homo sapiens
ggagcgatgaggtgtttctaggcccccaagtcacagaaaagcaggcgattgggaacaacggaggcgcggcgggcccccgggccgcgggccagcgccaccttctggtggatcttccccgacgcgagtctgggagtcgtccctccccttgccagcctacctggctcaggcccgccgcgcccgcagccccagcgcggtcgccgtggcaacgccccgcccagccgccagcctccctttgcccctccccacgtccggcgcggctgcgcgggacggggtgggacggaggcggggagaggacgcaggcgagaggaactcggcggcgcggcgcccgcggcctattggctgccacgtcccggcgccagaagccccgcctccctgacgggggtcacgtgatccctttcaaagatggccgccctgttgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaa

SEQ ID NO: 1554 - DNA, 906 bp, Homo sapiens
acaactcaccgaggtctcctgtagcccatatgggccagatacctgtagaccttcctacatgctgccttgagtgccatggtgggagggagcccttggggcctccctgcaatacaggccaacttcctgtttgtgcctgtgggtgggactttatgagtcttcgagaagcccagccatgccccgtgggggtcagaacccgcaggcctgctcacctgggcagatacctactctagggagggggctgtgctggttctgcctgggcagccccacgctgaggtgtgtgcgtggtaggggtaggtgggagctgctctggtgaaacttgagccttctttgtctgcttcccaggggttgtccctgtatttggggattgggccaagagtggaccgggttgggctcccatcggagcagggagggtggcagagtcaagctcttagtttaagcttagtttaaggcagccaggtagccgaattctcggtcacgtgatgctcgcccccttccccaggtcaaaaaccaaatccagtaagctgtgaagtcagaggccagaggggcagcctcggccaccgtcgagtcactcttaggctgggcactgggtcggctgctggtggagtgcggggcagaccactcccctccctgggtggggggcgcggcctgagccgccccgccccgccccgctccaccaggtcgggccaggcgggcgccgggagctgggagccgggagcccagagttcggaacctagagttcggagccggctagggagccggcgttgtcgcggcgaggaggtgggcgcgctggagcaggagcggggccggaactggagccgaggcgcaggtggcgctgggtgagtggtggggcggcggaggtgcaggaactcccgcctcccgctcatccccgctcctgaacgaactttc

SEQ ID NO: 1555 - DNA, 900 bp, Homo sapiens
tgtgtaccaagaggagatgtagcgtggatggcaccaaagtcagggaagtctttccggctcctggtctgctggtctgcccttttgaaggccttggagtgttacagccataccctggcctttcccaggcttttctttccctggcacggatgcagtgtgtgcggtcagagctggcgagttcgagacttgtccgaaccatccacccgcagccaggccccgctgcagaggctgcggtggccctcccagcccctgggaatctatccccaggtcccctccccgaccgcgggagggcgtgttaggggagcagcttaggcaagcgacgattgcaccatccacgttttgaaaagaaagtccggggagcgcaaggaggaaacttttacaatccaaaggttgagccccagcatccatactcggcccctgcagcgatccttccactcctgctcgctgggttccgatcccttcccttccaccccgtctcggccgaaccctgtgctgggcactggccctttaaggagctgtcacgatggcgtcgctggccccgcccggcggggagggccgagaggcaggggaggggttggtggtggctgcgggcaaggggaaggcggggggggctggggggggggtctgggtctatttttagctccgggtcgggtcacgtgacgggagtgacgtctccgaatgttgttgttggtggcggcggcgagcggagccggaggagccgccgcaaagatggaggagccgtcgaggaggtgctgccgccgctgccgccgccgctgctgccgccgccgcccgcgaagccggagctcgagccgcagcgggtgagcgcgccgccccggcccagatcccatcttccccggaccccgggacgcgaggcggcgccccctcctcctgctgtctctgtcc

SEQ ID NO: 1556 - DNA, 978 bp, Homo sapiens
ttcccagtcccaacagaatcttaaacttctccttcaagcctgaatctttgcttgttggtttggccatggtggaccaggacgcaccagaaaacccctctgtgcaaacgaaacaggaatggggacatctgagcaacacctctgcccaccttccccactgcggacctccagccgtcaggaccctgggtctctggtgggcataacctttcctcccacactccctgggagaactcaactacagcccagctgaccagctcgcaaacaggcacctaggaaagcccgggagacaccaggcctggtctagagagctctctactcagacgctgccgcccgccccgcccgactcagtgcacgggttaggactgccgccgcgaagtcctgggagccccgacgtttgccgtctctcctctacccatgtgaagcaggagctgtcacggagccgcctgcagcagagacccgttcgcacccgccatgacttaaaactaagggatgctcggagctccggagtcgggttgcagtgggcgcgggtgagggcccgggacccggacactgcggggtccgcctctctaggccgctgccccgtggggaccgccacttgccccgtggggaccgccacttaccccgcgccgcgccaccgcgctccgggccgccccgacgcggagaaaggcgcacccccctggccccgggacgccgccggaagcgcgacccgcacttccggtagcggcattgcgcggagggccgccttgggagcttgctgggagttgtagttctgtgccgccctctggcggaaaggccggcgatccttgcatcacgtgacggggccgcatgggccgccgggatgtgtagtccgcaggagtccggcatgaccgccttgagcgcgaggatgctgacccggagccggagcctgggacccggggctgggccgcgggggtgtagggaggagcccgggcctctccggagaagagaggctgcagcaggtag

SEQ ID NO: 1557 - DNA, 978 bp, Homo sapiens
ctacctgctgcagcctctcttctccggagaggcccgggctcctccctacacccccgcggcccagccccgggtcccaggctccggctccgggtcagcatcctcgcgctcaaggcggtcatgccggactcctgcggactacacatcccggcggcccatgcggccccgtcacgtgatgcaaggatcgccggcctttccgccagagggcggcacagaactacaactcccagcaagctcccaaggcggccctccgcgcaatgccgctaccggaagtgcgggtcgcgcttccggcggcgtcccggggccaggggggtgcgcctttctccgcgtcggggcggcccggagcgcggtggcgcggcgcggggtaagtggcggtccccacggggcaagtggcggtccccacggggcagcggcctagagaggcggaccccgcagtgtccgggtcccgggccctcacccgcgcccactgcaacccgactccggagctccgagcatcccttagttttaagtcatggcgggtgcgaacgggtctctgctgcaggcggctccgtgacagctcctgcttcacatgggtagaggagagacggcaaacgtcggggctcccaggacttcgcggcggcagtcctaacccgtgcactgagtcgggcggggcgggcggcagcgtctgagtagagagctctctagaccaggcctggtgtctcccgggctttcctaggtgcctgtttgcgagctggtcagctgggctgtagttgagttctcccagggagtgtgggaggaaaggttatgcccaccagagacccagggtcctgacggctggaggtccgcagtggggaaggtgggcagaggtgttgctcagatgtccccattcctgtttcgtttgcacagaggggttttctggtgcgtcctggtccaccatggccaaaccaacaagcaaagattcaggcttgaaggagaagtttaagattctgttgggactgggaa

SEQ ID NO: 1558 - DNA, 981 bp, Homo sapiens
gcacataaccacgatctaccctcgtaaaacgtttccagagcgtcccagcggtgcccctcatcatctggcggcccctacgcctctctgagactcacagacctactcccctctccagggggcggagcccacaccgctgagcatttactcttgttcttccctctgccaggggcaccgttctacccctttctgcctggagaaactgccgtttttccttaaaggatcctcgaagccggaaggagcagccacctcccactcccggctgctgcaagcaagctgctttgacttctttctagagttggggattgctgctggagtccgagtctcaggcccagagtgggtgcgatggtcttgcttgcaccctgtatcccccggcagacgcccgggaactctactaagtgggtgaccccagagagctcgcccccacactccgactccgagtccagcactcggtccactgcacagggacctcgcgccccacagctgcgtcctctctgaccttcgcaatccggtgcgcggcccgcggaacgccccgatctccaggggcacggaaggccgaggcgtgccgggggagccaggagcagctggctggcgggcgccgcgggcctccccggtcacgtgacaccccggacaacgtgcgccgtcacgtgacggcagagcctgtgagcgtttttctcacgtgacggaggcgcctgcacgtggaccaatggggaggcgggggcggggccggcaggggcggtgcgcgggaagggaccccggacccggaggtcgcggagagctgggcagtgttggccgctggcggagcgctggggcagcatgaagtgcctggtcacgggcggcaacgtgaagggtgagtgcaggtcggcctggcagcggcggtgcagcagccgcggagccgccagcctaacccccttccgctcttctccccgcagtgctcggcaaggccgtccactccctgtcccgcatcggggacgagctctacct

SEQ ID NO: 1559 - DNA, 990 bp, Homo sapiens
cttggagtgttacagccataccctggcctttcccaggcttttctttccctggcacggatgcagtgtgtgcggtcagagctggcgagttcgagacttgtccgaaccatccacccgcagccaggccccgctgcagaggctgcggtggccctcccagcccctgggaatctatccccaggtcccctccccgaccgcgggagggcgtgttaggggagcagcttaggcaagcgacgattgcaccatccacgttttgaaaagaaagtccggggagcgcaaggaggaaacttttacaatccaaaggttgagccccagcatccatactcggcccctgcagcgatccttccactcctgctcgctgggttccgatcccttcccttccaccccgtctcggccgaaccctgtgctgggcactggccctttaaggagctgtcacgatggcgtcgctggccccgcccggcggggagggccgagaggcaggggaggggttggtggtggctgcgggcaaggggaaggcggggggggctggggggggggtctgggtctatttttagctccgggtcgggtcacgtgacgggagtgacgtctccgaatgttgttgttggtggcggcggcgagcggagccggaggagccgccgcaaagatggaggagccgtcgaggaggtgctgccgccgctgccgccgccgctgctgccgccgccgcccgcgaagccggagctcgagccgcagcgggtgagcgcgccgccccggcccagatcccatcttccccggaccccgggacgcgaggcggcgccccctcctcctgctgtctctgtccgcgggctcccagcgcgcgcgccgcgctccgcgccccccttccttcctcccggccctgggagccagccggcgccccccgggagcatcggcagcccgtgagcgggacatcggggttgctgcgcgcgcccctccctgcccctcccagacaggggcgccttccctacaggtaagggaggggcc

SEQ ID NO: 1560 - DNA, 949 bp, Homo sapiens
ataataagtgccatgccctttcctgttttccctcagaggcaccctcccccgagctgggggagcaggcttctggctgcgtgtgtccttggcacccagcctctccgaggacagcaagttcactgcaggagggcggggatgggacccacagagcctggagtggagagtcccggacagagtggtgggaaaggaagcgttttcttgcttggggcgaaagggggcagcggagcggagcgcccgaaacccagcccctgcggaccgcaatctttgggaaaaaggcgcaaggtgggaacgcagggccgcacgtgggaaccgttcgcggctgccgggtttgcagcccctgcccgcgcagctgggagccgcaggaggcggcccgggactccagcctgcagcccctatcccgcctcctcccacgctccagccacggcgcggcgctacctgctgcagcctctcttctccggagaggcccgggctcctccctacacccccgcggcccagccccgggtcccaggctccggctccgggtcagcatcctcgcgctcaaggcggtcatgccggactcctgcggactacacatcccggcggcccatgcggccccgtcacgtgatgcaaggatcgccggcctttccgccagagggcggcacagaactacaactcccagcaagctcccaaggcggccctccgcgcaatgccgctaccggaagtgcgggtcgcgcttccggcggcgtcccggggccaggggggtgcgcctttctccgcgtcggggcggcccggagcgcggtggcgcggcgcggggtaagtggcggtccccacggggcaagtggcggtccccacggggcagcggcctagagaggcggaccccgcagtgtccgggtcccgggccctcacccgcgcccactgcaacccgactccggagctccgagcatcccttagttttaagtcatggcgggtg

SEQ ID NO: 1561 - DNA, 917 bp, Homo sapiens
tgtacacttcaggaagacgtggaaattcccagggcggaccaaaacttgagctgttccggcggtagtgatttgaggtcagtttgaaagagaagttgagaaagcggccgaggggcgaatttggctgcactacacgctcgccacaaagaggaagggccgccggccgccggggccgagtgcgcttccagcccaggcggagcggtagacgcaacagcctccgcccgccacgtgacccgtagtgttgtggtctggcccgcgtgggtggcgggagcgccgagagggcgggggcggcgatggggcgggtcacgtgatggggtttaaatctcccgcagccggagccgcgggggcgccagtgccgcgcgtcgagcgggagcagaggaggcgagggaggagggccagagaggcagttggaagatggcggacgaggcggccctcgcccttcagcccggcggctccccctcggcggcgggggccgacagggaggccgcgtcgtcccccgccggggagccgctccgcaagaggccgcggagagatggtcccggcctcgagcggagcccgggcgagcccggtggggcggccccagagcgtgaggtgccggcggcggccaggggctgcccgggtgcggcggcggcggcgctgtggcgggaggcggaggcagaggcggcggcggcaggcggggagcaagaggcccaggcgactgcggcggctggggaaggagacaatgggccgggcctgcagggcccatctcgggagccaccgctggccgacaacttgtacgacgaagacgacgacgacgagggcgaggaggaggaagaggcggcggcggcggcgattgggtaccgaggtgcgcagggtgcgggcggccggaactgcgcatctcctcctccctctccccgggctcctactggcctgaggttgag

SEQ ID NO: 1562 - DNA, 1048 bp, Homo sapiens
gaccacacctgtcagcagagtccgtcagacgtgagaagggtgggagcggcggactgtgaacgctggtagggccccggcgctccgagaaagtcccagtttcgcggtcgcccttccctaccacgcttccggcttccggtgtcatagctgtgggatccggaagtaaaaacacaagccccgcccccgagaactcgggaagccggcgagaagtgtgaggccgcggtagggccgcatcccgctccggagagaagtctgagtccgccaggctctgcaggcccgcggaagctcggtaatgataagcacgccggccactttgcagggcgtcaccgcctacacgccccctcgtctctcggacggcggcgtctagcctcggggcgctcggccgccccgccctctccgggggaggaatcaagaagagactgcccaatagggccggcttgacccgcgaacaggcgagggttcccgggggagtggcgcggcagaaggccccgcccaggagccgagggacagcccagaggaggcgtggccacgctgccggcggaagtggagccctccgcgagcgcgcgaggccgccggggcaggcggggaaaccggacagtaggggcggggcctggccggcgatggggattcgggagcactacgcggagctgcacccgtgcccgccggaattggggatgcagagcagcggcagcgggtatggcaggcagccggcgggccggcctccagcgcaggtgcccgagaggcaggggctggcctgggatgcgcgcgcacctgccctcgccccgccccgcccgcacgaggggtggtggccgaggccccgccccgcacgcctcgcctgaggcgggtccgctcagcccaggcgcccgcccccgcccccgccgattaaatgggccggcggggctcagcccccggaaacggtcgtacacttcggggctgcgagcgcggagggcgacgacgacgaagcgcaggtaaccggccgggcgggcgccgcgcaggcggaggagcgtactgtcccgcgctgcgccgcgcggcggtaaaatacacgctgttt

SEQ ID NO: 1563 - DNA, 930 bp, Homo sapiens
aggaaagccaacaaatacagcagccatgtttttcatcatcctgcaaactagaaaaacccaaaagcctattccattaagagttccttaataaagtacaaacaccagtgacagaaattgagaactaatgaaacaaaagccagctgcaagaaccactgagacataaaagaggggttagtctgtaagattacgaaccactgagatttaaaagaggggttagtctgtaaggttatgggaggtgatgctcgaatgggatctagtctcgtagacgtcaaacgttaatattctcatatatccaaagtaatgcggagagtggtttatgtagagctttacattttacatagcagctttacattcaccctcatttcacagataaggaaactgaggcccaagatggcacagtggcctcgacgcccaggttttccactttcaaagaccctccctcacatctcattacctgataatgcaacacagtctttaatcggggcgaatttcggggtggaaaggactagataatgctgataagcgtcatcatcccatatacacagcaccccaaggacagcaccctatcgcccacgcgtccaccagcccccgaaaatactggagacaaaagctgacgtcggcagagcgctcctagtccccgtcttctggtcctccacccttcccgaaaggccaagcggcggagctggggcgccaacgagaagggggtgagcgtgattgggctgtcctacatcacgtgacggccagtacgcgtgggatttggctccgaggaggcggaagtgcagcacagaaagggggtccgtgggggacggtagaagcctggaggaggagcttgagtccagccactgtctgggtactgccagccatcgggcccaggtctctggggttgtcttaccgcagtgagtaccacgcggtactacagagaccggctgc

SEQ ID NO: 1564 - DNA, 1080 bp, Homo sapiens
aaaatttagtcttccgccaggagttcaagtccctaaatctcctgcttttgcaaatttttctcttgactcccccaaaggactttttaaaaacggattcttaagatcgtccccaaggccactggaaaactcaaaggtcatttttagattgactactcgagagtgtatacatatgcccacaacaaaattatctaacccgtgacccttaaagttgctttcagtaggcctttggggtggggggaagccgcaacaaatcaaccaactttaaaatgaaaactcctggagctggaaatgttcgacactcatctttacagctctctgcgtggtaatggagggtgacggaaaacccttctagccaagaatggcatccagaaagacacattaaccaaagactgctgaatgcttactaatatattttatagtcaactggttatcgcggggaaccaaagaagggtccaggtgcaccaggtaaccctcagagcagccccgacctccaccaccaccgccgcagccagggaaggaaaggccgaccaggccacagtgcgcacgcgcggccccggcctttgtattccggccgggatttaaaagacccctgcgtgcgcgcgcgcgcgccagccagcctgcccagcagtgaggggcgcaagggaggggcggcgctggccccggtattacctgcccgcgttctccgcttccattccccgaggccgctgatgcgggcggctccacctgccgggcacacgggcagccggtctctgtagtaccgcgtggtactcactgcggtaagacaaccccagagacctgggcccgatggctggcagtacccagacagtggctggactcaagctcctcctccaggcttctaccgtcccccacggaccccctttctgtgctgcacttccgcctcctcggagccaaatcccacgcgtactggccgtcacgtgatgtaggacagcccaatcacgctcacccccttctcgttggcgccccagctccgccgcttggcctttcgggaagggtggaggaccagaagacggggactaggagcgctctgccgacgtcagcttttgtctccagtattttcgg

SEQ ID NO: 1565 - DNA, 1058 bp, Homo sapiens
tagagttcatcagcgacaagctgataaccacttttgagctgaattctttggtggaggaaggaaagagacagctgaatctgtgtttggggaagtggttagtacttaaaaacataagccattaaagactgtgaaatatcccagggaatgaatttccatagttcttcctgctactcacaactcccaccccaccccactaccctctctcccccatcgaagagcaccagatcttgtctttctcatacaaccaatagaaggagtaaggctggaaggcagagagagagctggaggtcgctacgggtactcattgtagttcccctagaaaaccatctttaaaataatttcgtaggaagttgggcgtggcggtgcacgcccgtagtcagcactttgggaggctgaggtgggaggatcacttaagcccgggagtttgaagctgcagtgagctgtgatcacgccactgcactccagcctgtgtgtcagagcaagaccctatcaaaaaaaaaattcgtagaagtctaagccctttttttctagtaacccaaaccgcgtgagttcctaagttctttttgttatttctcttctcttgaaacttaaactcttgcctgagctctgaagataaaggaggaaaaggggtggcattaccgatagcgactaagcgacaggtagctgagaaactgagctctgactggaaaaaagggggaaacccgcacccccaagaggccctaacgcgcagagcagcaagaccctccggggcgccgcgggagcgcgcagcgcggcgggtaaactacaactcccagcgtgccgcgcgcccggcgttgcgccgcgcccgctgattggcagccgcggatatttgaaaggagggtctggcgcggaaaacgaaggttacattttggatcctcgcggagtactggtcaggcggttaagtcctgtacctaggaaagagggcgagctctggggcggtaaggccggaagggactcgtgagcgtgggtacgtgctgaagtgaaggggatccccagcgctgacgcgaggagaggcgtgggtggctcctggagggagtgtc

SEQ ID NO: 1566 - DNA, 1055 bp, Homo sapiens
gagctcatccccgtcttccgccaccgctccctttttcccacgcttcggcattcccgttacgaacgcccttgggcagctgtaccgcgtcacccaccgaagcaatatttttaccgcgttgcctacagacgcaaagaaatcatgaaaccagctaaggctggggagaagactcctcccaagagcgtccccgcaccaggtcccgcctttcaaaccacgttatctctaaatcctttccccgcctccgtgcatcataggcccttcagcccctcacccacgaaactagatcatttcatagtgccttgtaccctactcgcgagatctgccctccagccaattgaggatcttaattaagggtcctgactcaagcttgccgttcagactgccagcgaagcccctcttatgagcaaaagagcaaccccgtatctgcaccggcccgatggcagcctagctcctcctaacccgagcacaaagaagggtgcacgctgagcccccacgtgggtagcggacctggtcacgtgatcagaggcgcgcttgtcgtggccgaagaatgcgcgtgattggtctgtctgacaccacgtgacggagacgcttagcctcgcctccctcctctaattctctaggacacttaggtccccaaccctccctcgggctgtttatcgttgtgccagatgcacagcacattgtgtgacactgacttaagattctaactatgtgcaagagggaaaaaaacagtggagaaggctgggctggaccacgggaaagagataggaaaacggatacgaatgtaaggcacagagttggctcggcgtccctggcagttaggaagacaggtccctggaggggccttggcgggtctccgctcgcgggagttccgcggtgtctttcccagtgctatctgcaggctggccagcttcctctgcgctccggaaagctgcggcccagcgcggactagtgaggacctccacagctcctgacattgccaggagtcctgtcggcgttttctcccagcctccgccatgccggcggtgctgggttttgaaggcagcgccaataagatt

SEQ ID NO: 1567 - DNA, 930 bp, Homo sapiens
tcgatcgacaccgttttactttttgtggggaggggaagcagtatcaaaatttcttcgggcgccagaacgagcggcaaagcttatgggagtagggccgaggctaggacccggcttccgccagtcccgctgggcccacagccggccctctgagggtcacaaaggggaaggtgtctgggatccacgccctgcagccccgcagctttgaggggccgtcatctaggcgaaggtgaaggcccttaccgcttgaaatcccgcatgagcctcctccgggccggggtcgacatgctccgcagctgccccgcggtcagtctgaaaaaaaaaaagtcccgcgcagcccccccaccccccggcgcggcggccgaatcactgtggatcgccgccgccgccgccgccgccgccgccgccgagactgacaaacaaccctgcaatgacgtctccctccgccgcctccggatccctccgccctccgccgctaccacagtgtgagtgctgggggaggagggggcgggacgcgggagcgcgccttccccgagcccttcagcggggcgcggttccccctgggcttcctgaagtaatagacaaatttgtgttctctgtgttcagactagaggttgtggattcaaagaccacgaaacagaaacactatcccgtctccctccccgtcactagtttaggctcggcggggtggagaaagagggacgcatccgggccagagatttcagggaaaggaggtgggatgatgtaagatcacgtgactgcccgcggccttgtcaacaatccacccctgagtgggagggggagaagtatctagaaccacgtgtccctatgacgcgtttagaacgggtcacgtgagcgcctcgcctggatgtgagtttcagccaggtctgtgaagcgggtttaagagggtgagggcgggataaacctttatta

SEQ ID NO: 1568 - DNA, 912 bp, Homo sapiens
aacaaatgcaatggaacgaaactatggctggggtacagagcacgtatttttgccatgtggtcacaactatgtggtcatagctgctaggatgatgtacgcaaactgctcacattaaagcaaaagtacttacgtaatacaaggggtttaatagtgcaacaatatttcttagcaacatttctgaggggcatatcaagttattatcgctaacgttatcatatcaggaaatgacggttaacaatgcaagaaacttttgggaaatgctatttagtgtttgagtccgcaagacatactcgtaccctgagcattcgcagttgctgctccaccacccattctctcactgctcacccacgtgcttctggacacttgcttaccaaagtactagtttgcatcacgtgacacgactagcaggccccctccgctcatgtatgacatcccaaagatgcctgattattttcccttctttagggaaaggtggtcccaatcaccaacaaaacagagaaagagaacgagaattatctctagtggttttgcctgctaatcttctttttccctgaaagaacaccctcacggcacggcgttttccttaacggtcaggcgttttcccgggcagcttacctgctcggcctgggtctttctggacagcaggcgctggaggtgcgcgtcactgtccgccgccgtgtccgcggctgcgccagacagtgtagaacctgcggcctcgatgtccttctcccgtgccctattgtgggctcggctcccggcggggcgccaggctggccaccgggcagccatctgctctgcccttcgtccccactttgggccctttcccggggttctggggcaagtttctgtccttgccaccgcctcctcctctgcctccggtggctccaaaataccaaacacgtccttgttcgt

SEQ ID NO: 1569 - DNA, 1083 bp, Homo sapiens
aatagcaaccaaatatcgcatggtggtttacgcactgcagcccatttggagtcctcaaatatgactgccctttcacagatgagtctgagactcaaaaactgtcactagcgtaaggttgtccagcgagtttagtggctgggaggctgaggggtagacagggcggctagcgatgtggggcaggcctggcagtcgccacagacgacctaacggtaggaaaatcttacagccaccaggagagttccaggcgccgcggcagggggactgggagaggggactgcgcccagaatgaaggctcgggacaaaagcagttgcgcaaacgcgccaaggctgggcgtcgagtgaccgcgggcggaggtcaccagcggccactccccggaagccacccacggaccacgcgcgcccctgcacgcagagggggccagggctccacgggcgagcggcgaccctgcctcccggagacggcgcggcctgccctgcgcgcctcagccccgggtgccggcgtctcgggcagcaccaccaagtctctctggaggggaaaggatggtcggatttgccccatgtcccttcctctgacccctccctcaagagtgccccgggacaccccgcctgtggctcagcctcccccgccccgcgctgccatctcctcagggccgggcagcaggctcccgagcgcccacagacccggggtgcggcccagcccacaaccgtcacctcaggggcctcaggcgcccagcggtgctgggcggggctggggcacgaccgggagcatgcgcagagcgcgcgtttcgcccatcgcgcacgcgcacacacctgctccgcccccacgctgcgtgccgctgctgggttccgccacgcccgtcatggcggcggccccggccggctctggccccgcccctcggtgacgcgtcgcgagtcacctgaccaggctgcgggctgaggagatacaagggaagtggctatcgccagagtcggattcgccgccgcagcagccgccgcccccgggagccgccgggaccctcgcgtcgtcgccgccgccgccgcccagatccctgcaccatgccgtcggagaagaccttcaagcag

SEQ ID NO: 1570 - DNA, 1959 bp, Homo sapiens
aaaagcaagcaagctctgaaagagtatgttacttgcgcagtgtcttacaagggatagctgtgtcatttcaaatacagatgtcaaggctggacgcagtggctcacgcctgtaatcccagcactttagcaggccgaggcaggcagatcacctgaagtcggcagttcgagatcagcctgaccaacatgtagaaaccctgtctctactaaaaatacaaaattagctgggcgtggtggcgtatgcctgtaatccagctacttgggaggctgaggcaagagaactgcttgaacccgggaggtggaggttgcggtgggctgagaacgcgctgttgcactctggcctgagcaacaagtgtgaaactccctctcaaaaaacaaaaacaaaaacagacgtccagtaaaggatgcacagtcaatagggactgatcaacactcgaaaaagcacagtaggaggccgggtgcggtggctcacgcctgtaatctcagcactttgggagtcccaggtgggcagataacctgaggtcaggagttcgagatcaacctggccaacacagcgaaaccccatctctactaaaaatacaaaaaatagccaggtgtggtggcgggcgcctgtaatcccaggtactcgggaggctgaggcaggagaatcgcttgaacctgggaggcagaagttgcagtgtgttgagatggcgccattgcactccagcctgggcgaaagaaacgccatctcaaaaaataaaaaaatagtagggccgggcgtggtggctcacgcctgtaatcccagcactttgggaggccgaggcggaaggatcacttgaggtcaggagttcgagaccagcctggccaacatggtgaaaccccacctctgctgaaaatacaaatattagctgggcgtggtggcccacgcctcaggcacgagaatcgcttgagcctgggaggcggagattgcagtgagccgcgatcgtgccactgcactgcagtacagcctaggagaaaaaaaaaaaaaggcaaaaaagcacaatattgcagtctgcagaatcttctttctccccctttcacaagagaccacattctgacaccaacttccgtggaaacactggcgctagctccaaactaacaatcaccaaattcgaatcagttaccgggagaaggaagtgaggcacttcgccgggcaggagtccacgttgggaggaggaaaggcgcaggctcccgagttgtggagccaacgttcaaatccttacggggtgggaccggcctgggccagtcattttacctgcgcctcagctctaacagggtactgaaatacctactttggggggcctgctaggaaattcaaatgggcaacgctggtcaggggcatctggcacagtggccattcttggtagagctacgcgctccagggctgagcgggaaatggcgaggccggggcactggggcaccgcccagacgcggggcgggcccccggggtcaggcccggccccacaccgccctcccccacagagcggcgaggcccgccgctgcccgcccgccggcccgccagcctgccgcgtcaagcccgccgccggggcccgcagcccgcgactcctcccccgccgcacctcgtggcccccgcttctccctagtcccgctagaggggctcgcgctccgccacccgcccgcccgcccagcgctgcctggcgcctcacctcgccgagaccccctaatccgcgccaaagagccgccggtcgcgcgcgcctccgggctttgcgtgcgcgcccccgggcggcgcagtggcgagcgcgccgcgtgccgcgcgcccgccgcctccgcccctcggccgtggaggcccccgccgggtgctgagcgcccgccaccgccctcttggccttttcccggtccccgccgcgcgcctgctgctgtccccgtgcccgaggactgggaggatggggctgagccgcttgcctgacttttgatccgaccagta

SEQ ID NO: 1571 - DNA, 2181 bp, Homo sapiens
agacgaggtttcatcatgttggtgaggctggtctcgaactcttgacctcaggtgatcctcccgcctcggcctcccaaagtgcagggattacaggcgtgagccaccgcgactggacggaagaaacggtgaaacttttaaggtggtagaattataggatctgatgactgattagatgaagcatggagagggcaacagtgtgcacagtgatgccttttcttcacaggcattataggagggacaggttggtaggaggaggcaacgggtttagttttggatttactgaccggggatgagtgttagctctctaggtagaggtgttccgcaggcaactggtgttgcgggacaaatcatagacgggagagaccgagcagagttcaggagagcctttattattaaggtgatcaccggctcagtcggactagggtccagaaagtctgagccccgaacaaagggatcaatcaccttttaagcagtttgtgttgggagttacgtgttgcatgaagtgtacttgcagaagcaagaacaaaggcagtaaattactcttacatttgttacaccatatgtcttacgtccttgggaatacatgcttttgtaacacttgctaatcagttttgtgactttacagcagcgctagggagggaagcaagaactcgctgtgcctcaaggaatgtgaaacgatggaacacagataagcctctccacgcataggggagaaataagcagttaatatactcttaacccaggccttgggtaggggaggtgctatattacattctacctcaaaggaaaagaatatacttcttgattagtatacttataaaattcattaatttccctttcactggatattcctactaattcccccagggccttgcagttttgtctcattcgctgctctatcccctagcttagcacaaaacctagttcttaacattgattaaataaatgaatccggtcaggtgctcccgtgggtgatctggaaggagttaaatttggtagtcatgggagacgcttctgtgaagccataggagcgaagattgattgtggcggcaggactgaactcagcttctgaatctttctagccgctaaacctacagactaagtggcgtccttggggaatgctgcctcaaacggctcgcgacgtcctaaaacatgtacatttattttggaaaatctgttttcgtaaaacctagcatacttaatcaccaacatttgttaacttcatggtggcatattaatacctgtcaggttgattttagttggagtgggacggggctgacctcaccgtcctacccttcggtatgaggccggcgtcttcacgacctcgcttttcacaaccccagtccccgagggcttatttggggctgtcggagtccccaagacgtggccccggagaagggtgaggtgccacagttcgaggtgccccagtaccctgcgtccggacagggggcggtgctcacgcccaaggccccgctgacgcgatgtaggccgagatcacctcaggcgctcgcggtgcaatcacagagcgcgccgtcgccgctcgagctcgccctgagatccctccgctcagcgccttcaacgccgtgtcccggcaccccgcacccgggcacacaaaaaacgggtcgcccgcgattctcagggattgatcgcctcttcaggtaagttatcttccggccccgtaccactgtgccacaggcgcagcccgcttcctcaggtgccctatcccgcgcaagaagaccacggcttcacagagtgttatttaaggggcgtggccagcggaacatcccgccccattctgtgacgcacggggtggcgcgcgtgggacccgaggggtggggctgggtttagtaggagacctggggcaaggccccctgtggacgaccatctgccagcttctctcgttccgtcgattgggaggagcggtggcgacctcggccttcagtgtttccgacggagtgaatggcggcggcggctgggatgctgctgctgggcttgctgcaggcgggtgggtcggtgctgggccaggcgatggagaaggtgacaggcggcaacctcttgtccatgctgctgatcgcctgcgccttcaccctcagcctggtctacctgatccgtctggccgccggccacctggtccagctgcccgcaggggtggtacgtacattctttagggtctgagtgggg

SEQ ID NO: 1572 - DNA, 1172 bp, Homo sapiens
ccaccccttgttaatgtgttaggattaaacagacaaacgggcccgcacaccgcctgccccattctagcccgccttaattctgggttccctttccccgcctctacaggccggctagtcctggcccctcacttgggacgcctctgtccctgatgcgaggcgcatgcgggaccgcttcccccactcccctctccgccaggaggaggagccgaggggttggccccgtacccggctgtggcagaaggggccgcgaaggccgggccaggggcgccacgactgcccagggcccgcccgcggcccgcccgcggcccgcccgccctctagccgctgggccccgaatggcagatccgcgctcggaccatcggcatcgcctcacatcgctccgccccgcgccgccctcccattggctgccgctgagccctcgggcccgcgcctcgccccccggcggccctggcagcgccgcagcccggagcggggtcggaggtgaacggcctggagtaaccccggacgtagtcacctcatggagctcgccggctgaggtgggagacaggggcggggcgggggcgggtcaggcccctgaagccccgccccttctccgtgtgccgggccggcctggtgctgcacgcctgtcagccatcgcccgagccgccggcgtctcctcccgcccagcagttcctccacgcaggggctccggaatcgcccgaccgcacacgttgccaccctgaggtgaggtgagggccggcccagaacctgtgaccggggacctggagaaactggggccaagggaggggcggcggcaggcagggggccgcctcccagcctccgctcacccgcacgcggcctgggctccacactatccagatcgggtgcggggcagcccagcccttcccgcagctctgaggccttgaggtcccctccctagagacatggagaggtctggggtctcgggaggtggggattcagatcccggaactgggaggcgtacagttcagggctcctctaggaaggggggctggagtttctgcctggagctcgcccgccacccctcttgcccagctccagcgtggtctgattccttccagacccctctccaatccgattctgggctcgggagagggagaagaccacgtgggaagggggcgttgcgggttgggtctgattgcattgaaagtcct

SEQ ID NO: 1573 - DNA, 1486 bp, Homo sapiens
ctctgcagacaccagacagaaaaggtcttccggccagggagcgtgggggaaaccctgtggggccgcgcccgtcagtgtcaaggaaaaacggagaggaaggcccttgcctccagggccctcgcagcagaattctgcccggcctgccaggaggccagcggggcacgggctgagggtgcaggatccggagggcgccgcccgcccctcgggcatcgcggggcccagggtccgcggggcctctgagctgaggcggtccaatgtaccctttgtccttcctcagattcattatgaaatccgaggcagtctgggcgactccagcggcgttcgcccgccgcagcctctcgaccgccggccacccgccagccacgcgcgcccagacaggagggcggccgggcgctcggcggggcggggcctgccgggggcggggcctgcgggcggggcggggccgcgggagggcggggccggcgcggcgagcgcaccagcagcatcctggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggaggtgagtgcgcccgccgtgcggagccgcgcctgctcccgcggcggtgcccgggccccggccgaggcgccggctgacgttgcccttcagggccgagcccggagcagcggccgccgcggaggcgcgtgagccaccccaggctcgtggggccgcgccgcctttccggcctcctgcccgcggccccgcttccctcggcagccggaggcctccggggtgcccgtgctgccgcagcttcctgtgtctgagtcgcgggcggcgcgggcgcggggctggtgcgcggccggggatgcgcgcgggaccgacccttgtgtgtgcggcggcggggaccggcccggcgaagcagccggaggccgcgcttcggctgggaggaggtggcccagctgggccgctgacgttgccctcgtccgcggcccccgcctgcccagaggccgggctcgcgggcgttcggaccgcgcgtggggcgagactgcactcgcgcccgctgagatgccggccccacgcagcgcggcggcacgaggcccacaggcagctcagaggccgctgccagaggcagacattctctcggtgactccagaggagtgcccgtggcccttgcacttggccgtggagtcattgatctaaggagtgctggcattttttgaaattgagaagcaaagatgatgtctgtcacctggcagcgtagacggagagtggcggtagatgacttgaatggacacgtggattcgagtctggggacaggcgttcccccagtcggtgcgttgtgagagtgtggaaaccccttccccactcagtccaatttcaaggttatggagcataattaagagtgaccattctaaaagcgttctctagtgccctg

SEQ ID NO: 1574 - DNA, 1500 bp, Homo sapiens
gagtagctgaggttacaggtgcccgccaccacgcctgcctgatttttatatttttagtagagacggagtttcaccatgttggccaggctgttttgaactcctgacctcaggtgatccgcccacctcggcctcccaaagtgctgggattacttctgtgagccaccaccgcggccggtcccttcctcctttaaaaatttttctcccagttcccactttttgtgggttagaggcatctaaattgaatgaaagtaccctttttggactactggggaggtggggggatgttctcagaaggggaattttctttctggtcctaatatccacctaatttttaaaagcagggctccttattattttgtaaagtttacaattacatcattagatacttccatgtctcatatttcatttttccaaactcttgggggaaatgagtggagggatggatggaatagaaaatagtttttcctcttggaggctgagggcccagtaggggtcaacagtacattcagccctctcctcacatattctgttctacctacaagtacagcaagtaaagccaaatttctcatgcatgcaaataaagtttttgcatttggccagtcggtccagttctcctgtcagcttccttccccactctgcctctgttcattaatcccccccttcccggtacctaaaccctccacctaacccagccctttcttccacttccggctactagcctctctcgcctatccactatcctcacactcagcatcccctgtctgtacgagattaaggagctctgccgtccgcagggcctgggttagcgtgaatctaagccagagctcccgggtgggggtgggggtaggggtgggggtggtcccagaggtagggcgaggaggtgggaagcgtattcccttcactggtgatctcaacgtagatttgcccggagttctcttgcaagagagctggcaggttttactatttcccaatcgtttactcgccaagctctcgggtccacgcgccgcggggatgcgccctgcaagctgaaacttcattcaaagcaaggcggcccacgaggttgggcttaggggatctggatgacctccaggccacttcctttctctctgcgcccttcccccactcttccaaccaccttcgctgtaaacaaaactgtcccccccgggcggagagaggtcgcgctctttcgcacactccctcgccaagggttaatttctcaaatcgcacgagggggaggagatttccctgtagacgagtaaaaagggtgatggacaaacgtgcgggcactaagaccgcaaggcattcatttcctcctacggtggatgcggacgccgggaggaggagagccccagagagaggagctgggagcggaggcgcaggcaatgctcagccctggatgtagctgagaggctgggagaagagacgaccgctggagaccgagcggcgtggggaagacctaggggggtgggtgggggaagcagacaggagaacactcgaaat

SEQ ID NO: 1575 - DNA, 1200 bp, Homo sapiens
agtgggagcgagatcaacatctggccccgccgcggggacaacgtgagggccgagggccccggaggcggaacggcccccaccctgcccgggcccccgaccgcggccgctaaaccgctgagtgtgcggccgcccagccagggggcggctcggacacagcggctgcggggggtgggggttcccgggaggccgaggccccgaattcgggcgccgcagggaccaccaccgcgatcttcctctgctccttggccgggcccagcgactcccaaaagaacccccttaggagaccacgaaagccccagaaaatatccctaccttcctcggaggcgagatctgaccctggcacgtccagagtcccctctctccttctcccccccaaaaccagcaggcccgggggagagatggggaagaagggcggcgggtccagcggctgctgaggcagaggctccggctcctcctcctcccgcggcggcgactggtacctttgtttggcggccgctcgggctccctggttggggggagggggacgacgaaaaatcccccccggactggaggtccgggcccccaatcgcgctgccctccagaggacggcggcgatggaccctctgcagctccctccgggcaaaggtccaggcggtggccgtggcggcggcaagatgaagctcaagagtctccctccgcttcggcgaccgagctcctcactccggactcgactgacgggcaaacatcgcttcccccccaccgactctaggttccccccctttctcccctcccctagattttttttccccccctcccctacctctttcccggatggcctcttagacgaccttggattggttaaagttctttagaacccgcctatacactgttcctattggtccctggatacaaacaacgacgccattttcccaccagttctatggaaacagaaagttacgcctcaaggctttctgggaaataaagtccatactctggggccaacgcgcaaatcctcgtccgcgagaactgcaaggcccgcaatgccctgcgcctgcgtggaccggtgcgggggcgggggggaggtgaaaggggcggggcaacaaagcagtagggaggcggcaacgacgcctgcgcagtgtgaccgggatggcgcattttcttgcaccaactaatgcggtgtcgctggcggctgaggagggcggagagttctgtggtgaaata

SEQ ID NO: 1576 - DNA, 2140 bp, Homo sapiens
tgtcttttattgtgtggcttggatctgtttaaaaagtaggtgggtcataaataataaataaagaaaacaggtgatcaggcttaggaggccctctgggttgtgcgttcagacagtatccaagaagtttgacttggtgtgaaagggtgggattacatgttaatgatagcagggtttagattctacactgaaaggaagcagttagtgagccctgggaggagttgaaggaaagcagttacaaaaatggatgcttcccaagaccctccattaagcctcctgggataggtcccctgtctgtccctagactccagggtactgctgggcacttcaagagagacagagaatttgaatactcatgagtcttggaatgtaggaataacaattcatccgaacaagcaaacatgatagacaatttttttttttacccactgaggacattgtgtctaaaaatctgatttgtgcccaggaattatctgtatagaattttcattactttatagaattgatattgcatagttctgtaggataaggatctagcacttgagttatgaatagctcaggatgacataacacacaatggttagttggactggatatgtccataaagctgaattctaattcaactatgagcatctctgattctgcttctgattctaggtgactttaatcccaaattgaattttctgacatttctgtaaaatggggcatgagagagcacgtcggttatggggtttaaatataaaagagttaagagctgagaagtgcctccttggtcaattaaaccacactgacatcccgttttccttttcttctttttcataattagagaggaagtggagggaaaggaaataaataactttaacaaagtatgcctagtttaaatgcaccaggtccccgctcttttataaactcataattctcattgcatcactaatttgaaattaatcacagctccttggtgtctcagaaagcttcctattgcttttcactacgtaactttccaagtctgtgtgtttggtactctaggatgttaggccaccagaggaaagaggatgtatcttttttttttttatactttaagttttagggtacatgtgcacaatgcgcaggttagttacatatgtatacatgtgccatgctggtgtgctgcacccattaactcgtcatttagcattaggtatatctcctaatgctatccctccccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccatattttcttaatccagtctatcattgttggacattttctttttgatagtcgaattcccttcaacgtctagcacagtgccttgcacatttacccactcaaaaaaaatttcgtaaggaattaataaatgaatccttaggaggaaaagtgaaaatgaagtttttctctcaggatgaggtgtatttctccgttcatttcagatatgcatcagctagtcagcgtaaattgtgctttttatatgctcaccaggtgtaggtaagagctttggctgagatggagaaattcatcgcgggaggataataaagcgggcagggatttggcaacctcagagccgcgaggaggaggcggagtcgcggagagtttgagtatttccgtccaatcaaaaggagactgtaagaggaggaggaggaggagatgactggggagcgggagctggagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggtaaggcgagagagagaaaattgaggtctctagggcaacc

SEQ ID NO: 1577 - DNA, 1097 bp, Homo sapiens
ttcatttgaactttgtccagtatcctatgtacatttgaagtttaactaccggaaaagtcttttgaaggcagatcgaatcatgttatttttttcccttaaaaatccctcatttctgtcatgtattccccatattatttatgtaataggtaaagtggcccagtttgccactttgaagttgctgagctggtatcacaagtcagtcccctctgttttaatctctgtttaaggaaagtcactctgaaacgacagatcttttggttccttatttctgctttcctccgtcctcttctgcctgtgaagccaccctcctctgctcagctctgtttcaggaaatcggagctgctcgattcatgtgtagcaaatcaaagccaattagatctgcgttaaccttggttttcaacaacttgtatcgtgaaaaggtttctgtccatgtttaccctcatcttgtcaccatttagacccctacatacaccggctcgcggagcctccagccattcagcgctagaaaatcggggggactacgtcttaaaaccttgagcacctgtttgggaacatctgcacctcctcccttgagggagaaaacgacccagacattcgcgtcaaaggaagtgtcgtctatttccctcaacgcagggcacccgttctaggaatgtttgtataaacaccgtaaacctgcctggtaccaccatgaatgacacaagagctagtttaaaaagaaagcaaagaaacaaacgcaaaacccgaaaccgcatcctccaccgcaaaggtactcggatggggcgcccgccctccccttagtcagaggacaaagggggcgtggccgagcgcgcggcgcccacgtgaccgcggagagctgcgcgcaggcccttcgcgcgatctgccgtcatatcagcttatggcgccggtcgctgattggctggccgctccagcctcccggcccgcttgctggctgcccagctgctaggacagtttgcagagcagtggcgtgcggagcggcggcggaccacctccaggtggggacggtgggtgggcggggaaggaagcggaatacacctgagcgggctgggccggggggcgatggaataaaagaagatgga

SEQ ID NO: 1578 - DNA, 1199 bp, Homo sapiens
agtctgcctagctctttttggctgctccctctagttagtaaatcaaggcaatcatagggctcacctcatttgttttccctcctcaaggaccactgtccagcacaacgtttaaaagccattgtcttataaatgcctgtttgtttttgtttttagttgttttaggcaggagagtaaattcagtcctgttgctccatcttagctggctagactggattgctataaattttaaactatctaaatagttgcatatatttagggggtacaaatcgatgttatgacttatgaatacaatgtggaataactgaatcaagctaattgacatatccacctcaaatacttctcagttttcatggtgagaacttttgaaatgtactcttagcgattttgaactgtataatacattattatttactatattcaccatgctgtgtaacatatagtccgaagggggaaaaaagcccttatttctcctaactgaggctttttatactacaagccttatttgcttcttttcatatctcattttcctccttaaaggaaaaggcactcagccactttggtagaaattacacaacatggccatttgcaatccctgcctctcccattcgtagtaaatcctacatagtcttacagatctcataaaaagtcagaccacacacataacctgatagcccacgcgcacattcccaacagagcctggaagagggacaagctcccggataagctgaatttacacaaagcagaatgaggtacccacacacactcacacacgcatggcctaggcagggtaaccatctgtccaggcgctcacacactatctttagccacacacaggcacgcacactcgagtacacacattacaccctcggatccgctcacgctccctgaggctcgcaggccgggccccgcccccggcgctggctagccggcggccccgcgtcaatgccacgcgccggttgcgtcatcagggtgcgccactgcagctggcattggccgggactggaagtgcgggcttctgcagcagccgaagctggagctgctagggtgcgaactgccagggcaggtgtgggctgcgggaggctactcgggccgggagcgccgggacaagtgcatggaggtggtgcgactcctgcaagttgctggggcagtcgtgtcccctattccctgacacccgagctccggtcttctccctgagaaat

SEQ ID NO: 1579 - DNA, 1015 bp, Homo sapiens
ctctgagagggaaatgtcctgaattttccctgcagagggaaggtcacctgcaagcctacattcgtgacagcgttcccgaggaccccctgatcctcatcttcttttctgcttcatcagaccagagaccgtggctaaaagccccccatctgccggctctcaggggcttccgaggcggcggggcgggaggcggcgcccagtcaaggacaacagaagactacgtcgcgtgggccaaaggaaacagtcccgtcaataaataagcctctggccgacgcacctcacccttcccatccatacaagacctcaccttctccccggagccgcggaggctgttctgctaaactgtctggaccacgacgaccccctaggaggccgggtcgcttattcaatatggcggcctcggctaactctgtcagccgggcctggagaacggaaagcccggagggactagaatccttgcattcgacaagtttgtcggcaatttccgtcagccgaccagagggcggagctgaggtcggcccagcccggaggcgggaaggacaacttggacccgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctac

SEQ ID NO: 1580 - DNA, 946 bp, Homo sapiens
ttgctgataatgatgaccctcctttattttgtgttatctacttgccattgcaacctccttgccttttttagttcttgctcccgtactgtctggctcgatgcccagcacctggtggtggctaataatatacactcaggtcacttacaagcaatgtgaccctggatgggttacttaacctcacttagtttgtgtcccccaattgcaaaatgggtataatggtacagaacacatcaggtggctctgagactccagcgcagtgattcaggagagtgcttggcaggacagtggcacttggtgcgagcttactgctagtgcagctggaatgtagaccatcagcgaacgtgtgttgcctttttaaacagtgggaatcaaacaccactcgctttccaaatgtaaatcctgggcttgcaagtaagtcctagagtgcagaaataatttcaaaatacagggttgaaattttaagatagcagcttttaaaaactgggagacaaaatcaaaataaaacaaagggacaaaccaacctgaatggcaccccgccgatgctcttcattaatttttaagattccaccctggggctgcttgcttcttccagcatgggaagcgctgacttgatgcggccaggtttctgggaccaggaggttgggacacgacgacgcactttttgccctgtgggtctgggtcatgtgagcctagaggagcgcttaaaggctcgagttctgcagggtcctcgtgactgggtggggctgcctcacttctgcctgatttgggaagcgctgcaaggacaaccggctggggtccttgcgcgccgcggctcagggaggagcaccgactgcgccgcgtaagtgccgcctgccctgcgtgggtcgtgccagctcagcgggacaggtcctcgcctcggtccctcggacttagggagcgcggggcaggtagtctcaaaagccctcag

SEQ ID NO: 1581 - DNA, 900 bp, Homo sapiens
agttttgagtcttgctgggaatccagggcggggctcacgaggaaaatcttggaaggggatttcatggctggatctcttccactcaagctcagtgccctaatttgacgccttaatagtagacgcaggcttttccattttccaggagccccctgacgcggccgcttcctcctacgtctccttcctcttcctctagcaggggcaaagtctccacatctccctctttctcttcctcctttgcaagctccctgcattcccgcgtctcctcctcttcctcccaggaaatgcaatgccctcagtgcgcccaccttttggcaaagccactgccggctgcgggtttcccctcccccgccaggcgagctctgcgcggcggcttcgcgggcacacgccttcccataccttacatggacaaatgcgtgcaggcaaagtcaggaattcaggcccctgacgtcagcctccagcgctcagggcaccgcacgggagaccaaggggagggggtggggacggtggggaggaaggagggggaaaggcaccaaccagcagccgctccagccctgccgaagtttcactttttgtctgtgggttcgttcccgggtcccgcgcgagctttcccgggataagtagctttagcgatcgggagacagccgggcgctgcaaggtaagggctggctgcacggcccggggcgcggggcgtggggcgctgggcgcgggcggcgcgctcgaggaggccagtgtggggcgcggggccgggcctgtccggggctggggacaatgggagggggagtgcccgggcacctcctcctctgcctctgcctccgcctccagccgccgccgccgccgccgccgccgccaccaccaccgccgctgccccggctgcctcctccctgaggtattgttgcaaat

SEQ ID NO: 1582 - DNA, 1057 bp, Homo sapiens
gggcagtcataccaagatttgtctacaagcagcagccaagctcacaggctcaccaggggcacctgcttcagtgtgaaaagatgaataataatccctttgtactccccttgcctgaagctgtgagccctgtgatgcccagtcattactcccagtctcatatcaggcaggttgatgtgaatatccaatcacaacctatacagcatcaagaatactaagagaagaaagaaaaagactgaacccacacaatctacaaatagtgagactctgagcaagagattatggatattttcatttttctcttcctagtacagattaccttctaaaaaatggacactgtggatttgcttaatacccagagttttaaaattattttctgcaaacatacaacacatgcaaaggcaaataggaagagtcattctgccttcaaatactcaaaatcatttctgaataaaaccttcctagaagagaatggaagcaaaaaccctagctattttgattaacctattactaaatattgagcaatgatgaaaaacaaaacattttagcaacattgttttcaaatacctactagattctagataatccatgtaacaattgtgttctgaaatttccgaggaaggcaattgattaattaagagagacctcagaagagctccttaatgccttgttcaggctcctctccagcagtttcctggaaatccctaaataataataagtggagatgcagcagttcaacactctactttgctaaatggaaatacattataattacaatagtaaacatctattgacctatcattctagtgccttaggccctgctttaataaatactttttgcaaatttgaatgtgaaaagacatggtttgcataagtagttacaaagggtcttttctattacagtaattgtgtttgttgatttccattttcctgaaaagtacccatcacccccactagcagatcctctactactgggaaaaacattaggttgctagaaagttgttttaatcaatagttgcccagtgaaatcactgtcttcgttgcctgtagctggtaaaat

SEQ ID NO: 1583 - DNA, 907 bp, Homo sapiens
cgaaagcagagaaagaaatttggaaagacatatgccaaatggttttctttggatggaagaattattgatggttaaagaaaacactttcttttaattcacactttttataacaagcaacttcattgttgcttgttataggaaatgtcatcagaaagacattttcattttgggaaaaagcacagaaagagggatatcaatttggtgcaaatgcagatggatcactttcgagaaagtgcaaaattgaatattaaaaggccttctgttttgttttaatgtagagtgaggattggaatgggccacatctacagggacactcagcagatgtggactgagtgactgcagtgtttcaaggtaaacattataaaaataaacaaatgagcaaactaatggaatgtgatagacaggatgcctgagtaattactataaatgctctggccttttttttgtgtgtgtgtcagagacccagaaaagactttaacctctaggtctattaatctggcttctatcacagggtagctagtggcgttttatggtctcaatcataactatattgcccttggtatgctctagcaattttgttctctttccatcaaagtttgttatcttatcctaggaatggaacatgtacacattggtgatatcacacaggtggatgtctacaaccttgagaatttcacatgcaggtgggaattttcccatgtgggaattcacgtgagttctcagaaggccagcagatcaccctcagctgccatccctacaaataaagttcaggaaggactctgaattctggactccaggaaaacccatggccatgaggttgatcctgttttttggtgccctttttgggcatatctactgtctagaaacatttgtggggtaagttatgctttctggtgcttctttgaat

SEQ ID NO: 1584 - DNA, 1057 bp, Homo sapiens
acagcccataagaatgctcaaaacccttgcaaggttgaagtatttactttttcttttttgagacagggtcttgctgcagaccaggttggagtgcagtggtgtgatcagagatcactgcagcctgcacctcctgggctcaagcactcctccgcctcagcttcctgagtagctggaactgcaggtgcgcgccaccacgcccggctacttttttaatttttatttttgtagagacggggatctcactttgttgcccaggctggtctcgaactcctgggcttaatcgctcttccggtctctgtcccccaaagtgctgggattagaggggtgagccaccgcaccggccttgagtccctattttcctggaatgaacattgcatttcatctgacaaaaggacggtttcagtttcctcctctgcaaaatggggtgggggtggaattcccatcttgcagccgagaattccctgataataaacgtcgagtaccgagcgcggttgaggcgcaggagcctacccaacgggagcagctcactaggacattcagagcaatctggaaaagtgggcacgggcagccccagacgtcatccccggaccccgctgcccagcagcgcccggacgccagcgttgtccgtgtcccaacaccgaagcccgcgtttggccgcaacccctccaggccctgctcctcccacgccgccgcggagcggatcttccacagaaaccacacacaaacgtccgttccgagagcgacctgctttctcggaaggcgtcgcggccacagctcgccttcctgtcgctcccaggccgggcgccaggtctcccatagcaaccgcggcctccagcgatggccgccagggcaccaccggaaccctcttcgcaggcacagagaggcgcgggtacgtaacttccgctcgcgcccggcggaagccagggggcggggcttgcgtggcggcgtcaaggggcggtgcctcgggtggcgggaagaggaggcgcgagaatggaggtggaggccgtctgtggtggcgcgggcgaggtggaggcccaggactctgaccctgcccctg

SEQ ID NO: 1585 - DNA, 920 bp, Homo sapiens
atcccttataacccctgatctgcataccacatccagagactcactagattcatgattactttggggcctgaactgaagatattcatttttttaatttttgaaattttcataacttcccacactacaccaatgttaggaggacattcttaataggaaaagaatagagccttgcagcatgggtcgtacattttggagatcctccactttggacataaagtagaggatgcagaacaattttaaaactcttcttgttggtgaccacagttcagaagtgttttagcagtgagtgttatcagaaatgcaaaacttaatagatacatacagcaggaggaaagtgctaatcaaccatcaccaactctgcttccgtcttctgagaaatgcagatgtgtaattttctaaatctggggaaggtttcttactgttgccgcatggggagctatgaaagttgtgacatttccatgcctctgttgttgtagctgctcatttgcattttatctttgccatgctgacatccaaatcacagttttgatgtgatgcttttggcagctgttcagagagactgtccagagaaaacagcaggtaactcagaccatttgtgaaaaatgttaggtgtgatacttatgctctcaaagggacaggtaagaatgaacccaaatgccaactcctcttcatggagggaaaaaagaaatcaatagatagctttttttttttttctggaaacttcgggaagtttattgcttttcaaacaatgaagattactgtgttcctatttatgaaacaagataggaatgagaggaatggtggggactgttgggaagtgaaactccacttgatacttcccaattctgtgccttctcaggtccctgagcaaaatgggaaatggttcagtgaaacctaaacattctaagcacccagatgga

SEQ ID NO: 1586 - DNA, 1044 bp, Homo sapiens
aaccctctaaggaatgttcaggcctgcattcgctgtacttccttcgaggagaaaacagacctgtgaccctgaacttatagcttggattttagacatgtaatggggccctcacatggcatctctgggtagccaaaagttctatgaggatctgttgtctgcaacatggatgtctgtcagagtgagaccagctcactgatattccgggacatttgtagtcacttcagttatttgggttttaataaatacttgaaaacaagacttaggaaggtttatttttcctctttattttttgtgtttactgtaagcctagagtccttgcgttttcaacaactttgttgtagagcaaataaaaagtgcaggtatttggaaggagaaaatgaaactgttctggaacacttatatgaaatgttgaataaatataggttgttaaaaatcagccaggcaatggctgttactgaacatggccatctattaacatgaaataaactccacctgcaaagtttccttttaggagaaaggagctcaagtcctctgtcctagtaattctgcgaagaattgggctgcgaagggctgacacccagggcagtggggtgccctcaacgccttggctccaaggtgcttgcagcccgtgtgaagccatgcggagtcccatcacatctgcatcctgccttggtctcagtgcagtgtgtcacacggcggcacaccggtcacacctgctgtggcagtccccatcccaattgatgccttttctttttttaattaaaaaaaaaaaatctcctggctgcatatcatcaagaaaaacaacattgttttcagggtctcttatctctccactcccaaatatcctgtttctttgggctggacagccaggaccaatagaaacctcttcctgccattggctgacttcatttcccagacttagcacaatctcatccgctctaaacaacctcatcaaaactactttctggtcagagagaagcaataattattattaacatttattaacgatcaataaacttgatcgcattatggccagcactatta

SEQ ID NO: 1587 - DNA, 1035 bp, Homo sapiens
taggccacagttagagtgaaggcagggaaggtttttaaagctgggtggaggggacaagtcaaaaagatgtggaaactggtttccctttcctatggctaaagtgctcaaaggggaaaaaggagtttcaaaaatgttcttggaaataccatctctcacgaattcttcggcctctgctgtcccaatgtcacttgtctgagatgtaaacagaggagttctgagaaagaagctgaacttgcatttctccctgtttctatttgttccaaacttgtggcatttctaacaggatgaagcggaagagaaagggaaagagacaaaagtgtagaaagatggaagatcccagctgcaaatggccatttgcagttagatggaacagctgctgacgttcagggaaatgcatgtctctcttcagatgggaaggagcagtggaaaggggtgacgagttcctggctggccaccaatcatcccatctttctgtgccggttcctcatctggaaagtgggagtgatacttgtgcttgcttttcctacccacaaagattattgtgagagctataatacggtgagatacagaatcctgcttttaaaaatacaaagcagaatcaagatgtcaataataaggatagtaattgtgttagttatctgcaatcatctattatagctagtcgtctaggatcctggatcgttctcctggttttactacagttttggatcagctcacccccaaatcccttgctgaagggtggagctctgtcagccatgggcagggaaccacttcctcttgcctttctactttctgtctttcaaacatgcccagggtctttgcacttgctgttccccctgcctggtacctctctcctgtggcttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcat

SEQ ID NO: 1588 - DNA, 1030 bp, Homo sapiens
ataaaggacaggggcttatggaaggaggtttaatttcctttgaagatggagccttaagtcccaggtgcattctgatcttgtttaagatcagatgcactctgaatgattctcttccaattatgggcaactttctcctccagaaacctttttatatcacctgggtagcaaggggatcatctagtgaccgttagacttcgcatagatgagcagacacaagcctagagagggacatgtgatcaccaatagtttctcagccagtaatagttgtacagccttggaacaagtcactttttgagccagcactatctgatagaaattaatgggaaccacaaatgagagccacatgtgtaatttaaaactttctactaaccacatttaagaagtaaagagaaacaggtaaaattcattttataatatatgaatttgacccagtatatccaaaatatcatttcaacctgtaatcaatgtaagtcttagaaatctggtgtgtattttatttacacttatggcacatctcacttcggagtagccatatctcaagcgctcggtagccatatgtggctagtgagtaaagtattggatggtgcagttgggagcgtcagtttccttttctgtgaaatgaggataaatcactggaagctcgtgagagcgcacacgaaacacccggcactccgccctggacactagggacgcgcaatcaagtttggtttcttctggtccctgctctcccctcccgcccctcctctaagtctccgccccctttccccgccccctcaggctccaggcggaagcaaccctgttccaaatgcagcgcgctttacggcggcgcgtccttttaccgcggtgtggccggctcgcttgtcgctcgcacttttgccctattggctctgcggctccgctcgccgcactttacggcagtgtggctggagccgcggctgacgggcccgcggtctgggcgtgagtgcagggaagtggagtatttgctgggccgggtaccatggacgtgggcgaacttctgagctaccaggta

SEQ ID NO: 1589 - DNA, 960 bp, Homo sapiens
cgaaagtgttctgggttgtttgtgtttaattatactaaggagatttgataggaaggagcacaataaatgtcatggtgattatttggtttattgtaatacaataaaggaaatacaataaaaggtttaacaaaccttttcataaagttgctttggttgttaaaaaattttagacctttcctgccatttttctttttttaagtacatcattctaacttcctaaaagtatagctcaaaaaggtgggggcccaggggagaggccagcagcgaaggcattattgggatcttatttgccccaagatcacgcagagatgatttattcagtttgtagattatataaacggaagagggaattaatagttcctgaatctaccatgagtcagatacaaactttctcatacaaccctcacggtaatcccacaaggttagaaattgggaacagaagagagagggcggggaactgagctcgggtttcaggctagcagcagacaagcaggaagcggaacgaagaatgatttctaagcgcagttccgcagcccactcacctcgtcggctggggccacctgctctgggagtttcgatttcccttcccgcgactgcacctccacagacatgggcaacgccttaccagagcaacacctgtgtttgttgggcgggaatgagccttgcactgggcagggctcagggcccatcgcgtgcagcgaagcgcgggtgatttaaacccaagcagcgggcgcctagaacccgaccggatgctccttgactttgcccccggtctccggactcctctgattggacgtggctgcgttcggccgcccaatggcgaggcagcgcgcggcttcccggaagtggcggcgcggtcagggctggccttggcttcagctgcggttttggggtcccggactctgggatcggcggcgctatgagttctttcgaggggcagatggccgagtatccaactat

SEQ ID NO: 1590 - DNA, 997 bp, Homo sapiens
tctttaagaccctggcaccataattaggataatagaatctctgggtttggaagtatctttgaggtcatctagttagaaggggtggcagctgttctctttaccatggagtttgagaatgacagtgctcaattctctcaatgggaggtgcaaaatatgtctggggctgtagtctctgcaggcaatcccataaaagataaggcaacgataaacaagtgtgaagcttgaaatacgtcctaggcggaaaagggcaatgggaagaaatatggcttactggagcccttatacaatgtaaaaacaaacaaatactaaaaacgccctggcagagatgtaatgtcaggcccttggattcagggtagaggcccacaaaagggatcctgattgacacaggttaaccctgtgtcaaagaagaaagagtctcttctgttgggttcaccagctctgaagtacctagccatcctcaagccgcttcttctttgccctgttatgagaaagctgggaaactctctccttttccaggaaagagggtgagggacggggattaaggggcgtgaacgagaaaaagcaggtagaggtactgaaatgtctgagtagtggtaaatgcaatcgtcctggaagcaggggaaggtatttcacgccctctcaaggtcccttcggttcaaggataccgtcattctccggctctactaaaggggagggcctgcaacgtccatgctgccatggaaacgcgccgccgtgttcctttttcttacgtggggcagggcactctgccgcagctacctatcatccacgggatttcttgagtggcgggcggcggcagcgaatggacgatccgatattgtgtgacgtgacgggaaagggggagttcgcggccggtggcggcggtggcgacagcggcgacctagggatcgatctggagggacttggggagcgtgcagagacctctagctcgagcgcgagggacctcccgccgggatgcctggtactgtttggagagaaa

SEQ ID NO: 1591 - DNA, 902 bp, Homo sapiens
caaacagaaagagaagatggcgttcttgcctggtatccgaccactaagcatgtactccattcacgcaaggatttggtggttcctaaaagtaaatactgtgtctctgatatgaataaaactacaatttcttctcagatattttacacctcagtgtgattgagtttagttgcttccctgagccagggtgaagaaagacgtgtgtgtgtgtgtgtgtgtgtgtgtgtgtgtgtgtgtgttgtggggtcagggtgaactaggtgcgtgtgtgtgtatgaatccgtgtgtgtggtgggtttcatgaactagaatctgtgtgtttgtgtgtgggtgtgttgggtcggggtgaacttgaatccgtgtgtgtgtgtgttgtggggtcagggtaaactggaatgcgtgtgtgtgtgtgttgtggggtcagggtgaactggaatgcctgtgtatgtcttttgtggggtcagggtgaactggaatgcctgtgtatgtcttttgtggggtcagggtgaacgggaatccgtgtgtgtgtgtgtttggtcagggtgaactggataactggaatccgtgtgtgtgtgtgtgtgttttgtggggtcagggtgaactggaatccgtgtgtccgtgtgtgtgtgtgtgtgtgtgtgtgtgtgtgcgtatgctgtggggttggggtgaactagaatccgtggaagtgctcagtctctcccgtgtttgactgactcccggccgcatacccagtccctgacacacgggggcgcacaacaaatatttcccgaaagatccaggagcagcatctccaccagcaagctgggctgctgggtgggtacttccttcaaagctgagggagcgtcctacgcccacgcgcgcaggagggcgccccccgcaaagcaacgtctaggagaccacag

SEQ ID NO: 1592 - DNA, 1013 bp, Homo sapiens
tacaacccagatgagagggaaaaataaaggattccaaatatcccccttgggaagtagagtcaggattcaaacaaagaactgtatggcttcaagttcatggtctttaatctcctggaggctgtctctctttcttttttcttttttttaatcagtgttgggatcaaattctggctcccctaggaagcatctggcaaggtttcgggagccatcgggttggccatgttatgctggaatatttataagcaccggagggttatccccatgtcgtagaaaatgaaactgaagctcagagagatttgcactctctgcccttttgtacaactcatttttccccagtatgtggaattgagggagcttcacgcttctagctgtcatgattccaagattctacgacatgtgggagaggatcctaaggttcggggaaccgcggaggtttcggggttctagaaatccgaggttctaagcctaggtgctccaataaacccagtgagagccagcccaggtttccggtctgtacccgctggtgcaagcccagagacaagcaggcgccacccatgagcccctctgcggccccctcccgggtcccacctcgcaggccagctggagggcgcgatcctggcgtcccccgacggcctggggccccaatccagaggcctgggtgggaggggaccaagggtgtagtaaggaagcgccttttgctggagggcaacggaccggggcggggagtcgggagaccagagtgggaggaaggcggggagtccaggttccgccccggagccgacttcctcctggtcggcggctgcagcggggtgagcggcggcagcggccggggatcctggagccatggggcgcgcgcgcgacgccatcctggatgcgctggagaacctgaccgccgaggagctcaagaagttcaagctgaagctgctgtcggtgccgctgcgcgagggctacgggcgcatcccgcggggcgcgctgctgtccatggacgccttggacctcaccgacaagctggt

SEQ ID NO: 1593 - DNA, 1041 bp, Homo sapiens
cagccacgtctgctcataaagtaattatttttatgtgcacaccctgcaatattactgtgctactcaaaagctaattatggggccaggcttgttggctcacgcctgtaatcctagcactttgggaggtcaaggggggtggatcacttgaggttaggagttcaaggccacctggccaacatggcgaaaccccacctctgctaaaaatacaaaaattagctgggcacagtggcgcacgcctgtaatcccagctactccagaggctgaggcaggagaatcgcttgaacccgggaagtgaatgttgcagtgagccaaagtcgcgccactgcactccagcctgggggacagagcaaaactctgtctcaaaaaaaaaaagcgaattatgggacttataagaaaatattaatttagcatgccccaaggaccaaagtgcgctgggaattcagccgtagctgtctttgagtgtggtcagccgcctgggcgccacagagacccacgaagaagtggggggtcctccgtgaatgcgaggtccaggctgtttttatctcttgagcctcagtttcctttcctgcacttggagcagttaaccctcagtgcctagcagccggttattaacatgttcacaacaccttccacccagggaaggggtgggaaagtctgttgggcttttgaaagagaaaaacaacttccacagtccttccggccccacatcctctgaacagggctgggcgcctcctctggggcgtaaccagcttggtcacgcccccgacagaccccgcccccagcccgccgccgaggccccgccccccgggccgccgcgcctcacgtccagcgggggcgctagagggcgggggactgggcggggcgggcccgggaggcctggaggcggggccgcgggccgggggcggactggggcgggcggaaggagagccaggccggaaggaggctgccggagggcgggaggcaggagcgggccaggagctgctgggctggagcggcggcgccgccatgtccgacagcgagaagctcaacctggactcgatc

SEQ ID NO: 1594 - DNA, 908 bp, Homo sapiens
actacattggggttgcactatggtggtggtgttggtgggagggtgtagaggcggggcttgtcctggaaagttggatatcagggtcaaggtaaggggagaggggcagggaggctctcagcactttgtgctctgggttcagaggggactggaggatagagtatggaagcagggagctctgatcctgggttctgcagggccaaagcaggaggcagaaggctggacttagtaagtggtgaggatggtgagagaaatattcagcagtcagactggaaaggacttgtctgcaagctgggtgtggagtatcagcatcaatcctaggtttttctgcctggttaggtggggaagcagatttgagagaaagaccttagtttggataaacggggtctgaactcgcctcggatttgccgggggtggagctcaggacgtcctggttggggagggcattcagagagtagatgccagtcctgggaaaggcaggggaggagaggagagccacggctgacgcttggggacagaaggaggagcctgaggaggagacaggacagagcgtctggagaggcaggaggacaccgagttccccgtgttggcctccaggtcctgtgcttgcggagccgtccggcggctgggatcgaggtgaacttaaaccccagcctgggtgttcactgggggcattgagggagtggtcagaggcggcgagggcagcggggagggcaaccccccattacttctctcccctttccccatgcagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcact

SEQ ID NO: 1595 - DNA, 782 bp, Homo sapiens
atgtctggaccctgacaaccttaacatataatggtttgatagtggaggtggaggcaatgtagaaagaatgccagaggcaggaaaaagcaagaaggatgtgttatcatcatgaccaaggaagaaacgtgtttcaagaacaaaggcgtcaactctgccccatgcttccgagctgtcaagtaaagtgagaaaaacagaaaagcgttccctgggtttagcaacacggaggtcagttgctaaagggagcttctagaatgacgacgtcgccaaatctgtcctctgcctggattctcggcgatgaaactactacagagacctccaagtttgggcttctgcaaacacagcacgtccttctgatcgttctctaagatatgtaaacagaacgccagttcccagcgtggcaacacgggactgggctgcagctcacccagccggcggcccccgccggaagccggcggaaataccccagcgcgtgggcggagcagcggcccgcagagggaggcggtggcgcccacggaacagccgcgtctaattggctgagcgcggagccgcccggtgattggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagagtgagtggccgtgaggt

SEQ ID NO: 1596 - DNA, 800 bp, Homo sapiens
tggtaacacttgcatgatacctgaggaggtcagcctggtcattcacccaacaaacatgggttaagccctcccatgtgcctggcacaaagggggctgaggactgcagttctggaacacctaggctctgagaggcgacgcgactgtggtagcagggccaggattctagcctgtgcctggagggccaacacctgcaccttctctgctacccaccctgcctctgtgactcagagcagttaagcactttagctcagggtggactcagggctgcctcccccttcctgagcaacctaggggctcctgtgccccatgcctgtgtccatttcccaatcatcagggggcctcagactcctgcctgctctgactttctaggcctttgaatcaagcaagaccccactggatcaccaaagagttaagcaaaggaaatccctgcctccctttatctccgcagaacccagaggctgaaagggagggagcagggaggaggggaagtgggaagcggctctgccctctccctccgccctccctccgccctctctccctccatcccctcctctctccctcctctgctgggcctgggggtctgggccagcaacaagttagtattgcagacatgggccaaggagccagaggccatgcagtggctcagggtccgtgagtcgcctggggaggccacaggacacagggtgagtgaccagaggctcctcaagcttgggggctggggtcagagcctggaattcctctcctccctccttgcttcctggaagcatctcgggccctgctctctccctctgactgggaca

SEQ ID NO: 1597 - DNA, 1091 bp, Homo sapiens
tcagagaaagtgaaacctggtccccaactgtcaaggcggcaactccccctccccggcttcccctctgagctcacagcttccccatctcctccttcccccatcccgccccctcgacagctaatacttggaatcagaccttcatctttgctttttccttcagaggtcttttccttttatgtccatgctggcagcaaccctgtgaggtgggctgggaaaggcttttctcctcctcattttatagttgtgggtctctgaggcccagagaggttaagtgacttgcctcaggtcacacagcacctcagcaggcttgaaccctggcctcctgtttctcttgctccaagtgtccagttctccccagtggagcctgcctacaaagacaaggcctggctttggggagtgggcctggcagagggtgcacgatgggggaaaggagaccgtcgggagccgggctgggggatgctggtcctggggcctgaaccacaatctcggggctgccagcctgcgtctggctctgtgcccagagcccggtggtttccgctcacagatgtcccaacagccccggcgagagggcaggaagggcactcaagaaggaagatgtctcgctcccctcagcccccaaccaccgtgtcctgtgaggccaatggctcctgggccaagactggcctggggcctccagaggcccagctcgaagtccctcctgcccatccctggcccagttccctgaagatggcatggacccttttcctccccactcaccctaggaaggctgaggctgcggttttacatcatccttgggcgtagggctgacctcgaagaacgaattcgaagaaaacaggaggaggagcgggcatacaccgcgccctgcgcccattggccgcccgtggaaattttggtttttggggtcatgttcccagaaggcctgccctcccccctccccatccccacccacctcatgaggtgttggccaatcgccccagcgggcataaagtggctgccagcctgcagggctcccagccgagaggtgtcacccccagcgggcgcgggccggagcacgggcacccagcatgggggtactgctcacacagaggacg

SEQ ID NO: 1598 - DNA, 1016 bp, Homo sapiens
tccccattcctgtttcttcactaaacggaccttcctctcactagtcaccatggtaccacctggccattggcagagctctcggacacatttcttgggtgggaggctcccgcaaccctaacccgctataggtccggcgctcatctcttagaaactgacctgaccccccatgaagcagcactcccttctcgcgtcactggataagcattcttggcgccaactcgaaccccagagtaatccctgtacgcctccacccatccccgggaccagcccctctgggcctccccgaggcccaaaccccagtttcctgaagacccagtcatatccagcccagataatgagaaggtggcactgcagctgctcaccacggcggcggtggtgaggacgcaggcagtggtgtaggcgcggctgaccggtgggatctgcaggtactccagccgcaagctctggtacgccatcttccccaccgtcgcctgccccaccccccacccaccccatttccccttccgccagcaggccccggcggcggggcgggcccaaaggccccccgcccactttagttttcccgcgactgcccaatcaacgccaagcaaccgcaatccgtagagacctaaggaacgcacatccgccaatcacgagttgcgtcgccaccgcccccccccagcgccccatctccccaccctctcttctccaccagccaacgtccgggaaaaacgagtaagtacaggttccttctgccaatccccgccggccacagctaactttcccgcccggcccctttctgtcataattgaggtgtccacaaccagccaatcaggaacgcgagagtatcccgcgtttgctttcgctcgccgaggcgcgtatcagtcggaattttggggagccaaccgcgccgtctgtccctggcaagccagcggcggtttaaaggaggtggcgggaagcctgtgtgtgcttcaaatcgtcaccctcatggtcgctccggtaagtgctgcggggcagcattttctctgaggaggagc

SEQ ID NO: 1599 - DNA, 956 bp, Homo sapiens
tcctcatttccaaacattggactgagagtagagagctgtgcaaaataaccacaagtccccaactatgccctcttaattatccctatcatctaagactgttgttcccatccatcactgaacttccccgtcctcttccttcaacccctgtgttagtcaatggttgaaattttgatttggtaaaaaacctctggcgaaaaccagcaaaaagggctcacaaatcaggtctcagggaagcacagaggtagccacgagaaggcccgaggtgctcatggaaagagctcgagcccaggagctctgggaggaccccaggcgctcggagccgccgttacgtaaccggcactcagagcctccgaagaccggaaggccccgctcaggccccggctcaggccccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgc

SEQ ID NO: 1600 - DNA, 937 bp, Homo sapiens
cgaattcccattaggacctctcttcgggcactgactgatgaacttctaccgcctcatcttctctgctagacttagagttcctgagagcagaataaatgcggcttgatcagtatttgccgattcaacgcagaggtgcccaggtcatctcggcgagttgagctgtctaagaccccgcgatcgcgcaggacaggacccagaagccagagcgcaggaactgcttccggccggctcccggcttccgtcgggccccgcgcccgcgctgcatgctgggatcttcaggtcggaggccggggtgaggccgacccacaggccgccttgctccctcgcgaagacgcttatgccagtctcgcccgtccccgctcctcctcagagaaaatgctgccccgcagcacttaccggagcgaccatgagggtgacgatttgaagcacacacaggcttcccgccacctcctttaaaccgccgctggcttgccagggacagacggcgcggttggctccccaaaattccgactgatacgcgcctcggcgagcgaaagcaaacgcgggatactctcgcgttcctgattggctggttgtggacacctcaattatgacagaaaggggccgggcgggaaagttagctgtggccggcggggattggcagaaggaacctgtacttactcgtttttcccggacgttggctggtggagaagagagggtggggagatggggcgctgggggggggcggtggcgacgcaactcgtgattggcggatgtgcgttccttaggtctctacggattgcggttgcttggcgttgattgggcagtcgcgggaaaactaaagtgggcggggggcctttgggcccgccccgccgccggggcctgctggcggaaggggaaatggggtgggtggggggtggggcaggcgacggtggggaagatggcgtaccagagcttg

SEQ ID NO: 1601 - DNA, 906 bp, Homo sapiens
ctcaagtagcgactgcaacttccatagtcaaattttcattccaagctataaatggagatgactgtccacttttcaggacaaaaagcttcttgcaaaagtagaagagcaaaagcaaaatcctccactagaaagcgcccccatctctaatctgtaacagtgagagcctcaggacgagttccgcagacgctcatttaaagcaaactttttcaatgaccttgagggtggctgtacttacacgcggagaagcaaatcgaccgcagctggaaaggcgctgggtcgagcgtgagaggaacacgggttttacctaagggagagtggaagagagaagggggttccccaagggccccggccccttcgcctcgttcgggccccgcggccaagctcctcgcaccgcagccccggctgtgcagaagcggaggggcggaaggtgctctcagaactttcattttccaccctgcagcagtcccgagcctcggctggagaactcggatgcttgcgaaacggcgaggtccagcaggggcgggacgggggcggtgggcggaggaggatagggcggggccgcggcggtgaaagggcccgggggcgggggcgggggcggggcgaggcgaggccgccgcggtccgggcccccgacgtgggctccgtgctctgcacccagctccttcccgggcgcgcacacgcgcttcctctcttgagctcccgggcgtccggaggcgaaggtcccggagcgttcacgagaatccgggtcccggcgagtccggggtccgctcctccagctgcgcccagggcgcacgagccggccagcctcggggagagggcgcgggggcgctgggggttcttacgggaagatgaggaagcccgacagcaagatcgtgctcctgggggacatgaacgtggggaagacgtc

SEQ ID NO: 1602 - DNA, 1011 bp, Homo sapiens
aggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggtgagcccccctgctcctgcaggggagaggaggaggctagcagggcgggcagggccgggggcgtgcggttgaaacgggggtcccgggggcctggggagttaaacgttggcccagcaccgggaaaaacaggactcctgattcccttgctcaggaattgggagtgcgggtcgcttctaagggcgctttctgctctgtaatcccagcgctttgggaggccgagacgggaggatcgcttgaggccaggagttcaagactagcctgggcaacatagcgagacgcgcccccccgccccgaccccgcgccattacaaaaaaaaagcaaacaaaaatttttttaaagatcatcgatgaagagagaaaatgcgcttttctacagagtccccttcccacccacagccccatccccagataagcggggagttccctggcgcggtgccagtttctagccgctgagtgggcgtgtgcgcggctccaagtgcgcctgcgtactgctcactccccagctccgcgccctgctccgttcctcccaaaactctgaatcgaagaactttccggaagtttctgagagcccagaccggcgggcacgcccccatccccaaccccctctgttaatccctaccagcctgcagtcctggctgcttccaagcaggaggtggggcctctggcctagcggggccgaaaggcagtcccctcccccgcagtctgatttccctcttccccccaaaggcaagcacgaggagcggcaggacgagcatggctacatctc

SEQ ID NO: 1603 - DNA, 978 bp, Homo sapiens
atggaagaagggtaagggatcaggcaggatgaggtgggaagggtgtatgggcctagggctgggtgaggtgagaggatcaaggcgagagcgagtggacgggcaatgggcatcaaaacgggttgggtgctggcagggcaaggcagtgatggggttaggggttccctggtttgtggcgttaggaatgacttgggtaacagggatgaaggggagaaggtgagatagagagggacgacgtgtaaggggcccaggacccgaaatgaagtggaagaatatgggcccggggctgggggtgggcggggtcgggtgtgtcagaggtcctgagcctacttatgcatgatcaaatgcccaccgtgccaatgcagtcagtcaggctgggcggcggagccttgggtttcgctttcccgaagagtcggttcatcttgagcagccgcgaagaaacccaaacactagagcaaaaccagaaacggaagcagagtcactcccgcctcgacttccggcccctccgtgcgcaagcgcaatatgcctcctggcgtttcccgattctttttccggattttcagccgggtcttccggggatggagagcaaaaggacttggtgctctcggagagagcctgcagggggcggggtgttggtagaaggagtgggaggggttttactgtagcaaggcggggcctcagttgagtgggtggggcctggaggcaactaacgcggcatagggcgagggcggggccggcaggccggggcggggctgggaagtagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctgggcgtccacctgcccggagtact

SEQ ID NO: 1604 - DNA, 971 bp, Homo sapiens
cctgaagacccagtcatatccagcccagataatgagaaggtggcactgcagctgctcaccacggcggcggtggtgaggacgcaggcagtggtgtaggcgcggctgaccggtgggatctgcaggtactccagccgcaagctctggtacgccatcttccccaccgtcgcctgccccaccccccacccaccccatttccccttccgccagcaggccccggcggcggggcgggcccaaaggccccccgcccactttagttttcccgcgactgcccaatcaacgccaagcaaccgcaatccgtagagacctaaggaacgcacatccgccaatcacgagttgcgtcgccaccgcccccccccagcgccccatctccccaccctctcttctccaccagccaacgtccgggaaaaacgagtaagtacaggttccttctgccaatccccgccggccacagctaactttcccgcccggcccctttctgtcataattgaggtgtccacaaccagccaatcaggaacgcgagagtatcccgcgtttgctttcgctcgccgaggcgcgtatcagtcggaattttggggagccaaccgcgccgtctgtccctggcaagccagcggcggtttaaaggaggtggcgggaagcctgtgtgtgcttcaaatcgtcaccctcatggtcgctccggtaagtgctgcggggcagcattttctctgaggaggagcggggacgggcgagactggcataagcgtcttcgcgagggagcaaggcggcctgtgggtcggcctcaccccggcctccgacctgaagatcccagcatgcagcgcgggcgcggggcccgacggaagccgggagccggccggaagcagttcctgcgctctggcttctgggtcctgtcctgcgcgatcgcggggtcttagacagctcaactcgccgagatgacctgggcacctctgcgttgaatcggcaaatactgatcaagc

SEQ ID NO: 1605 - DNA, 1044 bp, Homo sapiens
tcccaccctcttaaaagctaagggcctggcaattagaattggctgcaactgatgctgcttaactctgttctctcctcctctccaccggggaaagggaaacccccgaacctctatcacccgtgcagctccactgtcctatctcccattccactccccttcctcccaaactttcttcctcccagtctctcactttctccattacctcctcccaccgacactctctccattccccaagcctccgttctctccttttccacccaaattctcccctaggcccttccccctcccacctccaatttaacactttcgaagccccccagaaacgtcttaactccaattctgacctttacccacctcctcgcaacacccctcatcagagtccagtcctccctccaaccacatgccacagcccccttccccttcacaccctcagcctctccctcctgctcctacccccttcaatacgagcggatcgcagccccactccccacctcggcctctctaatacccctggctgggcccagtctcagcccttgtttacgcccctccccatgccctcactcctccgtctcgacccctgccctctcccgcagttgccatctcccctgcacgcccccctcggcagctcccctcccccacctctcagcgtcccgtcacctccctctcttgaggttctcaggctggacgtcgccaccgcctccccctccactttccttccccaagccctttgcggccccgcccggccccgccccgtcccgctcgactccctctccccactccggccgcccctccgcctcactctcggctcaggctcggcgccgccatgttggatccatccgcgccgctctcccgggcctgcctcacggcgccgcatccgggctccagcagccgccgccgccgccgccgccgcggccgtgggggaggggacaggcgggcgggggtggctgcatcctgaacggcgcctcccggaacccggccggttagtggcggcttcgaggccatagtgagacatgagccggagtagccatagtaagtgagggcagc

SEQ ID NO: 1606 - DNA, 1092 bp, Homo sapiens
ccatccaagactcctaagagcaaagccagttcttttccttttttttctttctttaagagacggtctcactctgtcacccaggttgaagtgcagtggtgggatcatagttcactgcagcctcgaactcctgggctcaagcaatcctcccgcttcagcctcccaaaatgctgtaggtcacaggtatgactcacccacccggcctaatttttattattatttgtagagatgggatgtcactgtgttgcccacgctcgaactgctgggctcaagcaatcctccctcctcagcctcactggcagctgggattacgagtcccacccaacctgcttctccttttgcaacccccagacccagaggctccagagcaggctctggaacagaggaaatctggctccggcccacacattcaccaaatactgacgcagcacccttgacctccagatgcccctgtgctctcttctgtgcccaggctgcggggagagaggggtcctccaggccaaagggagggaggtctccgggaggtccccgcggtcctggaggcaggtgcgcggggcccggatgtgatcatgcgtgcgcgtgggagaaaggcagggctgggcctgcgggagcgcggccttgcggttcccaggactcttctccgggcgcctcgtctccttacgccacccgcaacccaagccagggccccggtgacagcggcggggtgggccaggaccggggagggggtgcccagcagcgacccccggctccccctaaggccgggcgcagctcggagccaggagctggcccggcgcgtggcttcccggaaggcccggcgcagccggaaggtgggacggagggcggggccagcgccggggccgccaccaaggcctgcgcgaccctccgcggggctggggagctgggcggggagcccggggcctgccaggcccgggctgcagccgcgtctgatcgccgagcgcgccgcgtagacctccgctcccccaggtaaaggagcgcccggagccggggcggggcgcctcccaggccgcgccccgcgagaggagggggcaccccaagagcaggcctggagacccgggagtgccttggggagagggt

SEQ ID NO: 1607 - DNA, 974 bp, Homo sapiens
tgcttaaggcgagttcctaacaggccctcggggcactcctgcatctccgcacccggcagcctcgccccttgggtgtttttggtgggcgtgactagaagcacctgctcctgggctccttttgcatcttgctgcagtcccctcctgtgaagggcgcagctctgcagtctcctcgctcttccctcgggtgttctttctgagatccggtttcaatcctcgagcgtgtagccctcaggtccccttacaactccccagagctccgtgtgcatgcgtgcgagagggagagagccagggagagacccaggtgacgagacgaggctcccgggctccagttactggcccgcagggccggggcacgtcgtcgcccagcgtgcggcggggcccgggagcgccgcggcccctttaagagccgggcccaggccgtcgccgggaccgcaggagcccagagcgcgggcgccgcagaggagttgggagccggcgcaaaagtttcctcccaactctggccccgtgcgccgccgccgccgccgcccactccagcccccggcttggggccggccctgccaacgccgccagggccagggccagggccaggaccagcgacagggcagggccggcagtttcgctttggtgggcgcggagcagccgcctgggccgggcaggagtaggagcgggaggaggaggaggaggagccggtgccgcggagctgccgcgtcccgggccgccgggcacctgggaggtaacccctttccgcggccgcccctccccgattcccgccacctgccgcctggccaggtggaaggggcgctgccgcgagcctccgggcctcagggtgttccggggagcggcgccccgggtctctgggcccacccgccccgggcgtcctccgagagtgggggctgcgcccgcggggtcagacacctgttcggcccggcccggcgtggtcgccgggggccaggatgaaagtgaccgtgtgcttc

SEQ ID NO: 1608 - DNA, 1094 bp, Homo sapiens
tacccagtacaacagcttccagccagcctggacaggcagatcccggggctggagtggtctggcccaaggctgagaagggctgggacccccgacagtgacatgatgggctcagcccctgttccatctactgggcagggtgggcctccgcagatagcggcttcagactccagctccagggggctggtgggagtctctcaaggtgtcccacacatggtccctcggggaaagagtggagctgacccctgtcccccctcccgactcgagggccttagggccagcaggtgtgtgagggctccaggcgcgcggagccctcgaagggacaccagcccagcagcagcaggccgcgcgggggcagccgaagaccccatccggcgcaggccagggccgagctggcagcggcgggtccaagcctcgtcagctggcgcaggaggcccacgggcgagcgcgggacggagctgggcgccggggtccggaccgggccggggtcgagttgggcctggccggacaccggacccgccaggagccggcccctgccgcgctgggctgaggcccccgcctgcagacaaaggagccggcggggggcgggagccgggggggtgggggagtgttgcaggggggatggggcgagggggcgggcgtcgcggtgtcacgttaccgcccgcagcgccctttaactcccgcccccgccccgctcaccgcccccttcccctgctacagcgcgctcgccccgcggccgccaatcagccgcgcgccccggccgcgcgccccgccccgcccccggtgggtgtgcgcgcggccaatgggcggtgcgcgggggccgggccgcggcggggcggggcagcggggcggccgccaatcgccgtggtgttgttgaaactgaaaatactacattatgctaatcgcggccgggcccgcgcgcacgggggtggggcccgcgcgtataaagggggcgcaggcgggctgggcgttccacaggccaagtgcgctgtgctcgaggggtgccggccaggcctgagcgagcgagctagccagcaggcatcgagggggcgcggctgccgtccggacgagacaggcgaacccgacgcagaagagtc

SEQ ID NO: 1609 - DNA, 949 bp, Homo sapiens
actatgacttgtttggccttggacactttagttaagctctctttcatctgcagcattctagcctctacaagatgcatttgtatacgtggtcttacttttcaaaaactcttattatggaaatttcaaaacacacaggcagagagactaagttaacataactcccatgtattaatattaacattaacaatcatcaacacatagccaatttcatctttaccacatcttccatactccattcctgttgtaatctgcttttgggagagtaaaccagggaagaggcccttgccagccctagaagtgcgacaagcatattgctttctttagtgactaacaaacacaagccaaggagcatgatacatccagatagtggaatactctgaaattgtaaaaaaaaaaaaaaaaaaaaaacctttctatataatgatgaaaaacctctgtaagatctacagtgaaatggaaaatgcagaggtgcagagaaatgcgtattacaggttatcttaaagtggggagaaaatgggaggaaggaggtggcaaagtgagacatattgaacagataaataaaaaacaatagtgattacttatggggatgaaaccagacccatggagagcaaggaaagggtgacacttgatgctatatatctttttatccgttttaggttttaaaccatgtgaatatatacccttctcaagaaatgatttttttggagtagaatttgttaacatttttaagtgatttttttaaattatatgattctgaatgatgaaaacaataaaccacttctgtttccctttccctcaacttttaaattgtaatataaagaccattacgtgacaaagaagaaattggttacagagcataaagacacagaggattttagacaagacttccactcagagatgtctggattttgtaaagctgctttgaacacttctgcagggaactcaaatc

SEQ ID NO: 1610 - DNA, 1052 bp, Homo sapiens
ggaaagaaagttgagaaaggggaatatgtgcaagattgaaaaaatatctcatggactgagtctcagacctgagattttggggaatggggtatggtaagtggatactgaaaaatgctcttcagttatcatgagggaagaaggaaatatgtgtcttttccctctttcaaaggagcctttgattttataggcgaagaagcatagtggaagttattagtgaaactaagcccacattaaaaaaaatctcttaaaatatgcatcaagagaactaaaataccaccatggatttccactggggcatgaggagcaatctggtctaatgactaacataagatctaaacatctcttaggtcccattctttgaggcaagaacacaagtttttctgttgatattaatcttcagtgtgtattttaaagttttatgatgtgttcgtaactaccattgaatagtggtttagttagtgttggtcggtgacctgcttttgtttacctatttctgatgaacagtgtattgcacaagccacagccatgtccttgtacacactgcgtgcaagactctgctgtgtgcagtcagccctgcatcgtttctaaccagttatactggccttactttcatcatctttgaggccagagctacacatgttgatgccgaagagtggaaggaaggagagcagagagtaaagggggtagattatgtagattatacagacatgagcgagggagggtcacagatactgaacaaccagtgagttcccctatgtggattgccagaacatgaaatatctgagaagaaaacaaaattgtcttacaaggtagtagacgtctgggtaagctgtgatgcttgcaggatcggtacttacagaaaggaggtgcagagaccacaggaacactcatgaaaaggagaagcaggaaatcagggttggttgtttgaatcttccttctcgctggctttctaatgtcagactccagaaaggaggagtggaagggaaatggcaggcagatgcagtcctgagctggtgcccccttgccttcgcagtcgtgcctagtaaacagct

SEQ ID NO: 1611 - DNA, 1039 bp, Homo sapiens
cttcagagactttctgtggggaagggaaggtgggggactctgttgttaaaatagaaacagctgtttttctcataacacactcacttgaagaaatcaaaacaatgcataaaagcatgagagatttaaaaaagtaatacaaaatcccacccagaaggtaactatttctaacatgcaggtaaacattcttccaggctgttttcagggataaaaagcatcattagctcgcctgaaaagtccccggttaattctatttttttcactgctacatgccctggtgcctagaacagtgcctggtacatggtagatgctccgtaatatttggtgaatgaattaccatctatgatacccggtttccttttctgttaaaggagctaaggcctattccacaggacaactgagttaaataaaagaatgtatgcaaatacatagttccttgcttggcatatggggatatgctcaataaaataaatttttaatatctgttagcagccaaggtttttataacgttactggattagtccatccctgcctcgggctgttaaacattaatacagcccaaagccggggcctgcaagatgctgtccggaaccaccatttcaccaaagggcgcggccagggcatgaaagggccactaggctggggccccgaaggaggtggaagacctcacaaggggcatcaagggcaggagtggggaaggcgaagcgggcttgcagttcctccagcaggttaccagttagcctggcttctcgtgcaggtcaccgccgccggctcgttcctcaggtttccgcgatacaaaaaggacgagatggtctcgaagtcttagctccgtcacctaatctgagaataacgggcccaggagacttacgatcactgatgtccccacagtcgcctcagttcccgccacggaacggcgggcgaaaagcagggcgggaatacgccggtaggaatacgcgggcacgtaacgcgtcacttccggtgctggggcgcgctgcttgcggagggagtttgcccgtatacggttttatttaggcaggtgatg

SEQ ID NO: 1612 - DNA, 952 bp, Homo sapiens
agcaaaaccacttgttcatccatcctgagtctaggagatttggaagatctaaagaagtagcaggcaattattgtcacccttttacaggtatgaggcacagacagacccagtcatttgctgacatccctccactgaactgggtgctcgtccttttcactcacccagaggctgagcgagtgcctctcacccaccaagctctgttgaacttgtgcctttgccggtctgtggtcctgcggccgtctcatgagctgcagagtaggtctgtgtgtgtctctcctcaagctactcaagctgaggctttgtgtgcatgcctgccacataccagccattccgtgagtgttagtggaacaggtgagtcaatgagtcagggagtaaaatttgtgctttaaaagtagaacatgtcggagagaacctgtactgccttccagccatcttgctgtgagaggacagggcatggactctggagtttgaaggctgggtcaggtcatgctctggattctttactcactcgcatggcatgtccttagtttcacttccctcactctcagtggagccgttgcagcgggcagtgtcagaggcaacatccatttagcactgccgatttgacccccagccccatctcatactggcctcccaccctgcttctgtggggtgcctcagaggagagcaaggtgaaccccagtatggaaccgagacacggttttgacaacactgttgatcccatttggaaaatccagctatgtgattaaccattagtctctctgcctctgctctgatgtaagtggagaccacatccttcctgccccttctggggctgcgactgctataaattcattgcatttcctctctagctgttcctgaggctggcatctgggtaagtccagctccgcggggcagtgtgggcgacaggaccgggagagcagtgggggagattgtgttcagagggcagaac

SEQ ID NO: 1613 - DNA, 1023 bp, Homo sapiens
agaagtgactccagaacaccctgttccaaagcagaggacacactgattttttttttaataggctgcaggacttactgttggtgggacgccctgctttgcgaagggaaaggaggagtttgccctgagcacaggcccccaccctccactgggctttccccagctcccttgtcttcttatcacggtagtggcccagtccctggcccctgactccagaaggtggccctcctggaaacccaggtcgtgcagtcaacgatgtactcgccgggacagcgatgtctgctgcactccatccctcccctgttcatttgtccttcatgcccgtctggagtagatgctttttgcagaggtggcaccctgtaaagctctcctgtctgactttttttttttttttagactgagttttgctcttgttgcctaggctggagtgcaatggcacaatctcagctcactgcaccctctgcctcccgggttcaagcgattctcctgcctcagcctcccgagtagttgggattacaggcatgcaccaccacgcccagctaatttttgtatttttagtagagacaaggtttcaccgtgatggccaggctggtcttgaactccaggactcaagtgatgctcctgcctaggcctctcaaagtgttgggattacaggcgtgagccactgcacccggcctgcacgcgttctttgaaagcagtcgagggggcgctaggtgtgggcagggacgagctggcgcggcgtcgctgggtgcaccgcgaccacgggcagagccacgcggcgggaggactacaactcccggcacaccccgcgccgccccgcctctactcccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggccc

SEQ ID NO: 1614 - DNA, 1099 bp, Homo sapiens
aagagagccttaggcaatccactccaagagcttgaggtgcagccagttccgtctgtcctccagtcttccccaccccatccaactagctctacgaggcagagctttctcgtcctcatatcatatatgaaaagaatggccgggcgcggtggctcacgcctgtaatcccaacactttgggaggccgaggcgggaggatcacgaggtcaggggtttgagaccagcatggccaacatggtgaaacccgtctccactaaaaatacaaaaattagccggccgtggtgccacgcgccggtagtcccagctactcgggaggctgaggcaggagaatctcttgaacccgggaggcggaggttgcagtgagcttagactgcgccattgcataccagcctgggcgacagagcaagactccgtctcaaaagaagaaaaaagaaagaaaataatgaggctcagaatcgatggatcgcacagtcccacaacttcgcagccaagaccagactcgggttcacccccttcccaagtgtggttctgtaaccccgttttgctgccgccgatgcggatgcagagggcagagatggcccatccttagcagagaccaacctccaccctaggcagcagagcacgcagctgggggcttttctttctagatctcaaaagcctgctgtgatgggggatctggttctgccctttccctctctgcctctcctggcccgcctacccgggaactccccgcctggagcctctgggaggggagcggtgcaggccgcccgcgtcatctgatgctgtttcctgcaggagggagaagagcggaaaaaagtgaaactccaccctccacctctgcctcccgcccccggggccaaagtacaaagggaggaggaagaagggagcggggtcggagccgtcggggccaaaggagacggggccaggaacaggcagtctcggcccaactgcggacgctccctccaccccctgcgcaaaaagacccaaccggagttgaggcgctgcccctgaaggccccaccttacacttggcgggggccggagccaggctcccaggactgctccagaaccgagggaagctcgggtccctccaagctagccatg

SEQ ID NO: 1615 - DNA, 1053 bp, Homo sapiens
cttctggaattttagcagctggacaatcagtaaatacttttctacttacacaagattcatgtaaccagatctgtttggagactgatcgtgatttatattagactaaaagatcttaactcaaaagcatgttttgcatcatttgtctagattctttaaagtaaaaatggaaagctgtaattctcaaatgtcttcgaatgaacaaaaaattgacaagaatatgaagctgactgcattactgtatcatcaattattggaaccttgatttaacaagctattttcattttcagtccaatggcatacaaagaggaaattttattctttgtagtttctccaaattctttgtaaaaattatgaaagtaatttgcgaaaaataagcgaattgacatggaatataaggtgaataatacatttttaaaatgtagttgtgtataatggaaaacgtcattcttgtatattcagctaaaacagaccattagtgcaagacctaaatattaatgagatccggggtttgcaacgaaatgtcattgctgcttttcccccagaaagttaaaagaaaaacggggagagcttttaagtgaaaactaaatgtgctggcgtcacacttggaaatgcaaggatgcagaagaaatggtaagatgtgggtgggtagtatcccagtaaacaacataaaccttctaacagacttgaggtggctgtcaagcctttcagacatgtgattgataatgaatgtcagaggagagtttccttttccatcaacgcttcaggagacagcggaccgccaccaacacagggcggaagagcacccctgtcacgcagactgtgccgcccccggctcgcctgggcacgccccttcctgccctagcagcggcgtcccgccctttccgcctttcacttcctagtaaccgccctcccttgctccatcttcgcaggacccgattggctgatggggcaaccgccaacggctgtggcgtttaaacccaagccgcagccgctgctgctcgccgagctcccggagctgggtgggggtgccccacgctgaaagagaggtaagtt

SEQ ID NO: 1616 - DNA, 903 bp, Homo sapiens
gaggagtatcatatttggaaggcagtaaggaagtctgtgtagtcgatggtaaaggcaattgggaagtttgttaggcacaataggtcaaaatttgtttttgaagtcctgttacttcacgtttctttgtttcactttcttaaaacaggaaactcttttctatgatcattcttccagggcctggctcttcatctgcaacccagtaatatccctaatgtcaaaaagctactggtttaattcgtgccattttcaaagaggactactgaattctgatgtggcttcaaacatttaggttaggcatatctaatggagaacttgcagccacactgacttgtagtgaaatatctattttgagcctgcccagtgttgcttaaattgtagttttccttgccagctattcatacaagagatgtgagaagcaccataaaaggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgtgagttccacacagagagcgtgaagcatgaacctagagt

SEQ ID NO: 1617 - DNA, 1076 bp, Homo sapiens
cattctgaaattctttcggttcgtgaaagcagtaacctaggaaacgagactggcaccacccctttcagtcctaaagcttggtttctcccgcttttctccattatgtttagggcatcgctattttacagtctttttgttttttctttccacatcattagcacaaaagagaaattccccttctacagaagcaagtacaaaacctttctagtcgctcctttttggcagcagctcacctactatttttttctattccgcggtcgcagccccagacgtcctcaaagacaaatattttcgcgagggccagtgtagggcaggaactccctaggccttgaatcaagggaatccagtagataacaacagaaaggactccgacccaggtacctgagacatctgagaccgccaaaattaacacaacaccctacgcgacagagaaaactctgggcggggagagagaaagagagcgagcgagcgagagagagagagagcgagagagagagagagagagagagagagagagagagagagagagagaaagagagcgagcgagagagagcgagagagcgagagagcgagagagcgagagagcgagagagagagagagagagagagagagagagagagagagagagagagagagagagagacgagaggaagcaacgttctcgcgacaagaggggtgtcgacggaaactcggaaatggtcccctagacgacccggccccagctagtgggtggggccagggtacatccgcccctttccggtttttttccccgcctcccaaccgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttgg

SEQ ID NO: 1618 - DNA, 1085 bp, Homo sapiens
tacactaacatcccacgctctgaacgcgcgcccattaatacccttctttcctccactctccctgggactcttgatcaaagcgcggccctttccccagccttagcgaggcgccctgcagcctggtacgcgcgtggcgtggcggtgggcgcgcagtgcgttctcggtgtggagggcagctgttccgcctgcgatgatttatactcacaggacaaggatgcggtttgtcaaacagtactgctacggaggagcagcagagaaagggagagggtttgagagggagcaaaagaaaatggtaggcgcgcgtagttaattcatgcggctctcttactctgtttacatcctagagctagagtgctcggctgcccggctgagtctcctccccaccttccccaccctccccaccctccccataagcgcccctcccgggttcccaaagcagagggcgtgggggaaaagaaaaaagatcctctctcgctaatctccgcccaccggccctttataatgcgagggtctggacggctgaggacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccaggtaagc

SEQ ID NO: 1619 - DNA, 1479 bp, Homo sapiens
atccccaactgccacgttctgggcctttggggaattcagagcaaaccagcggcatttgttgggggtctccggccttcaacatcacagacaggcctgggggtggccttcccaaagtcagattgcagatctgaggcagtttccccctccctgcgtccctcactgaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatgtaggtggtgcgggggagcgggagtggggcgggggggactgcccagggagtgactttccgaggaaggcatttcggagaagacgggggtagaaaaggctggtgggagattcagagtccactggtgctttcgatttgacttaagtgaagtatcttggaacctagacccagaccttcgtaagacccacaaagaaaccagttctggtacctggagggggaatggaatttttagggtaaatggcatgcatattaattatttttttttcctgaagctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttc

What is claimed is:

1. A method for determining activation of an estrogen response in a cell comprising:
   a) providing at least one cell comprising an expression construct comprising a sequence comprising an estrogen response biomarker promoter operatively linked with a heterologous sequence encoding a reporter, wherein the estrogen response biomarker promoter is selected from:
      (1) SEQ ID NO. 19, SEQ ID NO. 20, SEQ ID NO. 23, SEQ ID NO. 25, SEQ ID NO. 28, SEQ ID NO. 29, SEQ ID NO. 533, SEQ ID NO. 565, SEQ ID NO. 634, SEQ ID NO. 641 or SEQ ID NO. 653;
      (2) a sequence of at least 50 nucleotides having at least 95% sequence identity to a sequence of (1); and
      (3) a fragment of at least 50 nucleotides of a sequence of (1);
   b) contacting the cell with a sample comprising a test compound;
   c) after step (b), measuring expression of the reporter; and
   d) correlating the measurement of expression of the reporter with the estrogen response, wherein increased expression of the reporter compared to a control, results from activation of the estrogen response in the cell.

2. The method of claim 1 further comprising:
   i) measuring the activity of the reporter in an absence of the test compound or with a control compound;
   ii) measuring activity of the reporter in a presence of the test compound;
   iii) measuring a difference or ratio of reporter activity between a cell exposed to the test compound and a cell not exposed to the test compound; and
   iv) correlating the difference or ratio with the estrogen response
   wherein an increase in activity of the reporter in the presence of the test compound compared with activity of the reporter in the absence of the test compound or with a control compound indicates that the test compound induces the estrogen response.

3. The method of claim 1 wherein the estrogen response biomarker promoter has an induction ratio of at least 2 when the cell is exposed to a medium having a concentration of β-estradiol of 10 nM.

4. The method of claim 1 wherein the test compound is a small organic molecule having a size up to about 5000 Da.

5. The method of claim 1 wherein the test compound is a nucleic acid derivative selected from a small interfering RNA, a micro RNA mimic and a micro RNA inhibitor.

6. The method of claim 1 wherein the at least one cell is a plurality of cells, each cell of the plurality comprising an expression construct comprising an estrogen response biomarker promoter of a different gene.

7. The method of claim 1 wherein the expression construct is comprised in a plasmid, a virus, a transposon vector, or an artificial chromosome vector.

8. The method of claim 1 wherein the expression construct is integrated into a chromosome in the cell.

9. The method of claim 1 wherein the reporter is a light-emitting reporter, a fluorescent reporter or a colorimetric reporter.

10. The method of claim 1 wherein the estrogen response biomarker promoter is SEQ ID NO. 19.

11. The method of claim 1 wherein the estrogen response biomarker promoter is SEQ ID NO. 20.

12. The method of claim 1 wherein the estrogen response biomarker promoter is SEQ ID NO. 23.

13. The method of claim 1 wherein the estrogen response biomarker promoter is SEQ ID NO. 25.

14. The method of claim 1 wherein the estrogen response biomarker promoter is SEQ ID NO. 28.

15. The method of claim 1 wherein the estrogen response biomarker promoter is SEQ ID NO. 29.

16. The method of claim 1 wherein the estrogen response biomarker promoter is SEQ ID NO. 533.

17. The method of claim 1 wherein the estrogen response biomarker promoter is SEQ ID NO. 634.

18. The method of claim 1 wherein the estrogen response biomarker promoter is SEQ ID NO. 641.

19. The method of claim 1 wherein the estrogen response biomarker promoter is SEQ ID NO. 653.

20. The method of claim 1 wherein the estrogen response biomarker promoter is selected from:
  (I) SEQ ID NO. 19;
  (II) a sequence of at least 50 nucleotides having at least 95% sequence identity to a sequence of (I); and
  (III) a fragment of at least 50 nucleotides of a sequence of (I).

21. The method of claim 1 wherein the estrogen response biomarker promoter is selected from:
  (I) SEQ ID NO. 20;
  (II) a sequence of at least 50 nucleotides having at least 95% sequence identity to a sequence of (I); and
  (III) a fragment of at least 50 nucleotides of a sequence of (I).

22. The method of claim 1 wherein the estrogen response biomarker promoter is selected from:
  (I) SEQ ID NO. 23;
  (II) a sequence of at least 50 nucleotides having at least 95% sequence identity to a sequence of (I); and
  (III) a fragment of at least 50 nucleotides of a sequence of (I).

23. The method of claim 1 wherein the estrogen response biomarker promoter is selected from:
  (I) SEQ ID NO. 25;
  (II) a sequence of at least 50 nucleotides having at least 95% sequence identity to a sequence of (I); and
  (III) a fragment of at least 50 nucleotides of a sequence of (I).

24. The method of claim 1 wherein the estrogen response biomarker promoter is selected from:
  (I) SEQ ID NO. 28;
  (II) a sequence of at least 50 nucleotides having at least 95% sequence identity to a sequence of (I); and
  (III) a fragment of at least 50 nucleotides of a sequence of (I).

25. The method of claim 1 wherein the estrogen response biomarker promoter is selected from:
  (I) SEQ ID NO. 29;
  (II) a sequence of at least 50 nucleotides having at least 95% sequence identity to a sequence of (I); and
  (III) a fragment of at least 50 nucleotides of a sequence of (I).

26. The method of claim 1 wherein the estrogen response biomarker promoter is selected from:
  (I) SEQ ID NO. 533;
  (II) a sequence of at least 50 nucleotides having at least 95% sequence identity to a sequence of (I); and
  (III) a fragment of at least 50 nucleotides of a sequence of (1).

27. The method of claim 1 wherein the estrogen response biomarker promoter is selected from:
  (I) SEQ ID NO. 565;
  (II) a sequence of at least 50 nucleotides having at least 95% sequence identity to a sequence of (I); and
  (III) a fragment of at least 50 nucleotides of a sequence of (I).

28. The method of claim 1 wherein the estrogen response biomarker promoter is selected from:
  (I) SEQ ID NO. 634;
  (II) a sequence of at least 50 nucleotides having at least 95% sequence identity to a sequence of (I); and
  (III) a fragment of at least 50 nucleotides of a sequence of (I).

29. The method of claim 1 wherein the estrogen response biomarker promoter is selected from:
  (I) SEQ ID NO. 641;
  (II) a sequence of at least 50 nucleotides having at least 95% sequence identity to a sequence of (I); and
  (III) a fragment of at least 50 nucleotides of a sequence of (I).

30. The method of claim 1 wherein the estrogen response biomarker promoter is selected from:
  (I) SEQ ID NO. 653;
  (II) a sequence of at least 50 nucleotides having at least 95% sequence identity to a sequence of (I); and
  (III) a fragment of at least 50 nucleotides of a sequence of (I).

31. The method of claim 1 wherein the reporter is Luciferase.

* * * * *